United States Patent 9,487,797 (GENOMIC PLANT SEQUENCES AND USES THEREOF) - sequence listing, part 25

SEQ ID NO: 58098 - DNA, 22213 bp, Oryza sativa
ctaggatcacctagggttagatctagtggggtggttctatttggaattgatgttttaactaaaaagattgaaaacggagagggtttaatatagaccgaccggttaaggtgttggagaataaaaaagtaccggcaatcgtcgtcgttggcgctcggttgtcgtgaatgcggcaccggtaaggtctacgccgatgacgcctgcgggagtgagggtcgtagatgtcctgccgataaggtgtggcgggcggtggcgcttcccgtcactgactgcgccccctctcgatcgaattagggtttgtagggtggagttggcggcggcggtgaatctcgtacctcgtgccgtgccggcctccacccctgttttatatggcgcagtgtgacggggcccaccagccattgggctggacgccccagatcagggcgcggtcaaggcccccttgagccgttgggctcaaggggagggagatcaatccaccaatacatacatatatacccatatatatatatatatatatatatatatatatatatatatatgcaatgtcaatatatgcatatgtgttaccaaccgggactaaagttctttagctcccagacaggggtctgacgtgccctgtcagggggcgaaccgggactaaagatcccttagtaccgttgtagttataaaccgggactaataaaccattttagtcccggctattgtggaaatcgtccgaccttttaaagatcacttctccagtagtgataagtacgtaccaaaaaaagtatacacacatatcgatcacactgcacagtaacacacgctatgctatttgcttgttgaaaaaaaattaaaagtatatactttttttctacctgattttacgagaatatatatacatgttcgaaaagaattgacaagaatataccatcgtcgtagagcaaatgtgcgaacttgcgcgccgctttgctgcgcctagcgaactgggcttctgatgagatgctaatgattcaattaattaattattaatttctaactaggaagataacccgcgcatttgcacgggcatacgcattagtttgtttcgaaaatagttctaacaaaataaattaaaattaaagtaacgtattttctattttgaattgagtgttctttatatctctctttcgtgaagaaatctcaacaactttcattggttttttttaccatcctgctagccctctctttaattacatgcaattagttatgcatgtgaatcaatatagatagaaaaaatcatttaaaaaatatttattgtagtagttataattattgggttcacctatttaaaggaaaatcaatggtttgttttttatcataatttttaggatttttaatttatttgagcgccatatgacatcttaagagtgtttctagcacaccacgcatgcgataggttgagcccgtttgtagggagtttatttgatttttactatataatagatacttcctccgttttataatgtaagtcattttagtatttcctacatttatattgatgttgatgttaatgaatctacatagatatatatgtctagattcattaacatcaatatgaatgtggaaaatgttagaatgacttacgttgtgaaacggagggaatagttaatatagcatttcttatattattgtttatgtactgagctgctagctagaaaatttggataaaaaagtgagcaggtgagataacaggagataaaatgatgggtctactatattaaatattaagtgaaaatcaatgatatgatgtttttctttttttctcagaactttttagatttctctaatttactagagcgccaagtgacggcttagtagtatttgtaggagtcacgtgacggattaagagagtttctataaagtttagttagtggacttttatatataacctggttttttcagctttatcctttttaatttcggttcatacgatcgtacgttacgttgatataaacgtaacatgtaattattttttttaggtagtacatttatacgtacattcctctccatccacatatgcataggataggaaggatgttttttgtttttttttctatttatgaatagtacatcgtacctttatctccatccatttgcatcagatccatattagaaggaatgattttaatatatttaatctaatggcctgaaatatcggacccactaatttaagtgaaaattaagggccatatgttttactttttttctcagaatttgtaggattttctctaatttattagagtgccactgtagcacaccacacaatgataggttgagagtgtttgtagagagtttatttgatatttactatataatagatagttaatatagcatttcttattatttatgtactgagctgctagctagaaaatttgggtaaaatagtgagcaggtgatgtaataggagataaaatgatgggtccaccatattaagtgaaaattaattatatgatgtttttctttttttctcggaattttttagatttctctaatttattagagcgccatgtgatggcttagtagtgtttgtaggagtcatgtagcggtttaagagcgtttataaaaagtttagtgacttttatatataacctggtttttttggctttatctttataatttccgatcttacgatcgtacgtgaagttcatacgaacgtaacatgtaatttgttttttttttgtgttttaggtagtacatacgtacattcctctccatccatatgcatcggataggaaggatcttttttggttttttctctgtttacgaatagtacatcgtaccttcctctccatccatttgcattagatccatattagaatgaatgattttaatagatttaatctaatgacccgaaatatcgggtcctctaatttaagttaaaattaagggctagatgttttgttttttttctcagaatttgtaggattttctctaatttattagagtgccacgtggcggcttgagagcatttttagaaagccacgtgggtgcttcatagcgtttttagtaagattaatggatttttagtatataatagatagatagatagatgatgttgcgagagatgccaatatgagagctgcaaaattttgcgagatctttagggatattgttggagctagtcttttacttgtaaaaatggtaaattttgatgtggggaatgattttgcaacacttgctaagccaagctacgactcaaagcacaacttgaatccctcaactagtcatgtttgtttcggcttaagattaattactataatctagattattaagtcagattactattaactgaattataataagccgacatagaataagttgttagctgtttgtttctgtggattattagttgtttgttagttgttagccacctaataattaaaaaagcacttttaaagtggattaccatattatagtaagctgtctgtttgtttcagcttactccgaataatttggattataataatcctaagctgaatcaaacagggccttaagttagtcacatagataaccagacacagactatgtgttcttgcagttcctttttccacattcctacttggggaaaaaaatcaggatttttgaaatttaaataccattaggccaaaagtaaatatttttggaccaatttgttaaaacaaaattccgaggctgaaagtttcgaaaatgctcaaaatcgggcgcccgaacagtgcaaaaaatcgggcgcctcccactcgtgcctctgcctcgcctcccacacgtgcgtgtcgcccccaccatatgtccccaccactcgcgctccgttgcaacaaccacccgatataacggaaacgcactatcaaggggatttgttttatttttttccaccaacaatatttcaggtagtgtactcgtgatgtttcactatgtatggatgaaatgttgcagtggattttggtactatttcataatttcatcttaatggacatgtgatttgttgatgtatacgtggtttaagtgttgcaatggctttaaattgtttgctgcatacgttgaaccaaattattttatctagtgatcttaatgtttttcatattttttaagaattgaaacattctttcgctatttgctgaaacattgtttttatatagggtgaaacaacgcccaattttttttggaaaccgttgtttcatacatcttctattatatactaaaagtccatttgtcagggttacgggttaggtatatcctttacccttcgatatacgtcgcatatcggtatggcatacctacgcgtatatggatactctctgcatacactaaggaaatcctttacggagtttatagaaggaaagaatcctactcggacaagactgggtcgtcagtgtatcatgtagggtctgatgtctccgagttctacttggaaaccgcctgacctgcgatataaaagggaccccccggggaggacctaaggcatcgaatctcagagccagcacaacccccacagcctacgaagtcggagcctgcaggagccaaaccgccggagatctagtcgaaccaactcgattacgatcttgccggatccatcgagttccatcgttccttttgtaacctgtgttttccatcatataatcccacatcaactggatttgggctattacttattaaggggcctgaaccagtataatcttcgtcttctgtttgcttgatgtcgtattacgtagacccttgtaccaacgtaccccaataccctctatatccggtctacgggtatcacccgtcgacagtggcgcgccaggtaggggaacatggtgctcaaggttctactactatgtcatccagcttcgccgacaaccgcgtcaacaccaacctccaccggggatttcctgcttcaataatgctggtgtggactcaagtcgacgaaatcgtcttcccggtttacaccacgatcccgatctcagccgacccatcaatgatcagaaacgagaacgcaatggctacaacccaggacgactccatgtcgaaggatcctcccgccgaagcggagaacggaacatcgacgacatccgagctcgagaaggattctaatgcgaccaaaccttgtcgtttagacaagagccacgagccaacgagaatgacttccgaagcgacaaggtcctggtgtcctatccacaaaaccatgaaacacactttgcaagcctgctgggtttttctcaacgtccgcgctgaaattcgcgcctgcaaagagcgtggaattcagcgtatttctccaactcgtgatgtctattgtcctattcacaagacaaagaatcacgacctctcaagctgcaaggtcttcctcagcgccacgaagacgtcatctcctaaggtccagcagtcaggcatatcccttagagatgaagacaaggaacaaggaacgacgctggtttcagatcgattcgtaggcgtaatcgacatcagctcacccgaaccatcagtcctgcatctactcgaggactatggctcatcgccagcaagtacgccgcgcgaggtattagctatcgacggaaccagcacgtcagcacacgctaatgcggaaacacaaaatcaaatggctacaccggcccagcacatcaggaccatcaacgcaatactgagggagaccccttacgatcccgttctaaacgatgatctcgcacaatggacagaacggctacgggaatcaagaaccaacctcaactacgcgttcgaagaagccgctgctgcggcgcacccggaacagccactaactggcggtgccaatggcgaaaatcccaaacagcaggagtcaccgcatcgagctaccccccacctcgcggcaccggcgatctccgcaaccacctcaatggccgccgagaggcacgacgcacatgagacaacggggatcgctcccgataccgcgtctcttcacgatgtcgcgataatgaaagacaggaaggccgctcgaacgaagaccgagactgtgttaatcgccacgatcgtgagaggcggacgcagggcgacgctggtcgaggacaccgccataatgacgaggacgacagagatcggcgccagaacaagaccggagggcggcgacaagattctcgagaacctagccgacgtcctcgtaatcctacactggaaccaagtgatccatcgtcatcgtcgtcttcttcttcatcctcatcattagacagacatccacgaaggacacacgatcgccgacaacccaccgcccctagcgctgggtgtagagctttcagtcgttccttgcgtgatgtccgatggcctgagagattccgacccagagcaatagagaagtacgatgggagcaccgacccagaagagttccttcaagtttactccacagtactctacgctgccggagcagacaacaacgcattggtgaattatttgccaactgcgttaaaaggctctgcacgttcatggctgatgcatctcccgccctactcaatcacttcgtgggcagacctgtggtagcagttcgtcaccaacttccaaggaacttacaagcgccacgcgatcgaagacgacctacatgcgttgacacagaactcgggtgaatccttgagggaatatgttcggcgcttcaacgagtgcagaaatacaatccccgaaatcaccgatgcttctgtaattcgcgccttcaagtccggtgtcagagatcgctatactacccaggagttggcgacaagacgcatcacaactactcggagattgttcgagatcgttgagcgatgcacccacgcaaatgatgcgctgagacgcaagaacgataagccgaagaccgggggagagaagaaaccagccatggacgcacctgagtcaagcaagaagaaaaatcgcaaaaatgggaaaagaaaagctcaagcggaagttctcgcagcagaatacgcgaaccctcccaagcgcccagatccacaaggtagcgacgtgaagaaagcatggtgccccatacacaagacggacatacattctttggaagattgtcttgttttcaaaaagtcgctcgagaagcacatggcatttgaaaaaggcaagcgagtacgcgtggtcgagaaggatgcggaggcggctcctcaggaatcggactcaacatatccagactctgacatccacgtttcacacattttcggaggttccacagcgtactcctcaaagcgagaatacaagaaagtggaacgtgaagtctgtttgacatggcagggggctgcacccaagatgaagtggtctgaacagaagatagaattttcggaagaagaccatcccaagactgccatcatcccaggatgctatccgatcatggtcgaatccactattcggaacatcaaggtcgcgcgggttctcatcgacggtggcagctcaatcaaccttctcttcgccagcacttaagacgtgatgggaattccacgaagcgagttgacacccaccgatcaacccttccatggaattactccctagtcctcgtccaaaccattgggcaaaattacattgcctgtgacttttggccaagcaaacaacttccgaatagagcagatcacctttgatgtcgctgaattcgatacagcgtataacgccatcatcgggagaactgcacttgcgaagttcatggccgcatctcactacgcgtatcaagtgctcaagatgccaggaccgaagggaacaatcactattcaaaggaacgcaaagctggcggtacaatgcgacaagcttagcctcgacaaggttaagcaaacgcctagcccacccgccacaactgagccacccaagaaagtgagaaggacaaacaagacgccaaaaccggacggcgcgatcaagatcgttccactctctagtgccaaccccgataagaacgtcaagatcggggcatcactaagcgagaaataggaattcacgctcatcaccttcctccgcgacaatgctgacgtgttcgcttggcagccgtccgacatgccgggggtccccagggaggtgattgagcacaaactcatggtgcgacccgatgccaagccagtaaagcaaaaactgcggagatttgcaccagaccgaaaacaagccatacaagaagagctcgagaaacttctcaaagctggcttcatcagagaagtacttcatccagagtggctagccaatccagtcatggtgcggaaggccaacgggaaatggagaatgtgcgtcgatttcaccgacctcaacaaggcgtgtcccaaggatcaatgccctcttcctcgaatagatcaattggtggactcaacagccggctgtgagctgttgagcttcctcgacgcttactctggctgccaccaaatcagcatggcgaaagaggacgaagagaagacagcattcatcacgccattcggggtattttgctttgttaagatgccattcggactgataaccacagggaatactttccagcgcacggtacagggcgcacttagcgaccaactcggcaacaatgttgaggcatacgtcgacgacattgttgtcaaaaccaagacaagtgactcattgattgaggacctgcgggaaacgttcgacaacctccgacgatatcgcctcatgctcaatccaaagaagtgcacgttcggagtaccgtcgggcaagctgctcggtttccttgtctctggcagaggaatagaagcaaatcccgagaagatcaaggcaatcgagaacatgaagtcacccacaagactcaaggaagtacaaaagctaaccggatgcatggcagcactaagcaggttcgtcgctaggatgggagaacgaggacaacccttcttcgctctgcggaagaagcaagacaaatttgtatggacacaggaagctgaagaggcattcgttgcactcaaggactacctatcaaacccccctgtacttgttgctccccaacctaatgaagaattattcctctatattgccgccatgccatattccgttagcaccgtcattgttgtcgagagagagaaagtacaacgaccagtctactacatcagcgaagctctccatgacgcaaagacaagatatccacagatccaaaagctgctttacgcggtaatcatgacatcaagaaagctacgccactactttcaagcccacagagtcacagttgtctcctccttccctctcggtgaagttgtgagaaacaaagactttgtcggctgcattgcgaaatgggtagtcgagctgagccagtttgatgtccactttgtgccacgaacagccatcaaagtcccaggtactcgccgacttcgtagccgattggactatgcctgataacaaatcagacaaccaaatcgataacgaaacatggacaatggcgttcgatggtgcactcaacagccaaggagcaggggcaggattcatcttgacatctccttccggagaccaattcaagcacgcaatccacctcaacttcagggcgaccaataacacagccgaatacaaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggttcgacacgtataccgcaaggacaacatcgagccagatgacctagcacgacatgcgtccagacgagaaccgctcgagcccggcacttttctggacatcctgacaaagccatcagtgaaagaggttatcgacgaagttagcccagccgcccccgacattagctcggaggccacagaggcagaacgcgccgttgtcgatatcgagaccacagacgactggcgcaccccactgatcaaattcatcaactgcgaagagttgcccgaggacgatgcagaggccgagaaaataacccgtaaagcaaaaatctactgcatgatcgggaacgatctatacaagaaagcaccaaacgggatacttctcaaatgcgtctcgtccgacgacggcagacaccttctccttgatatacatgaaggcatctgtgggtcacacgccgccggacggacattggtcgggaaagctcttcggcaagggtttctctggccaaccgccctcaaagatacatgcgacatggtccagcgatgtgaatcctgtcaattccatagtaaacacacaaagctacccgcgcaagcgctccagactatccctcttacttggccgttctcgtgctgagtgctagacatactcgggccattcccacgaggacagggcggctacaggttcctattcatgacgatcgacaaattcactaaatagatcgaagcaatacccacgggggaaatcaaggccgacaacgccatctaattcatcaagggggtattttgcagatacggactaccgcaccgcatcataaccgacaacggctcccagttcatcagcgccgatttccaggattactgcatcggactgggagtcaagatatgcttcgcctcggtctctcaccctcaaagcaacggacaagtcgagagggcaaacagcatagtactacaagggatcaagacccgcgtctacgatagactcatgtcacatgacaaaaaatgggtcgaagaactcccatcagtactatgggccgtacgcaccacaacgacaacgtctaacaaggaaacacccttcttcctcgtgtacagctccgaggccatgctccctagtgagctacgacatcatagtacacgagtacagaagtattccgacgaggaccaggaggagcagcgaaacgtcgatgtgaatctactcgaggaacatcgcgaacgagttgccgtcagtgcagccagttaccaacaagccctccgccgctaccacgagaagcgcatccgagcacgcatactttcgatcggtgactacgtcctctgacgggttcaaagccaagcagggcgaaacaagctctcacccaaatgggaaggaccttacacgatcacacaagttttgcggccaggcgcattcaaaatagcagacggtgatggttgcgagttggcaaactcttggaatattgaccaactacgtaaattctatgtatgagtcaatatcatccacacctgtaagacgccttacaacatcaatggagcctatttttaggtgcatattacaatcaaagtgttcctgcccgatgatcccttacccagatgacacctagcgttgaaacctatcctcatgtccctttacgccgtcttaacaaggccttcgaggaacctaagggatcttcggctggggacgcccagagccgataaggccttgtcagatcctatagggacgaaagaccatgtaagacctggtcgtgtaagagttctcgccgtgcgtattaaccaagctgcgtaatcggaaattcactttccaacttcacggctgggggctaggatcagtgcttattcaaccaaggcaggtcaaaggtccaagagccttaccctccgagaagaatcctccgacgacaaggctgggggctggggagagtgtatgactcaaacgattaactaaagttgtgaattgagaacacactcttacacacggtacccagaacatccatcatagggtacaaagactaccaagaaggccaacgccagttcatagactggaagaccttctccgccaacggcgccatcgacttcgctaggtggtctatctccgtcggagtcctcctagaacgagcgaaaccttcatggagaaactcaaggtccagtcgcggacgatgatttcgtaggcaagccaacacgtgccctccggcatatcggctcgatcgacgacattcctgcttcaagggttcgtcaatgcgtttgccgacgccttcgagctgagtacacgccccattcagccacgagatgtatccggccgccgactcttcgggatccccacggggtactcggagctctctacaaaccttggccatggacgtgcagcaactcttcaagtacgagttgaaccacacctcacgacctcagagcgtttccacagcttgctctttctttacttccagcatagttctctcgagttccgctacttcaaatttcgtcttccaatattggatacgacgatcttggccagcaagagcactctcgagatctgttcaatatggaaacaactaagtcaagctgcacccttctttcgggaacacggctgatcaagtcggaggagcaaaaagggatgaagggaccactaacctaaggaagtcgtcgccatcttcgtcctcgcggctaaaatctgatctacatcgtccggcgacgcgtgtggctcaaacgcaagagccggaatgatcgccggcgacttaggctgcccacgctgctggacatcctcgtcatcaacatctctacaaaggacaaaaaagtactcgagatcaaaatgctaaagaaaactaaggtgatgactgcatgcacaaaggcggttggaacccattggagttttacacagcatgtctaaggaatacaagagagtcaaaatcctactctttaaaaagggggagaacatattcccccaggtcaccgacttcttccatcacctccttacgcgtgtcgctagccgccccctgatccaagatctcgcgcagatcgagttcagggtgcgtcagcctcaaacacgcaaggacgtggcacgccccggtgtagatcccgttggatgtctcctctccgatgctggccgcatgcttggagggaatctcctccatcaccgccgccagctccgcaagagaagatgtcagcaagaactcatcgggattcgccgggatagtagacttgataccgcattccccagcgagttggtgcagaccagtataggtgacccgcaacgagccacggatttccgacaagttgttcccgagctccgacatgcggtgctcaagcccctgccgttgtcgctcattgccagccaccaactcccttatcttcttgaggtcctcacgagcctccgccaagtcgtgcgccagccggtcggcgcgctcgttcgccgatgccgccgccgacctcgcctccataatctcgtgaccaatgccgcgagcactagcctcgaggaggcgccccatttcaacctggagctcctcccaggtgaggacggcagccggtggaccacgaccagccgcgagatcgctggctgggccgcttggtgtcgcctcgcggcttccgggcacgaccacgacatccgtcgaggttacagaaggaggcgcgccggaagtccctccagactcgtcttgcgccgccttcgcccgcgccgccctacgagaaggctgtggtttagacaaagttcgacgaaatcacgaaaactcaaattcattcacttacttctcgccgagtgtcacaagccgctgccgtcgtggaggcgggggagacgcgtccgaggcctggagtataatcgatatgaagtcaggtggaagtattctgactacgtgatcaaatgacaggagaacttaccgagggggtaggtgcctttcgacgatgtccgattacagaggagaatttcctcccctttgttggaacgtcgccaccacttgttgtggcagcaacagcagcagcatcggacacctccttggcgactttctctttcagtgacgccgccacctgatggtccgcgagcggctcgatgatatcagtcagaggaacaacctacgctttattaagtcgtaaggcgatctcggaagaaaaacgcagaaggcccactgagtacacttacattgatggcagcgttgcgtttggccgcccccttctcgcaaaggggaacggggacattgctcgccgtcgtcgggccactgatcatcacctggccgacacgatgtctcacggcttcgccgctcagacctgtgaatcgagaaccaaagttcgataatgtcacgaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggggttataccataaaggggttagggttgcagtaaacagcatttaaagatatttagttgctcagggctattttgtaaacacgattctagaactaaacaatattctttatcaaggccgtgaacccacacgaacctgccttaacccaaggcctacgatgattcagaccgaactggcaacccgaccctgggtcccagctcgtcccaagccaacccagaccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgggcccagcctaaaaccatttttggggattttgaatagagggggcggtgtgaatccaattccacaatactccaacaattccacagtgtccaggtgatatgaacattcccaaagtctagagttgtaaaaccgcctaatgttacctaattaaaagcgaagcatctacctataatcatactagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttgcgccggccggcgccgtgggtcccacgcgttagccgcactcgagggcgcgggcggctgacggccgggccccacatggcagccgcggggcgcgcccgaaggcggcctcgccggcacggccgacgggaggcggcgcgcccgcgccccgatggtcgccggcggcgacctccggcgcgacggagcggcgcccgagagaggggagggaagggggaagcgagatggcggtcctcggctcaccctgggtcgacggcgacgacgggaacggcgaccgaagcggagagaggcggcggcgcggctcgggtcgacgaggacggcggcgttccggcggtcggcgggcgaaacgaaggggtggacgaggtcgacgaggacgcggcgaagccgaaggaggcgatgccgaagcgggaggaggtccggggcgacgacggcggcgaaccgaagctcggcggcgacggcggagagagaggacgacggcgcgagctcgattccgacggggagagaaagcggcaagggtcggaaacggaggagggaggcatggggagtgcttaaatagtgttgggagtgagagagggcggccggaggggaaggaaaccggcgcggcgatctcggctccatcaatgacgccggcgaagtttgcgggaggatttccaaacgaatccgagagagagagagagggaaaagtggggggaaagggggagggaatcacggggagtgatttccccctctttattgcgcgcgggggcggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcgacgcgcgcgcgggggaaggccgatgggccgcgggggagaggagagagagggagggagctgggccgagccggcccaagagaggaaaggggggggaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctttgcataatttcgaggatgtattttagagtcaatttgggacgcgacagataagtcaggagaaacgcgcacacaagtaagtcagggtaaatgcaagaaagataccccgaggagaaacccgggtcgtgtcctccggtccagaatagtcaaaggctggatgggctcgagcctggagcggctggatccgtctaccaatgaagtcagcagcgacttcataccccgacaaacctcgtactcggagatcgtcgacaacatcgatgaaggactaaagggaaggggtcaaggtgggctttgcggtccaagacgaaatcttgtctggttgttcctcaggaacaacgaagataggatccgaattttctatctgaagatagaaccacctcctccgccatttgctgcgagaggaagggcactggaaggggatataacgcgacttcaggccatcccgaagtcggaatccaacgcatccagacaccctgttggattctatccaacgcaactcgtagtagaagcgaaagagatcaagaaagggctctacgccaatgtaggcctcacaaagatgtgaaaaaatactaaggaaggcaatagagttggggttcagatagagcaaagaaaggccgtagaagttcaaaaccaagagaagaaattcagaaggcggagggagaaaaccgcagagaatgtagtcctcgatcgcaaccatgtgacctaggacaggttggggttcagtacctcctgcttctctttccatggtcccgcgaccaggaagggcgccatcctcctaaagcttcttcagtgacgcgctggtggaggaagatttgccgagatccatcgctgactggagatcgccggaggaaggactgagattgacgagctagggttttgcgggagcggagaagacgagaaacgcttggaggctggaggttttcttcacaacaggcggacttcaaaatggatccccaaaattcccttaaatagacgcacttccgacggtgcgaattccaaggaaaggagagagatagccgccggaaatttctgggtccgttacgcgtggaaatctttcggacttcagtttaaattcactcatgaccgttgggcttcacatggtgttctcgactatgtcctgtctctacggttttcacaccgggaatgacaacagcctcgacactagaagtcgcgaatggttacacgagttcatttaagcagaagtcgggggctactatcagggttacgggttagttacaccctttacccttcgatatatgtcgaatatcggtatggcatacctacgtgtatacggatactctctgcatacactaaggaaatcctttacggagtttatagaaggaaagaatcctactcgaacaagactgggtcgtcagtgtatcgtgtagggtctgatgtttccgagttctacttggaaaccgcctgacctgcgatataaaaaggaccccccggggaggacctaaggcatcgaatctcagagtcaacacaacccccacagcctacgaagtcggagcctgcaggagccaaaccgccagagatctagtcgaaccaactcgattacgatctcgccggatccatcgagttccatcgttccctttgtaacctgtgttttccatcatataatcccacatcaactggattagggctattacctatcaaggggcctgaaccagtataatcttcgtcttctgtttgcttgatgtcgtattacgtagacccttgtacaaacgtaccccaataccctctatatccggtctacgggtatcacccgtcgacaccattaatcttactaaaaacgctctcaagcagccacgtggcttcctaaaaacgctcttaagccgccacgtggcactctaataaattagagaaaatcctacaaattttgagaaaaaaaatcaaaacatctagccttaattttcacttaaattagaggacccgatatttcatgccattagattaaatctattaaaatcattcattctaatatggatctaatgcaaatggatggagaggaaggtacgatgtactattcgtaaacagagaaaaaaccaaaaaagatccttcctatccgatgcatatggatggagaggaatgtacgtatgtactacctaaaacacagaaaaaaaacaaattacatgttacgttcgtaagaacttaacgtacgatcgtaagatcggaaattataaagataaagccgaaaaaaccaggttatatataaaagtccactaaactttatataaacgctcttaagccgctacatgactcctacaaacgctactaagccgtcacgtggcgctctaataaattagagaaatctaaaaaattctgagaaaaaaaggaaaacatcgtatcattgattttcacttaatatggtggacccatcattttatctcctattatctcacctgctcacttttttatccaaattttctagctagcagctcagtacataaacaataatataagaaatgttgtattaactactccctctgtttcataatgtaagtcattctaacatttcccacattcatattgatgttaatgaatctagacatatatatctatgtagattcattaacatcaacatcactatgaatgtggaaaatgctaaaatgacttacattgtgaaacggaggaaatatctattatatagtaaaaatcaaataaactccctgcaaacgctctcaacctgtcgcatgcgtggtgtgctacaaacactcttaagatgtcatatggcgctcaaataaattaaaaatcctaaaaattatgataaaaaacaaaccattcattttcttttaaataggtgaacccaataattataactactacaataaatattttttaaaagattttttctatctatattgattcacatgcataactaattgtacatatatgagaaataattaaagagagggctagcatgatggtaaaaaaaccaacgaaagttgttgagatttcttcacgaaagagagatataaagaacactcaattcaaaatagaaactcaattcaaaatagaaaatacgttactttaattttaatttattttgttagaactattttcgaaacaaactaatgggtatgcccgtgcaaatgcgcagagttgtagaaaaatatttcatgaggtaatttggttgtcttttagctttttatataattgaaacattttcgatttactaaaaatatgttcgatctactcggtgaaacttgatattttttcccgattcgggaatgttttcatgccgcggggtctgaagttcctgaattttcggaaatacgggaagtttcgaaccgaaatttcagggctgacggaaccaagctgccgcctgttcaattcctatttcagcgccaccttccctcccatcctcggcgtctcctcgaccatcatcgccgccgccgccgccgccgccggcggctcgcctcatcctttctccggccagccggtcgacctctccgtcagtttctccgcgccctgtcctactcgctggggtaaccaccgccatcgtcttgctactcctcttcgttccctacaaaatcctacgagccatttttcgttttggggttttggggttgggcaagggggaatttgagggctgtgatgataatgatgctttttcgttggtgatgccgctgatccagttttgcaatgggggatcgatcgacgccgttttctggatgaatccgtccttgaaatcggccattttacttttccttttttgggatcaaagaggtaaaggggttcttaatcttgtagaagaaatggccttggcaaagcagttgttaagtgttgtcgattaggtttccagcaatctgcggaggtggaatgatttggggactaatgtggttttgttatttgaggcctcaaagtctttagattggtgggtgaacataacggaaatttgtgtgattgataaatcaggtattgggatttgtggattggaggaactgggtgtgataggttatttttatcaacgtccgcaagggatttatggttcttttaggtatggtggcactggcaccagttaattaagggttcttgttgaggttgatcatttcttgtgctccttgttgaactgattcccgatttataatggaaatataggagaaaaaaatgtggaagagtggtgaaaattggtcttgttgcttttagtgaatggtaggagcacatgctttgcatctttcatataatcatattgcttcaaggaaataattgtgccctacccgtgagaaggaattggttgcatgttttagttgtattggcatatatctctgatgtctatgttgtaatagttcagagcatgagtgcatgacagcattgtgttttctttgcggatgtgcctgttgtagtggtagtggtagatgattcttttcctctttagaaacatgcagtccgtatatcttttaggaagtcatataacagtggaaattcatcatattgttctctagcccatttttcacttcgattcttcactaaactttcaatagttccagtgtgttttattgtttaaagcacaaaaacttgatgtttgattcttctgatgtagaagtaacaatctaatgttagttagtttgatgatattgggtgccttgaaattgtcgattccgttggattaatatattaatcaaagtatggtgagtgtgtggattacatacagcagccagactcttatatttctggaaactccgatccagcgttaagactagcgaattactctgttgtagaaaccagactgtaatttttaccgagtcaagtatttttttttggcgtaaactgggaagcttctttctaattacttaaacaagttttttgatccagccatttgaatatccatgtattggatgtgtattctgttacatattcagttagatccttgattttccatcctgcagatctgttcctttcatataatcccctcaatttcaaattcttgttccaaactttatcttttattatggagttttatcatataataatagtaattttgataggtttgtggtgacaactttgttcttattaaggtttgcagcatgtgtacgctctgacatgatgtagggtctgaataggaagagctagcacctgtgtggaactgcataataattttgtaatctgaaaaatgttacttacatgctaaattgtaattttctacttctcttgtgctttctatttccaccttatattaactgaaatctcattcttgttaccaaaagcgagctaacctatctcatgccatatctgaacatgcttgatcaggtccatc

SEQ ID NO: 58099 - DNA, 38219 bp, Oryza sativa
ggcgccgccatctccgtcgtcgccgttctctctctcacttcacgcgggtggagggcgagagacggtggggggagaagagaagagaaaaggcgctggccatggcgcggcgggcgcgaaggtcgccggcgatggtgacgccatccacgcggtcgcgcgagagagagaagagaagagaagctagggttttcggcggccggctgggagaggggggtttttgatcctccgatctcggcgcccggccgtccgatcgaaaccctagctgatcggacggtcgacgccggccgggccgaaatcggcccaagagggcgcgcgcgggggggcggctttcctggcccaggcccaggttgcggcttggggaagggggcgcccgcccgtgccaaaaggccacgggccgaccggaaaaagtctgtttgaggtccctcggggccgaaaacaaagaaaagagaacagtagcattttttccaatttattttgtcgatttttcatgcaaatttcaatagaattttgaatagatttttgcatgttttacctctgtttaaatttgaaccaacgggagaattttcacagagagagaattacagagattttgctactgttcatatgatttttatatagttttccgctgcaaatagatgtaattgatgaaaattagtgtttctaaaattaaatttcgaaccaacgggagaatttaattttaggaacattaattatgtgctatgatgttgtaattttctgaccaacgttgttaattgcattattatagttatggttataagtgttatgtctaatttctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtgttgactaccccatgtcctatagaacctgctgaacttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgactttctgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaggaagagaaagctccattagagttgccaatggagttgaagaaaaagttgaagctgttggagatcttccgctagagctcgcgaatggcttcacacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaacttccaatgtctcatcgaaattatggcactgtcgtttgggccatatttcgagggggagaattgagagactagttaagaatgaaattctttccccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtatggatggctatgactcgttcataacattcacagatgattactcccgctatggttatatttatccaattaaagagcgatcagaagcactggataaatttaagatattcaaagctgaagttgaaaatcagcatgatataaagattaaagtagtaagatctgaccgtggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctacagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacagcctcaaatagataatgtgccagtacaggagactcatcaagagcctcaggtacaggatgtggcaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttttcatgaaaggaaacgaaaatatgggatgtcgtctaaagagatccatttatggattaaagcaagcttcgagacagtggtacttgaagtttgatgggacaataaaaaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtccacaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccataaatcagtatgagctcaatgaaatgaaaacaaagccatatgtgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgacttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggtgattgaccgtgacgatgaaacatgctctatttacaaatctgtgatggaatagaaaaagctaaaagaaaaagtgagatcaagggggagaatgttagattgatctccctccccttgagcccaacggctcaagagggccttgaccgcgccctgatcgggggcgtccagcttaatggctggtgggccccgtcacactgcgccatataaaagaggggtggaggccggcacggcacgaggtacgagattcaccgccgccgccaactccaccctacaaaccctaatccgatcgagagggggcgcagccagtgacgggaagcgccaccgccgcgccacacctcatcgccaggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaatcccaaatagaaccacccgactagatctaacctaggtgatcctagtgcaaagtccaacatgtatatatatatgtatgtatgtatgtatgtatgtatgtaccataaatatctctatatatatgtgtgtgtgaagcaggcagcacaaccaaattaaaaataaataaataaaatctttagtcctgattcctggttggtgttaccaactgagattaaagatggagctttacttccgggtatttgaatcgggactaaagactgtcatctttagtcccggattcttcctcccggttcgctacacgggagtaaaggggttacgacctgggagagatgagcacttctccggtagtgtgcatcgatcgtttggtcgtccctccgacaagttgcgtcgggtgaagctagatggagacaaatgagaattgactcaggactccattctgatcgatacctatagctagctagctaatgagcagtgacgatcgcgaattcgggatcaacatggcagcaaaagaattgacactcgatgggatgcctttgactgatcgaagtgctgaaatcaatgggctcgatctgctagcatatcatgactggaagatggcttatcgattattggtcatcccttcgcacctatgaattgccgcgttggtccagcccgtgatgtatggtgaatgatatagtatcctccctccgtcccacgatataagggattttaagtttttgattgcaatgtttgatcacgtgtctcattcaaaaatttttttgcaaatataaaaaacaaaaagttgtgcttaaaatactgtagataataaagtaagtcacaaataaaataaataataattttaaaaaaatttgaataaaacgagtggtcaaacgttgcaagaaaaactcaaaatcccttatattataggacggaggaagtaattatcggagggtcgaaacgaataaattgaatattagtaagttgataaggtgatacagaaattaaagttctctaagagaaaaaactgataaattaaaagtgccaatttgcaaagtatgcctacgataatccatactattattatgatcgaccaataagctgaaaagaacgggacgtacgtaagcgttgcgacactgtcatgtgaagtagcgccttgagtcatcatcgtcaacgctacggatcggagctccttcaccaattatgtgcatattcttagatgacgtaaagagctccggaattcttcacttccctaacttgaaaaaaaaaataatacctccatattttaatatatgataccgttaattttttatccaacgtttaaccattcgtcttattaaaaaattatataattatcatttattttattatgacttgattcatcatcaaatgttttttaagcatgatataaatattttcatatttacataaaaaattttaaataaaatgaatgatcaaacattgttcaaaagtcgacgacgtcatacatatacgaagtgagtaatagttaccgcgtactccctatacaaggggcgacgatgctgtctgttttccaaaagaccgacgaagctagctagagtcaagtcaacatgcaagtggtacatcgtgtattcacatttaagctggccccgactaatcatcgattcattgcatgcatttaccagccgtgcctataaattaaggtaaccatacctgcaaacacactgcaaactcgcatatgtgcacatatcaatatatcatactagtaccattctgccggcatcaagttcgggcttcgagtgcccagctaccgcgagctgtaagcttctcttctgtagtctactttcacttgttatcatgggaagtaggaacatgtcatgttattcttaagttaagcattcgcatcttttctaaatatccaaatgttgatggctgtatgaattatctacagctagttcattacaaaatataagccgtatatatatatatggttttaacgtggtcttcattattatattttgacaatttatttgtttcaaaggacatcattaacaaccagaatcatcatcgtataaaaatattttaaaatttgaatccaaaacactatcacttgtgtagttctacaagccatgcacctcatatgtatggttctacctcgatcaaaagctagtcaaaacgatcccatctcaaaccgtgttcatcagacgcatttagattgctaagcacacgtatataaaagtttatttttcagcctttgcatttagattgctaagcacacgtatataaaagttttatttacaaattacaaatatgttgtttcgcttattccacaaataaacgaaacgatgggtccgtacgttgatcaaacaagctcactacgaaggttactactgtgagtcttgtgtacgttcttggcctcgtccttccatatctagttagtttttttaaaaaaaaaaagataatgtaaatcgtttacatatctagtttttgccatagggtatatagactatagacataaaagagcattgctaaattagaaaaaaacagaatagggcgacgggacagatctcgacactccactcaaataaacgagaattcgattggaagtcatatggtccgttgattgcttataatcgaacagtctataatggattgggcggtatatatctataggaggggattaaaatgtgagccatgtattaatttaaacatggaaggaaaacactgcatgcaataaacacattgcatagaattgtaatttgaggcttagtaatccacaattttttaaacctagcaaatccctttaaatttattttcttgcacatggaaagcagcgtttacaattttggttcgaaatttcgataattttggtccccaccggcaaatcaatataccgatagaaattttcagattttctcttttttttgtggaatttggtcaaatttactcaaattcgatcaaaatctttcaaaatttcaaaaaaataatggtccgaaaagtgccgaaaatcatgaaatttggtaaaatttcggtcctaccgaaatcaaaattgtaaaccctggtggaaagtcgaaaggatctctgcaacaaaaagaaaaggggaagtcaaaagtaatatcactggtcatggactagccataggaactgccactggtgtctcatgtaagcatggactaaattatgcaatacaacgttcggtaaccaggaaggagcctataattagtcaactaatgttttcatgtatgcgtcgagtagtgaatagtttaattagaaaaggcacactactaaaaaatagttttcgctgacagtcaaaatggattttcgctagcggctagatgtgccgccagtgactaaaggcaagtgaaaataatgctggccgccagtgaaaattgagtttcgcaagcagctatgctaagacaaccgctagcaaaaataccattttggctagtggcaaaattagaccaccagtgaagacaattttggggataaaaaaaattcaaaatggtgctgccaactgccacagccgcaaacaccgccggctgctgccacaacacctcaccgtggccgccgcctgccaaagcccaagccatggtcgccaagtggtagatgggggggaggggttggagtagcctagccatcatcgtcgttgtggcagcccccatcgtcgtcgtcgtcgtggcagccgccgccggatccacctccttcaccgccgtggaggaccgcctgagcaccaccgccggcggatccgcgcccaccctcctaccaccatcgcttcccactccgttggcctcccccgttgctgtggcggcggatccttggtagccgctagcgaaaatcctattttagttgtcggtaacctataaaaagatctctatttttgcaagcagacctcttaagtgaccgccagcgaaaatcaaatttttgcaagcggttgataaccggaatccctccaattattttcacaatcgtattttcatcaaacccgacagtaaaaataaaagggtaatgctataaaaaataatttttctagtagtggcagcttgaattgggtgtaatgtatccttgagctgaaagagatgatgactagtagctttcttgtgtgcaggatttttatgaagaaaactctcaactctgtacagcgctgaaaggaagctagttttcagataatcttagcctaattaagctaaaccattcttcaggtatttcaactactaccaactgagtgtccgaacattttatacaacattgaaaatttaaactttccgatccgtttcaatgtatgaacacaaccaagatcgatcgaaattcgagcaaacaagctcgccatgaccatgaaggttaccactgcaactgcacatttcctcttggtgttcttggcgtccaccatctcccattcagtcatctgctcagctctcggaaacgaaaccgatcagctgtcttcgctgcttgaattcaagaacgcgatcagtctcgatccagagcaatccctcatctcatggaacagcagcaaccacctgtgcagctgggagggcgtctcgtgcagctccaagaacccaccacgcgtcaccgccattgatctagtaggtctagtaggtcgcatctctccttcgctcgggaacctaacattcctcaggaacctctccctggcgacgaacagattcaccggccagattccggcgtccctcggccgcctccgccgcctccggtcactctacctcagcaataacacgctgcaagggaccataccgagcttcgcgaactgctccgagctcagggcgctgttcctcgacggcaatgagctcgccggaggactccccggcgccggcgacctgcccgtcggcatcgaggcgctggtgctctcgtcgaaccgtctcgccgggacgatccctccctcgctcggcaacgtcacgacgctgaggaagcttgcctgcatgaacaacggcgtcggcggcggcatccccggcgagctcgccgcgctgcgcgggatggaggtgctggccgtcgacggaaaccggctgtcgggtgggtttccggtggcagtcatgaacatgtcggggctcgccgtgctcggcctcagcaccaacggcttcaccggcgagctgccgtccggcatcggcggcttcctgcccaagctccggcagctcaccatcggcggcaacttcttccaagggaatatcccttcttccttagcaaatgcttcgaatcttttcaagcttggtatgtctgacaataacttcaccggtgtggtgcctgcctccattggcaagcttgccaagcttacattattgaaccttgagatgaatcagctccatgctcgtagcaagcaagaatgggagttcatggataacctagctaattgcaccgagctacaagtactctctcttgagaagaatcaaatggaaggacaggtaccaagttcactaggcaatttttcagttcaacttcagtatctttacctggggctcaatagattgtcagggagttttccttctggcattgcaaaccttccaaacctgataattctggcactggatgacaactggtttacaggttctgtaccacaatggcttggaggtctcaaaacattgcagagcctaacagtgtcctacaacaattttacagggtatgtcccctcctccctttccaatctatcacatttgatggagctttttctagagtcaaatcagttcattgggaacatacctccaagccttggaaaccttcagttccttacaacaatcgacatttccaataacaatcttcatggtagtgtgccagagtaaatcttcagaattccaacaatagagcaagtttggttaagattcaataatctcagtggggaacttcctgcagaagtagggaatgccaagcagctcatgtatttgcagctttcatccaatatgttgtctggagatcttcctaatactttgggcagctgcgaaaatttgcaacatattgagctggatcataataatttaagtggaggtattcccccttcgtttggcaaattaattagcctaaagtttctcaacctatcacacaacaagttaactggatcaataccaatgttacttggtgatcttcagcttcttgaacagatagatttgtcattcaaccatcttagaggtgaggtcccaactaaaggtatcttcaagaattcaagtgccatacaaattgatggaaatctagggctttgtggaggtgcactagagttacacctacctgaatgtcctattacgccatcaaatacgactaaacgcaagccatctgtactagccatagtgattccattagctagtatggtgacacttgcattggtgatattggtcttgtttatctgtaagggaaaacaaaagaaaaactcaatgtctttgccctcatttggtagtgaatttcccaaagtttcttatagggatcttgccagagcaacaaatgggttttcaacatccaatttgattggcgaaggaagatacagttctgtataccaaggacagtcatttcagggcataaccgtagttgctatcaaggttttcagtctagagacaaggggagcacaaaaaagcttcattgcatagtgtaatgctttaagaaatgtgcggcatcgtaatctagttcctatcttaacggcgtgctcaagcattgattcaagtgggaatgacttcaaagcattggtatataaattcatgccacggggagatttgcataaattactgtactcaactccacatgatgatagatcttcaaatttgtgctctatttcactagctcaaaggttaaacattgtggttgatgtatctgatgcattggcatatctacaccacaaccatcaagggccaattattcattgtgatctcaagcctagcaacattcttttggatgatagtatgacagctcatgttggagactttggacttgcaaggttcaaaattgattctaaaacatctttgggtaactcagtttcaacttcttcattcacaataaatggaaccataggatatgttgctccaggtatatatgatccatttcacacagtattttcttaacaattaattgaagacaacagtttcataatttgtttatatgacatctaaaatgaactctcttcctgcatacgatatgtagaatgtgccataggtggtcaagtttcaactgctgcagatgtatacagcttcggagttgttctcttagagatattcataaggaagaggccaacagatgacatgtttaaggatggattgagcattgcaaaatatgcagatatcaacatccctgacaggttgctgcagattgttgatcctcagctggtacaagagttgagcctcaaccaagaagatccagttgctaccgatgaaaatgcagcacactgccttctttctgtactgaacattggactttgctgcaccaagtcatcccccaatgagcgcatcagtatgcaggaggtggctgccaagctgcacgcaattagggattccatatctcagaggttactgaatcaacatcaacactgttagttgttctgttttgtctgaaactccgaataattttcagaagacatgctgtacgccaagcaccacctctagactgagccggcgccaattcagttatatcgatggcgaccaccacaacacgtagggatctgtgctcttggacatggagcagagggtcctcatggaggagatcgtcacactactccccgtcgagagggccgtcgccacgacgaggttcgtgctcggacttctccgcaccgacatgatcctgcacactggcgtggcgtgccgagacgcgttggagatgagagccagcaaacagctcaaggaggcaacgcatgaggacctcctgatccccaacactggcaactttgtggagacgctctatgacgtggactgcatggagcggatgctggagcagttcatcgtcacagttcacgaactcgtcggtgtacgttcaccggtccgtctcgccacagatataggacgaaggctaggtggttgacgcatcctccggcgagctcatgccacggattagaacagtggccaagctcgtcgacagctactccctcattccctaaatattttacgccgttgactttttaaacatgtttgatcgttcgtcttattcaaaaatttaagtaattattaattcttttcctatcatttgatttattgttaaactaggaaggtagcccgcgcagatgcgcgggcaatttattttatgtttatataaaaaaatctgaaaaaaagtcatatatcatcatattaactataagaacagtagattacctcgtaaccttaccataaaagaaggaaatatttataccgtgaatttgataaggtaaatgatagtgtctatcatattcaaacaaaaaatcactttgtttcggttatatgtaaacttacctatcatcattctttgcaaacataatatgagttttgatgttttttttcttttattatacatgtaattcacttacgcatgttcatgggtaatgtacaaagaaatactctatattgtcaaaattatttgtactaattgttaacacaatttatatgagaacgacataattaaaagggataaaatatgattccatatgacattttttattgtacgtatgtacgtaagttttttttctcgaatggtagtctctcgtatgttcgttctttttcatgtttttttgacaaatatttctctctcataggaggtagggtgtgcgtatgtgtattcatagggtgggtgcacacacgtttaaatgaccacctatgattgcgttttacattgttagtcaaaaaaaatattttcaagaaaattggcgagggtgacatgaagcggcgccatggcagcgtggcttctttgacaacatcgcaaagagtggtcgctacatatatgtataatttgggagaaccttagggctacaaagaaagaaattgaaaactaccagatggggtgaaccatatacacacacttcttttttatttttgacattgcgtatatgtacgtgcatatatatacacacacttctttttttatttttgtcatctcttatatatgtacgtgcatagagagggattagctagtttatagaagcaagggcttacctgaataaatctaatttaatggttgaaaataatggattcatcggttgaagtgcaaatcgatgggtagatgttttgttttctccttatattttttcttaaatttcctcctatttattagagcatcacatgacatctcacaagtgtttgtagaagtataggaacgctattgcttaaactcacagtctacttgtagtcaactactgtttgttgtgattttgtgtcatcctctacttatatatcattttttttattaatgggttcccactaagtatcatcatatatcttcggtgcttgatgacgcacgtgcttattggatgtcaactaattattaagtgcattgtgcatggatgtatcataaacaatataactcgacgattgttgacactggtttgtatatagaacttattacatagaatttatcggggacatacgattgatatattatactatcctagattcacaaagtatattatacactacatattaagttttagtgcatatgtaataaatttatggttaagttctaaagtgcttatcagagtggctacttcattatttatcatgaccatgtttaccgaattgttaaacggtgcatattttacaaaatattttttattatagaagttttctaaaaatacaaataaatccattttcaagctttcaatatttaatactcgattaatcttgtgctaatgacttgtgacttttcgtgtgccctggatacgctaagtcaatgagctagatcgaacgaaggctaagtaggagaaaaagatattgacgtggtgtcaaatgaatatatttgatcttcaattttctaataatatatgaatagagtaaacacataatacataaaaaatatttatgataaatttataacatcatttttccatatcagtattttttacaagagagagtgagtaatttttgaaattctacacacacttgaagttgttttattttggaaaatgtaagtctaatttaactatcacataatctatactttcaatttatttatattttttatgggtgtttcaatgacatgcgcctaatttgaatacaactcgaaatagcatatatttttacaacgcaaagcatagttgatattagtttaaattattagtttggttttccatctaatccaaatgatgagaagaaaaaaaaataaggatgtgggacgcggtgtgtatacgcactgtttataggaatagctgtgtacatactctacgtaggtacgtacttttcttaagaaggaatacctacatacctacgtgcatgtatattggccggtcgtgccaatacgacatgggcctttttacaagtaaatctattttgtagttttaagatagatctaatagttgaaaataatgggtccaccaaattaaatgaaaaccgattggtcgggattttttttattttatacaatttctatgatttattagagtgccacatggtggtctatgagcatttatagggtactatgttcggattagaagcgtttgtaggaagtttatcctcttgattacattttctccctttttctctttatgaaaatatttgcaacaataatttttaaataaccacaaccttctgaattatatatttatttgtaacaatatattttaactcattataatttttaacttttaaatcatacctttatttttttatctatttggaccattgtgttatttatgataaaaatcacaattagaattcatacgtaagttatctacttcactcataaaatgtttattcttccatgttccatttactatcctatgcatgtcattcaaacgtatatgaaaaattataaaaagaaagtgactatatattgtttcttccagtaccacttcacttgcacgcataaataaagtcagtcactgtatatactgttagatcaactttttaaagaatgcccgtgtagctgaaaacatatattttcaaatcatatattttttattgtacgttttttaccatatttgtgaagtaataagttttgtttttctactatagaaaatactattttaaaaaaccatctgtttttttgtctacgcatacgtacatttttttcttggttttgtctacgcatatgtacgttcgtttctaaagtttctgtttttttaattgtgcgtacgtatgtagatttttcggtctaagcggtttcactcgtatggacatgattttccggtatatacggcttcaatatacaatgtagtactttttttggctttatagctgcacgtatattagtttttttttaagcgagcagtacgtatgggtttatatccgatcggaatatactttaatttttctcgtaaaactttctcatgtataaagcttatacgttaagggagtagcaatgacttttcaagtagatctaatctaatggtgtaaaataatggggctaccaatttaagtgaaactcgacggttagattgaaaatagccatgtggcgatttaggagcgtttgtaggaacgtcacatgatggcttaggagcgtttgtagggagattaatggacttttagtatataatagatagatatgcttttatgtatacatatagttttgtatattttaaaaaaaattgaataagacgaacggttaaacgtgtttaaaaaagtcaacaacgtcgaatatttatggacagagagagtacctcgcagaggtcgcgaccaacaccatcctcaagttctccaagtagcatcactaataagctcatcccagactaagcgggccattgtgatgttgctacaggtgcggttaattgaagcgggttgttgtttgtttgctgctgatatactttgaggtgtacgttgaatgttgctgaaatgctagagctaaatggtgttgttgctgttgatatgaatgatagctgatctgatatgctgctagataattcaaaggctgtttgcttgtggcaagggagggagggagaggtcggtgggtgcgtgcaggaggaatcgacttttgggcgaggggagcacgtgtgggaggaggaaaacatattttctgttggtagttttatggaggtcacactttttagtttgtacaatcaatttagccttgatttatggagggcacgatagttttagccttaatttaggttaaagaacggagatagtaaaaatattagccccagaacctaaattttttacctactccgtatttaacagaaggaaggtaaacattatgtcacccacaaacactcggccactagaatcctcgaggtccctacggccatcacgtgacatcacgatgatcaaggtcatcgaggtccctacggccatcacgtgacatcacgatgatcaaggtcatcatgtcaccatactcatcgaatttcctcacgctcgtcttctttcctcgctctacacccaaatcccaaccaccctcacaacacctcccgcttcatgctggctaaagtccccaaaaagatgagaacaacatgcatcgcgcccacgattaatcctagtgtcactagtagcgatcttgccaagattgcgctctcgtaggtgtcgttttggtgagagacccatggcactgttggcaacaacacccatcaaggccgcctccattgagcattgcaacctctagtagatgagagggttagccctgatttcactttcggtcgttccattttttaaagaataatgattatagctaaatcaaagggagttgagacatgcatacctttaaatataggaccaaaagggtatgaattgaaatggactatgttaggctcaacatttgcatcgcctcgcatcggtgccgctctcgcattgaagtaatcattttagcaaaatgatgtgtgtacgtctcgtaggactgaattttccaagacatgcgggactagagagggaatgattatttccgtcactagatttgatgaagtggtatgagatgaaatcttggactaaggatggggtttgctaatttgtttatagacgtagagaggaaaagttcacaaaagaggaagaaaagggaaatacattgcactacaagtggaatgacatttaaaggcatttttgtaaacgctcctcaaatcatccccttttaaggcgattttgataaaaatgcttagtaaaatattactaattggatgaccaattggcggccatccgacggttgggggaatcgcccttcctcaaaaccaacggtttggatccgtcctcccgagcacctatagcctatcaccgtcacgctcgcacacgtgcccaccacgcgcggttgactcctccccctacctctcacctcccccacctcgccgtcgccggccgccgccgcctcccacctcacctcctcttcgccctctcccctcccaccccaccaccactccggcgagccatcgcggccctccgccaaaaaccctagggcaacagcgatcgccggtgcgcgggggcggcggagtcggagtcggagtcgggggccatggccatggacggcggcgcggcggcggtgctgcgcgaggcccaccgcctgacggggcacaccgaccgcgtgtggtccctcgcgtggaacccttcccccggcgccggcgccggccccgtcctcgcctcctgcggcggcgacaaggccgtccggatctggaagcgcgccgccgacggcgcatggcagtgctcggtaactatcacgcccgatcccctcctcgttcgagctgatgctgctgcagctgcaacgcgtgttgattgacttggggttcggtttgggtaggatgtgctggaggacacgcacaaccgcacggtgaggtcgtgcgcatggtcccccgacgggaagctgctggccaccgcgagcttcgactccaccaccgcgatatgggagtactccggcggcgacttcgagtgcgtcgccaccttggaggttgaaaatggctctcgggagtttcagatatggggttaagactgtttgttgttgtggtgcattgtgatcgtttggttgtgcgtgttgaatttactacttctgttgtgggggtgtgtgcagggccatgagaatgaggtgaagagcgtgtcgtggagcgcgtccgggtcgctgctcgcgacgtgcagccgggacaagtcggtgtggatatgggagatgcagccaggaaacgaatacgagtgtgtctcggtgcagcaaggccacacacaagacgtgaagatggtgcagtggcaccctatccttgatgtcctggtttctgtcagctacgacaattcaatcagagtatgaacgctgttaatttcaaacaaatgcctagatcgcacacaagcatttcttgctgttcccctatgctttgtagctgtgatgcgtttgcttatttcatttggtagtgttcaagtgtaataatggctgatttcaaattttctgtggcgaaggtctgggctgatgacggtgatgatgagtggcactgtgtacagacattaactgaagctaataactggtaactagccttggtatccctgtggcctttttttcatcccatgtttcatagagctggtactaggttgtggtataatctgtttgacttatttagcatgtaacatgcatcactgtataatgttaccaaatcatcaaatttcagctggcatgatgctctttattataattaaaataatgtaacttctgctccatggccattagttatttgactttccctactttcctttctccattagacattagttatttgatattttgtgctgtttctactttgctacagcaatattttggcttctatgtcacaataatgtgtttgtgttatcttacaatagacaattagggatcttcttcaactttcctcgataataactaataagatcactttgctgccatcctgctttgtaattagttaaacatacgtttttttttctccttttcaatgttcacttcaattgttgatgaactcatttttctctgtttggcatgttaatacttatatgttcttcctactttcagtgctcgactaattgttgtatcttttccttgtctaattgatctcgttctttttaattccagtggtcactcgtcaacagtatgggcattatcttttaaccagaaaggtgataggatggtcacatgcaggtctgttttgtaatagctactctctgttttaaatgatattcaaggcctcttatggaatgtggggtttccccggcttcttgtcgattgtgaaattcctgcgttccaaacaggtcacccgaaaagttactaatgtcatacagctgttattcagtgatgaccatacattgaaaatatgggacacaagtgctgatttgtctcaaccaaaaactagtgacaaccaggaatcatggtaagagcgtgctattaatacctattttctctacttggcttattcttgaatttattgactcatatttgctgtataaagtttgatagctttgaaatatcgtagctctgcctaaaagctaagctaaaacttagttataattccctggaaacagctatgccactactatagcaaatctattaatgccaatattgcttttatacaatcttatttttgtaatttatatttttgtattctctagtgtagttctgtgaggctgtgatcaacgtacaccaataaatgaggataggcatgtccttcagagagtagaattgtttggtctccggctagcataaattcttttctattgcagaacatgctaatttagctgtactatattttagtgctataacggaaagatctaatttaccagtaagatcaatatcgattaaacttctgctgccctgctttatactggggtgaactaacatgtatggtggctatttccttttggataagacatacttgttactccctccatttcatattataagtcgcttttacttttttcctagtcaaacttctttagggtggacaaagtttatagaaaaatttagcaacatctacaaaaccaagtaagttttctagaaaatatcttgaatcttgataatatgtttgttttgtgttgaaaatattgttatatttttctataaacttggtcaaattttaaaaagtttgactagaaaaagaagtcaacgtgactcacaatatgaaacagaggtagttccgtgcatcactgaataataatgacttcagtgtaattgccctagttcaattgatactgctgttacatcacagcagtgaagtgtcaaaaatatctcttttccataccatgtctccttaacaggatggttgttatttgatttcaggcgacatctttctactctcacgggatatcataaccggaccattttttcagcccattggtcaaggtgaggtgatctctaagcaccaagatatccttgatacacatgatttttatcatagagaactaacaagttaactctgttcctcagctaaactgtgagcatgatttatcaacaagtatatttcataaacccaaggttttcggggcactagtaacaccagttttcacaaaactacgagttctcatgctgttacaagccctgttgtatttggagtccaccaaactgtcaaagcaactcaattctcaccatagggttccagttttatatcctaaaattttcaatataaggaaattcatgaacatatggattttttttttactgcagaacatatggaattttataaacatttattttgttcatagcatgctggatttttacccatctagtttcatgccaaataataatatgccaaaaataacaacaataaccctcaacggtgtcagtggcaaagtgatcgaatgaataatagaaagcaggaagttagacttgctcaagtccacattatgcttggaggttagtagataaattcaagccaactaacaagacctatggtttgcttctactagtgtcacgaaaccacaaattcgtgaaactatggttgtgtttactaatgcctcaataccttgctttttaaaaaattttaagttcgctctattaattcagtacgtcaatatgaattttataattattagtttattgattctatttgagagcgctatatgttctttaaaaggatgcacttgttgtgtttatgattttatgctgataaactttatatacatcaagatacctattcaagcaaaacagggctgtttaaagtactaaccttgcagtccattctttctttctttttcctattcttgttatttatttatctgtgtctcttagtaccattgctgcattcttaaatgttggatgcccattttaaggaagaaattttactaccagaaattctgtgggcactgatggtggtttatctgatgtaatttcttctcttttaatcattattgtagttttccaatattacctcagcccatatgaatcaagatgttaaaatgaatagaatagtgtatttactattctttgacattttcctgttcattcttggcatgacagcgaggatattatagccagtggcgcaggtgatgatgcaatctgcttatttgctgaggacaagagtagtatggtatcatacccttcctagcacattcatattctcaagatttttggtctttgcattctgtgcttagcctgcctgtttgtcaaagttatatcttggtaaatatttaataataaataatggagtgcaatgttctgatagggattccataatttcctggttgtcaaaattttcctaggagtaaaatgtgaacatgaccaatcgataaactgttgtatcattttttggtaaccagtgctgtgccatttgttttgattattggcaaattatgtatgactattttctccaaaaaactgtacaattattattccctctaccataatgccattttattttgcgaaagctgaagaaggatgctaattccttaccttcattgctgcaggttgagggaccttcatacagattaattttaaagaaagagaaggcacatgacatggatataaactgtgtccgctggtgtcctcaggtaatatcagggaattaacaaaaatataagtattgttatattaagttagtgcaatggaatacttatgtcctcaggtaatatcagggaattaacaaaaatataagtattgttatattaagttagtgcaatggaatacttatgtttctaccaattaccacccatttcgtggttctgtttatcttttaaacttcagataaatgtactaatcttctcaaatatgttttaggacccgaggatgttggcatcagcaagtgatgatggcacagtgaaattgtgggagctgagggggaatgcactggattgaattttgttctgtttactgtattataattatagttctaggtttgtgaacgaaatgaggcgtctcctttgggtttttgttttgcttaacaatgctctgtagttgttaatacttctatcatgaacttgcgtggtgattgtcttttaacagattttccatgcaaagctatgagcatctgttatccagccataacatgaagaaattgcttgtgtatacattatggaacaacgcaagtgtgctcatatcatttacaaataagctattgaacattttgttactcaagtgtagaaatggtactaatttcttgttggacgcttcttctctatcagttgtagagagcagatttacaatgtggctgcctcctgcatgatgtaggtgcatctaattttgattgcaaccttctggtgttgggagtgcatttttctgactaattagggccgggcagtattgatgaatgatggtgaccacattttcttttgagttcatactaaaaacttagaaacaaggacatggtgttaatttgttaattcttagtttggtgcagagaatttatactagactttaacctgtggatccgcatgggcaacctgttttatggttacgtttcattttttttctcgctttttactatgagagtttgcaatttctgcttaatccagcaattcctaatgacttaatacacgttattcctagaaaatagcagagttaaaatagagctgatgtatgtcctgacatattcgtgatcatattattattttaagacaaatctttttcctacaaaacatcgtgattttacggttttaaatatagaacatcacacgaagtaacttttggggaatacacattaaaagcttttttttctctacataacaccgtgactttacggttttagaggttttagatataggacatcatttggggaagacactttacaagttggatatttattggtggacactaataatattcggttgaagaggagagagaaatcacgtgaaagttttgaaatgccttgggcccacatgtcagctctcccatctcttttctatctctatcccctccatttgactagggaggatgccatggccagcgctgctgcctcctccttccgctcctttctgattggcgagctctgcgaccacctccgccgggagctcgagctcgaccccaacctcgcccaatgcctgctcctccctgcctcgccgtcgccccctccatcgacgccgactcccagccccctccccccgccccctcctccctccctccctccctccagcgtcaccaccaccaccaccaagaagaagtggtgcgcatcaccaaccgtgttgatggcccatgctgatggccgtcaatatctggcaatgggaggatgccatggcaggtcaccgcggcgccactggtggtcacggatggcagcgagcagacgccgtcagggacgctgacggacgcgtttcatctgtccaaggcggatttggagtggttttgcgtggaagtcgtcgctgttctcgtcgtcgtcattacacgggccgacaatgctgaaggtggcggtgtacgcctcggctatggtactggcattgatggtgacaacgttcgtggccttgccggggacagaccgggtgagtcgctccaacccgagcacatagctcaacctccgccccatcgataacaggttgtgagagccatggggccgcctcgagtgttggtgcgagcgtggcagggcaggcgcctcaaacagcctcgactactgctttgaccttctccttcccggcgtcgaccacgctgtccccttggtggagtcctccatcgccgcatccaagggcgacaagttcgccgtcgacctcacctcgatgcagccccagagctgagacggcacgccagggtgcagcccacgaagcagcgaaacttcagccagtggctgctcacccactacagctatcgacctactgtggcgacctatcacggcatcctccctagccggaagaaggggatagagagagaagagagataggagagctaacatgcaggcccaaaggcatttcaaaactttcacgtgatttctctctcctctccaaccacaaattattattttaaagcgtgcggtgtccaccggtaaatatcaaactttaaagagtgtatttccccaaaagtcactttatgcagtgtcctgcagctaaaaccacaaagtcataatgtcctttatccaactataatgaaaatgttcggatgataaattaccttaagaaaaaaaaagtacgaattatccccctgaactatttaggtcgtctgaattacccccttagactttaaaactagacatttgacaccctcaactactaaaactagacaaataacccccctaacccaatctggagtggttttgatcctacgtggcatacgcgtgacagtccagtcagcaattctttaaaaaagttcggtgggcccacttgtcatatctatccctcacctctatcctcttgtctttctcaatccgtatccctctctatctcttctcttgaattcctctcctcgctaaagcatgcgacagcggccgaccgtcgagcttgccggccgggctttcttctcctcggcacaacaagcacaccaccaagtcgccactctcgaaggcagttgccggagaccgtcgttgttgaggagccacggtgaggagctcgatccccttatcacgctcgcgaattgaggagaaggtgtcgtggcggttgccggtcgagagctcgaaggcgccacggcctcgtcgtcgtctccacctccatcttgatctgcctccttcgacgctgctaggtcggcctcatccctggaagctgcacggacgtcttgtcgccaaccttcgccgcttctccccgtccccctgacctccacgacctcctatgcaggaagttgcagagctcatgctcgaggaggcggccaccgacgtggatctccttctcggccacatgcgtggatctcctcctcggccaccggcgcggatctcctcctcggccacaggcaccgattgaactccaccgccggctccctgaggggaccagcctccgtcgccatgtgcctcctatgcggctgacggacgccacttccggtcaacacgccttggccctatctcttctgccctctctctctctctctccccgcgcgccgccgtccacccgccgccgcccaccgcccgttcgcagccacttgctcgagcgcgttcacgggagagagagagagcgagcgagcgaccgggtaggaagagacatgacatgtgggcccatggattctttttgctgattgaattgccacgttagtgccatgcgtgcaagatcaagtcaaaactgctcaaaacagtgtcgagggggtaattcgtccagtattgaaagtttagggtaagcaatgtctggtttttgggttaggagggtaatatggtcgaccgtaataattaaggagggtaattcgtacttttttcaagtttaagtttagcatacaacgtttggaactcaagtacatacaaactcaagtacatgcaacggttaattgcacattggcaagaatgggagttcctgaaaacaagtttggaactcaacaaacatatatttaattagagtcaggaaaaaaatacactcaaacatacactgtaatttcaataaatgttgtaagtgcttttacgtaacaatctaacgcatacgccctccgtcccattttccgttttatttaaaaaattttaaaaacgtaagtcacgagtatagcactatttatgttttatcatcttataacaacaaagatattaattataaaaaaattcaaataaaacggacgatcaaagttggacgcggaaactcatggttgcactcaaaatgggatggagagagtatttttctttgctccccagcaaatcctttgcttcatgcacaagcaaaggagaaggatgtttagggttgtgtttggcactcccttttccccatatctactttctcatttttcatgtgcacacttcctaaactactaaacaatgcattttaaaaaaattatacctaaagaattcggaacaaaatagatgtagtacttaattatgtactaacgaatcaattcatgctagggagaaaggttccgaatccttttacccgaacgtaggaactttaaccaagcagcccttggtacagtggcagtaatatgttacgggaccacctatacatttgtcgacaaattttctactaaaaatttgacagatgtaattatagtacaatcgtagtgtaattacaatataacttgtatgtaattacattgtaacttgcatgtaactacagtgtaacttgtatgtaagtttcacgtaattttgaatcgttagatctattacaagatttgttctatggaggaagaaaaaaatcacatcacacacatatatgaaagaatttgttcccgcgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgatatgttacaacacatatgcaatagatagatggactgtattatattgcaagtcttcacgaagcctatttaaacaacaagaattaattaatgtatatgcattaattaccaaattgttaaaaacaggtgttaacaatacttaacatggcttatttagtgcggaaactttaacataaattggtccattagaggtgaggcccattaatgtcgtttggattcatattgcttatccatatatactacactagtataatataaggactgtagcctctattatctgttataatagatgggccctagctttttcctttttaaaaaaataagaaaggcagaagtccaatagaacagggataacagaacttgggggaacatcttgtctctcttgcttaactttttatttatgcatgaaacgcgtgttcattggaaaacaaataattataatcataatattgcatcatatatggattctccattctacctcatttatttggtagacaacaacccatcaaatatagaacaaaatagatgtaatagtgtatgagaattggtgttttaggctttagaattccacaagtagctatataaattcaattatcttaccgctcatcaagaaacccttacaaaggggtgtgagctccgtttttcccatgcattcaagcgattgcaccacctcgttgctcacacaaactacaccgcctcgtgcagcctagcttgtctcaacctccacaatcctagttctagttatcagccgagcttcaccatctaagatctggtcattagccctcctaaggccatgctcaaagcgtggttttaggcctgtggttctagccgccaactaggtttggatgcgacagtggagatttgggaggggctacatctgtgtcagagttaccttacatgagctacggtggtttgggaagaaaagaagcaaaagtgtggtccagtcggcaacaatccgaagagaaagtgggaaagagagtgcacctcatctcacgctatcgggaggacccccatcaccatcgtcgccgttgtcgagtagaacgacgactagggaagaagaggccaatgacctagggtctgtttggttgctaccctgatggagatttgcctggcctgtagcaagcctgagcaacacacaactttgtttggttgtctccctgaagacttgcctgactcaggccaccgaaaatggacgcctgatgcaggcacggtgcatgcctgcttcttcttcatagattattcattgatgtgactactaccaacacttttaatcatcctaactcacacaagtgtactttttatgtttaatatattttactcaggcttggatcatcaaccaaacaacaaattttcaacatgcctggccaggtagaactcaggcacataactcaggtcatcaaccaaacagacccctagtgtcctgatctagcggctagcacactggaggttggggagggaacaaagcttggttggcatcaacagatctaacgattatttgggcgccacatccgctatcactaagaacttggctgcggccgccgtacctggatccgcaccgccaatagcccggttgctagattccccccacgcctggatccgcatcacttagcagcgtccggagacatgaggtgataacaatccggtccaggtgaggttggccgaggcccaataacttaaggttactcagaccccaacagttctttggcacacccactcggggaaaggcccaatctccctaaaagactagtccaataggggaagggtggctctcctttttaaggtggcttcctcctcccaagctaagcaaggtgggattattcagaggctcacacggtcgccacccgacttttatgtctttgccagcgggtaatagtggaggatgtcctcatcatgagggttttcagcaaggatgaggaggagagggcggtgtggtttcttgtaacgaggaatcatgaagggatggtgggccgatggcgctcgaggtgtcgggatgatggcaacgctcgaggtgtcgatggaggaaagggaagagacaattaagaacgagagagatgggtggtgggataggtaaaaaaatagaaagtgtgactgacaggtggggtccatatgaggggtccatatgagggtaagggtatatatgtgcatcttttttcactgcgatagggtctaaaatataaaagttttaatttagtttattacaagaaataccccaaggaccttcatataaataataaagggttgaaatgcaaaatatatattagggtgttctccactatgggttatgtgattcttgtgtgattttaatccacatggcaccttgagagttgagaccactggtagtgttctccaacgtgcgtgccctaagttttagctcaaccttggcctctggctgtcaccaacacacaccagaggcccttggcctactgcctcggtacaccccatcctgagaagccagctccatgtgtggagaacagaaaagaagacagtgcaccaaaggaaaaaaaaaagaagaagaagaagcaaattatgcatcggatgggttgaaatggtgaaccgtggcaaataaacaagcgtgcacctgaactttagagagcattttagcaatggcaacaaactatgaggcatattagagtatgccatccaacttgtgcccatctgagcaattttccccatgaaaaagaaaaggagaaaacaatgcatccaaacctcagccgcctctccacatgtgcgcgtcggtcggactaagtttgtgggggccgggagaatcggggaatcgatcgatcatgcatgtgaagtgagccgaggcgaacagagtcaggcctgctccgtgacacacgcgctgcttcgctcgtacgtagccctaccagtacgtggcccagcgcaacaaccactcgtttttaatactccacggggccccctacccacacccaccaccaccaccaggaggcggtctcgctcacaaaagctgtaagcaatgtgcccatgattgacctcgctagcccagtgcggcttcggttgctcacaaaaccaaaaaaacaaaagaaaaaccatagtagtagacgagcgcgagtgatgcgggggagaagctgccaaagtgtcggcgcctcggcgcaggcggggcgggctaccgcgaaatacgaacgaacccgcgcacgcacacgcgcgcgcgcgcgcgcaccgcacggaaacgtcggaaaggggaggaaaacgcgtggagacctggccgatttgggtggtgggagcggccgggattaagggacccttcgcctcgcccacggccggcgtggagtactcgtactggactagtggtactgcacgcgctagcaatagctgctgctgctctctcgttggctcgcacttgattacgagatcgatcttctcccacttctgaacagctgcttttcttttttttttttttgttagggttggaaatggatcggattcggaccgttaatagtcctatcatattttaaacataatttttaagtggatctggaacgggtgcgaatagtatgcggatacgaagcggattgcttcagatgtcagaaatggtacaaagtcaatacggacccagtttagaaacgaattaaaaattatcagatgtcacgtatatgtgtaattaatacaacatcaacttagcgatgcaacaaacaacaatacaataataatcaatgaacgatctatcgtatactggagtgctaaacatcatgaatagatgatgtccataattttaaaacacagttacgtaagtataaggtgagacagtaagagcctcaaattaaagtgtctaggttaattgataaattaggctattttattgaacggttcatgttgtattcaacagatggagtggttacgtggattgacaatttcggattatcaggcaaacagcctcctggataatccgatagagatatcggataatccgtatccgtcggattttagataccacatccgtatccgcattagcatccatattcgtcggatttctataaactcatactttatccttgtttcggatcaattcagagcggattggatcgaataatattcgatccgttttcaccactcaattctcgtttccacgagcacatctatctatctattatatactaaaagtccattaaacttcctataaacgctcctaaaccgccacgtggcaccccctacaaatgctcctaagccgccacatggcgttttaatagacgagaaacatctaaccctcaattttcatttaaactggtggatccattattttacaccattagattagattaaaaccaatagtttatcccttcctcttctgtccctgcacgtacatctactcttccctccctccctcagtacacgtactgacgtacatattccaccctccctcacacgtatgtatgtaggcaggtagtacgtactcatcccctttttttttcttcccattcaccctactgttattttttaacctaggatacccctaaatatttttatattacttttttccgctattgacttttgagcatgtgtttgattattcatcttactaataaaaatacgtaattatcatttattttattatgattttacatggatgtcttatattcgctatattttagcacaaaatacattgtggcagatgacatccacatgtattaattaactccacaacaatttttcaaaagtaatcacatcaaactatatactttatggtatcaaatattacttaacaaatatataacggtagtttgaactatgtaaaaatgcaaaccatgtaatttagttgtgtttttaagtagatccaatttaaattttaatttgtgtaagattaacattctcaaatcatttggaatttttcaaaattatttggttggtattttaattgtaataaatcctaaattatacatatatgcaaagaaaattcaccaaaaatattttcaacaggtaaggtatatatcattggttttttcatatttttaataattatttaaatgatatgaaaaaagtcagaatataacaaaaaatacaatatttattttagaagttcaaatatagttaatatgggtcctcgataaaaaaatagttatttattttaaaagattataataaattagggttcatgattaatatatgatgaaaacatgagagacaatacatggggagagggcatgaatgagggcagaggggtggatgttgggcgatggtgcacgtatgtacatacatacaatgcccctcgggctatattggtacaatcgatgtttactttatgttttcactgccaatacatatccagaatgacatatttggttaaggtcggcttttgactctagctaccataacaattataattttatatctttatttgtgattgatcgaaaaatgtagttttgccagttagaggaaacaatcgaattcatgaattctctaaaatgtgctcaaataatccaagagtgccaaacgatcttctacataagtgctctagaatatattctatgtaacatttaaattactttattagacggtatttaatagcattttagtatatggtacatatatatacttgccggtggctatgtgcttatattccataccttacgggtatgaaaataaagtatgttttctctatgcacaaacctttaaaaagatcttatcatccatatatatggacattaactttctataaacatgtcaccatgcacatattcacttgaagaattaaattttgaatccatttatgtgttacgatacaccgagacatgaaaagaaagattaactaaacatgatcgaaactgtaaacactactacaatgaatcgtatggtaacctccgtgtctcagcatatatacaagttttacaaccatgcaacatgatgacttggaggtgcaagaaaaccattatcaccaaacaattgtcatctactagacagaaaaaatttacaatgtattgtttagactttggaacccaaaaattttcttgcgcaaactagaatgagacagcaagcaaagcagggagacactgagtagaccagttttaatgagataataatagtgcatcaatagaggataagaggagtgctattgagtccagctaggccttactttttgtcaccatagggcatattgagtagaaggtgcaagtggattgtatagtgaccaaacaaattccatgctacaaatgcaaaaagctttcaaataatttatctgatatttgaaacacatattttctagggtcttttagaacttcatagaatatgtgataattatgacaagtggatagacattataggcttcagataaacgattataaaatctaattgttactaattcatgcccaatgcaagctagctaaacaaaatatttgtgggttggttactttcgattacataattcctaatatttaactaaaaattttattaaaaaatgaaattatgggaacaatcatataaaagctcattccagataatgatatgtttgtagtaatatttaaccatccaataattgtgttctcgctagcctcgcacacttatgggttgtctcctacactgcacaatagaattggactctacaagaatatgtatttaacatagttttgaatcccctcaatccatgaataaataaacaacaggaacctattttagtattagatgtttacacaaaagttgattcatatttataaaaatgttgacatataaagctaactaattagatgtttacccattagcataagcattgcattattttttagttcttagatgattagactgcaataagtatgtaacaaaaagctaactaattagagggcacgagctttattgtgcaaatagaacatgtttattaaacaataatggatttggaaaaaaaacatttcagaaaaaaataacccttaaacaaacaattataaaaagttcgtaataaaaatttaagcaacatcaaacaaagtgcccgcgcaactgcgcgggctaccttcctagttttctaaattactgaatgatgtgttatgtataaaatgcttttatacataagtcttttcgaaagttaaataaattattttcaaattataataattaatgctcaattaatcatatggtttactttatctcatttaccgtagaacagctggttcgaatgagtctattctcgaatcacttcatcagagtatgtatgtacttcttccatataaaaagaagtctacttctaacaattggtttaggcaaacacttatctatatacataggtagattttttttttaacggaagttttatgggtgaagtaccatggagtattatggactagttgccgggggtgaaattgcagtggacatcaagtgctgggtatattctgttttgcaactaggaaacgtggttagtccacggcaatgttttgtgtttctttaatcaagtggccgggatgccaactgatcacagagaggatcagaggattccacgcacatgttgtttagacatcttgccggtgccgggtgtctttctcgtcgctacctctttcgcaggacacgctcatactcatagtcataggggcgtacgactacgagctagtaagagtggaatgcggaccgatctagggcagtagcttgctagtagtagaattctgaagctgaggcgaaacgaacacaaaggtggtgtttttttttccctgaaaaagaagaggaagattaagttttttttatgcataacgaggtagtattaatgtacgattgattgagttttaattattacaaacttaaaaaaaatatattaatatgatattttagagcaactttcatatataaagtttttacacgaaacgcatcatttagcagtatgaaaagcgtgccacgaaaatcttaatcttcatccaacttttgtgggagaaaagaacatgaccaaaatataatgacgatgtcaaattgatgcgctctccaattaaagcatatgctaaatgtgtagagtaatggccaaactcgtgaaaccttattcggttaatcttctcttcgagcaatttaatcccctcaactccttccatatttcaacccctttctcttgggattaataatttcgaagcttcgtttatgtgaatataattaaccacacgaaaaataagataagtgattagagcatgattaattaagtattaaatgttataattttgagaaatggatttatctgattttttaagaaactttcatacagaaagattttacaaaacaaaaaatatttagcaattttgaaaagtgtgttcacaatagtccaaggagttgctatcctaaaacagctcaaacaaattgagtttaatcaatgtatctatacgatgttctgcgacatgatgtgattaaaattggtcctttaatcatctgctattaattttaactgttgctatcgaaatctttagtcggatggcacgcaaacaattataaaggtcgcgacgaacgatgaagaacgcatgcgactacaaagatgacgatcacgatggacgaggcgaactcaagcatcggtgacggctgcgacggatgtggaagagggcgaaggtcgtggctgacgatgggcacgaaagacaagggcatcgacggatgaggtggatgcaagcaagttgacggtggcgtagcgtggatgtctagcctacaaacggtcaagcggatcccacaactttaagctacgtgtgccgctaggcgacaagttaatcatccgctctcgttctctctcctctcgtcttttttactcgtcctcacaaaatcctacgtgaataggagtttttatcatcaattattatacctgctctaactattgtgcatattgctgttattaatcccgactcccgaggtgatcaccgcgccgctccaccgaacactcgctcacactcacgtccagcaacaacacacgccacttcactaccgacgatcccaccgactactcgctgtcaaaacaacatggccatcccatacaacctttctttaaccacctctccacctcactaatcatcatcatcatcatcaaatcaatcaatcaacgccccctccccctaatttaatcaacccccccccctctccatccagcctagcatcgttagttagtctcccctggccccacccaccagacattccaccaacccccttcctttctctctccctcttctaaacaaaaacatctcccgtttcagtcgcccacacaccgacactctcctctctctctctctcctcgtgaaaatatttgtcacaaaaaaatttaaaagaaaaaaaaacacacccttcgctgagctagcaacgcggtggttgctgctctgctctctctccaagcaaacaccattattataccaccacctccccttccccccatttcctcctcctcccccacgcggcgcaccagctatcgccgccgccgccgacgaggagggtgcgatggaggcgagcgcggggctggtggcggggtcgcacaaccggaacgagctggtggtgatccggagggatggaggaggagggggaggggttggggggaggagggcggcggaggcgaaggcggcgtgccagatatgcggcgacgacgtcggggaagggcccgacggggagccgttcgtggcgtgcaacgagtgcgccttccccgtctgccgcaactgctacgactacgagcgccgcgagggctcgcaggcttgcccccagtgcaagacccgcttcaagcgcctcaagggtgagctcttcctccgtcgccattgctctctctgctctctgcttatgcttcgctctgacaatgttgacacggcatgatgaagtact

SEQ ID NO: 58100 - DNA, 22598 bp, Oryza sativa
cgatgggccgagagaaatccggcccatcgaccccaggggagccaaaatagacttttgcgaaggaatttgatttggaaggatttggattcggaaacgagctcgacgatagatcggggattgagatattgagatggcacggacactggacgacaatcaaagaaacaaatttcgcaattagggtttttaagagataactttcccgctaggcgccacgacggaacgggcgctacacatcgtctcccgcccgtaagtccccgctacggggatgaaaacggcgatattttttgcatgcgtgcgggcccaactaaagcagacgttggattcgttttggatggctcagatgcatggtatgtcatccggtgacttgccataccaatgtcaccaaagctgaatccgatgccttggggtctatgctaaagtggggaccggcttagttactttcttgagttttgttagcaagttttttaaaccgctaaacaacgtgttttatatgaaaacttcatatataaattttgcttttaaaagatcaaataaatttaggttactcaccttgatgtcaagttcaaattttaggaccctcatctcgacgtcgagttcgaattacatttttgaattgcaataccatatataatatgtctcgggacttaaaatgaacttattccaaattttaataatttatattcaatcatatgctaatcacatttaatcatattcaatcatctgctgcgcgacgccgtccgatgccgacgccttcgcatccccaaacagtgattgcgcgcgtctgccacaacctcgcatcttagggacgcgacgaaggtatattacagcaattaattccttttcaaaccaatatattcatgtagattcagaaaaaaactatatttttaaaaaacatttcacctgtccaagttcaagttgtagaattggtacgagtgctcatattcggtaattattttcttaataataaacaacctaatattcgacaataaagtacccgcgagctaatttaatcaatctcaagatatgttgatgaccataacaagagtgcttatatatagacataagaggagtaatatgtgcgtatgcatgttcctagaggtgtgtagtatgtgcgagtgtatactagcgtccgcttctatattatttttctgatatctggcatacacgtgcatgctcgcatatattttcaaataaacgaagtcacctgtagcatccaagtagttgtgggggtgaatcatgcacatggttcgacctgactgatacagcagcaaatgcgtaggcgaccgaccgaaatacgtggccattattattactgttattttgaaatttcaaacaaatagagagggcgagggcggcatagggcaaacttttatctatcctttcttggaaccttgatgatcagtaccgacgatttgcccatggacagcaagttaaattaagacccaatgctgccagcgagacgaggaagttctagagcaattgttgaatttttgactgcacctgtgaccaagctgattggttaaaactagagccaaaaccgtttgtgcctcgagcatttaatgtcactagccgctcacccgtgtggtgcacggactattattattattagtgtttaattataatagtacatatgacttaataagtttgttaaatatttaagaacgaactaaaatcagtattaaatattaaatcacttagaagtgttgtaacttctaaactgggtatgtatgcaaggtcgaaataattataatattgtttcaaatagacagttttatacttgcattcgacagatatttcacgttttcttatcctacaggactcatgttttattttttttacctttccttacaagatctatagataaatgggatctgtcacttttttcatgattaaggtaataatagaagacatgaaatgcttttagtaattcatcctacatacagtacatgtccacgcgaatgcgcgggctatcttcgtagtttctgttaatagctaaatcagtctatatatcgttcatctttgattcttttctgtaatctaataggtcatatttttgtttatactaccacatcaaatgttaatagtagatggaataactcataaatcaacagttaagatcattgctatatggaatagagtattatatatggtggcctcatcttttgcattggttttggggtgtttagatccagtggtgtaaaattttaacgtgtcacatcaggtattatatagggtgtcgcatggggtgttcggacactaataaaaaaactaattacataatccgtcagtaaaccgcgagacgaatttattaagcctaattaatccatcattagcaaatatttactgtagcaccacattatcaaatcatggagcaattaggcttaaaagattcgtctcgtaaattagtcgtaatctgtgctattagttatttttttagtctatatttaataatttatacaagtgttcaaacattaaatggcctattctgttgtgaacggtactgaatggaatcccccagtccacattcgatcgatcctcgtatagctctgactgtagtgcaaagttccattgcatggacgtggttgatttcaaggagtcatggagattatctgagcccttcacgtcatgatcatagacccggcatccatccgacagaattgaccggcccttgactagatcccaactttttttttcaaactttcaacttttacatcacattaaaatatttctacacacgtaaacttataacttttttcttcaaactttcaattttagtcaaacttccaaatctattatattattaaaggaatagaaaaaggagcctccacgttcgctctcatggcctagaaattctcacattaatcgaaaaaagaaaaaacagagtccatatagaaatataatttagaaatagctgaaattcggaattaaaaaataaggaatattagaatagaagactagagtccatatagaaatacaatttagaaatagttgaaattcggaattaaaaaataaggaatattagaagaggagactagagtccatatagaaatacaatttagaaatagttgaaattcggaattaaaaaataaggaatattagaagagaagactagagtccatatagaaatacaattaggaaataactgaaattcgtaattaaaaataaggaatattagaagagaagattagagtccgtatagaaatacaattaggaaataactgaaattcggaatttaaaataaaaaatattagaagagaagactagagtccatagaaatacaaatataggaatataatttagaagtaactgaaattcaaaaaattaaaaaattaaagaatattgaaagatgagtttagagtccacatagaaatgcaattagaaataataaaaattaagaaataaaaataaataatattggaagaaaagcatagagtctatatagaaatacaatttatagaaaatttagaattaaaaaaagaaatattaaaagacgagtcttgagtccatataggaatatatataatttacaaacaactaaaatttgatattaaaaataattaataattaacacgtatataaaatataatatgaaatataagaaataaaaataaataatattggaagaagagcatagagtctacatagaaatacaatttacagaaaatttggaattaaaaaaagaaatattaaaagacgagtctaaagtccatataggaatatatataatttacaaataactaaaatttaatattaaaaataattaataactaacacgtatataaaatataatataaaaattaagaaataaatataaataatattggaagaagagcatagagtttatatagaaatacaatttacagaaaattcgaaactaaaaaaagaaatattaaaagacgagtctagaatccatataagaatatatataatttacaaataactaaaatttaatattaaaaataattaataactaacacgtatataaaatataatatgaacattacacattagtagttttgtagagttattgcaaaatttaaaattatattgttattttaatatatttgaataatataatgagaaaacatataaaaatataatgatgctagccgctcaatctgcgtgggccacaatactactttgatatgaaattaaacacaccctcgatcatcttccgagtatagatgtggcgtacgtgaacatggatggatttgtttctcctgattttaccccgtttgcgtgtttcagaacagtgcctgtttctggtagttgtaacatggagaattttgcttgctgtaaatctgtaattctctccggcagcgcgctctagctcctggcatcagcggtctttcttcaccattatggagctcatgaattttttttaaacacatcacattttattaaaagacaaagtttaggggaaatgaattccgaacacatcaccaggagatagataagagttgaaccatctttaacaagagagaggtcaactgaagaaagaaagcaaacttcctaatgaaactagacagcaataaaggagcaaatctacagggtactgcagcaatgccgtgatgactgcatcgtagggcctgtattgatattgatgtgcactccgcttgacaagccgttaaatcccttcgactgcctccaccggaacaacacatatgaaaggtttgttgctgagccgtagattttggtgtgagttccaaaagtttccatatccatacctgttttcaaaaattttaaggccatataataaacactaaatctcccaaccctatccaaaatagtatactactgtaagacatctcaatttttttcctctggagggggggggggggggctactcattttgaaatggctagagatttctttgagtgaacacaatccaaagtctcccaaccctatccccgatgagatgttatgcttatgatatagggtggtactgttggttactaaaatttggaattttttgttttaaagaaaaattggaagcttagtttgcctaaggttgttagaactgaggggatcacctatacatttgtcgataaaatttctcctaaaaatttgacaaatgtaattacaatatagtcgtagtgtagttacactgtaaattacgtgtaattacactgtaactacaatgtaatttgtatgtaactttcacataattttaaaccgttagatctaagtcacaacacgtacatgtgagaggatttgttcccatactctattttaccgaaataacatgttacgtagagatttttaaaagttacatacaagttacattgtagttacagtgtaattacactatggctgtactgtaattacatctgtcaaacttttaggagaaaatttatcgataaatatatagcaaaattgatatgtaattatgacacacttacgtcggatatgaatattataaaattatgatacaaaatgggattagaaccgttctatcttggtaggtaagataccatgatttaaatcgacataccactaaccttacttctaaatacccctcatttaacaaggggcatcgatgtcatttttctcttttctactatctcgtaagagtagttattttaaatgttagacttatactactactacatttgtttcatattataagttgttttgagatttttaaatcaatctttttaggtttaaccaagtttataaaaaaatatagaaatatcttcaacacaaaacaaaagaactatcaaaatatgttaatgaaactaatttaatgctttaagtgtgtactacatttttctataaattggttaaattttcaaaaagaattagaaaatcgaagggaacttaggctgtgtttagttcacgctaaaatagaagtttggttgaaattggaacgatgtgacggaaaagttggaagtttatatgtgtagaaaagttttgatgtgatagaaaagttggaagtttaaagaaatattttggaactaaacacggcgttattttgatacggagtgaatagttccagttagcagcttgtgtgtacatggcacagtacataccagctgggtttgcagagaaagtgtgacagtgtgacagatgtgcatcatgtgggtcacaaactcatttcacagtcacacaccagataagcttcctcccctcccctgcatccactccacagtccaccacaccacaaacgtatctgcggactgcggcgatcgatttgggaggagaggattcagacgacgatcgatcgctcagaattcagatgaccagcgtgaggcgagcagacaaacgcagctgattcgacggattcagaatggcatcatcagttgcaggctcagtgactcgtcgtcctcctcccgtgctgctggcttgccgatcgcgaccaaataatcgtcgcctcatcagattgttaccgctcctcttcgccgtcgtcgtcttgcttgctcttcttccaccatgcgttcatggagctcgtgctctgaatgatgccaaagaagccaaaggtcagtcactgttgttaagatttgctgctagttgatctgcttcgtcaggagagtgagattagtgtttgtgtcaagtgtttgatcgtgaattgcagttgcagaggccagcgaccagacgacgacgacgacgcacgccgcggcggcggcggtggctcggtggtctgtcaccgtgagggaaggaggaggtggtggtggtcacggcagcggccatgccggcgccggccacggccacggcagcggccacggcaggccggagccagccgagcaccacacgggcaggcgcagcgcggcggccggatccgtgcgccctcccatggcggcctcctgcgccgccctccttgtcgccgccgtcgtcgctctgcttcgcttctgaatgaatgaattctggacccgaatcgctcccgatttcgcatttgaatttaaatcgattcatcttgctgtgtgtacatagaatgaaatgaaatgaatccaaatgaatcgccaagaatccgcccgattcggggattcccggcgagatttttccgcatcttcaatctgcaattttgtgtgtgcgctttccaagaaatcgagattttgttgaatgcgttcttggaatcgtataatccgttgctaaacttaaaaaacgtactcatctttccacgaattgcatttaaatacgtaagctgcggccatcctacggtacaccgagcaaaataaaattcaccaaccatggattcaccggtcaggaaacaatggctgctcctcctcgtcttcttcctcctggcctcctcgtgtgttcttgcagccggtgattcgtctgcaattggcagcaacgaattaacgggcaagcaattcaattcattctctccattgatctctctctctgctcgtggttagattgatctgatcccagtggcgtcttgtttgtcttgaatcttgatgatgagcaggagctgaggagaagaagacggcgagcacggcggcggagttggcggtcgtagtaagaagctcccacggcgatcaccatggccgccacggccgcggtggccgcaagcacaagggcaagaaatccggcgccgccgcctccgaccgccgccccggaggtagcacggcgatcgcttgctgcggcgtcgcctcgccgctgctgccaattggctgcttcctctctagttcgatgtacttaggctcaatggtagtagaagattagttgatcaggggttaattttgtttagctatcctttttggtattctttcactatctttttcacattttcatgttagagtgatttcactggtttgtaaggcggcagtgttaatttatggcattgtaacttaacaccgtattgagagatcatcaaaatttaaattagaactgtacctccttaaaagcagtagaaaatctcatttagttaacattctctctgtctatactctaaagaagaatgggtttacgaaagatattgtcatatttttcacttaattttaatcatactctttctactatagtaggtgttatgaaactacaaggtgatctcatgatgggatcgcaaccgaagcaaccgcgtctcttccactcgatgatccgtcgcaacgggcgcgatggttcccaaccttcgcgtctacggttgccaccccttcattgatcaataaagaacatccgattcattcgctcaattctctcttactcgttctcaatcgattctattcactttcaacagtaggtatgctcagatggattcttaacacgtgttttgatgagggctcagcttgaccccttttttttttctaggcttgaaataacccaagacctaaatgtgccatttgagcattgtaagctctagactacgtactacatcgcaaaacttaattacaatataagttgtaaaactgatttaactatttatttttaaaatgtgccgtcgtaaatatagctaaaaaaaataattctagccatgcaactggctagaatggggacatagataatacgtcatatatatgttttgtgtcataatgccgtgctaaaacatgtttttatttttcactcattttttgggtgttgtcgtttttttaggtgtggctgtatacatccctgggatgtaatggcaaggttttatttaaatccattatttaaaaaaaaggtttttaggtccggtctttcttttaaaacgagccaactctccttgatatatcccgtgtaactcccctcatcagagttttaatttttattaaaggtccttatgatgtgcatctaaaagaacaacgatttgaatgtattttcttttgaaacaaggagtcccatcttcatgacaaaaacaatgaaaccggagtacaaggacccaagaaagaaaaagaagtacagaaactctgcacaaaaagaaacaagtatagaaaacttagcatgattactactttatgctccaaaaggatctaaacaagctaagctaaatatagttttaaacaagaaccattaacaaaaacaccatgccaggccaaaattcaatcccataaaaaaaatggaagactaattgtctgtatggaaggagctaactctgaatgttgctgccaacacaatcattactagttttagttttgtgcctaaagttgatcttacaaaccatttgagcttcctggagaagttgttacaaccatttgaagagtagatgttctactgattcgaggcactgaacaaaacatgctcctcttggatcctttccacactttggggatcaggttttctttagtgagaatacaattctgcagcatcaaccatatgagcaccttaatcttcagaggcaagtttgtgttccacaaatacttgtgtgtgaacgctgcctgagtgatttgatcaaattcaaagcctacctatgcatatttgcctaaacagcacaagttagtgttctacatgacttgttccattctgaatagctctggtccttagtaattattggctgaatagctgaatgatttgtgataatatttcatgggtacaaacaaataaattaactatgataaagttggaaaatggatttaaaatagtataacaagaaattcgcacatatatatttttttctacaaaatcgtaccgtttaggagtttgggaagcattcatgttaattctattcattacaaacgaccaggtcatgacatttcataccatcaattggtacaagacccacatgcgtaattgggcgggccaaacaacacatctaaaatgtgcaataatagtactagtccttaaaaaaaacaacttggtgcatatcttttaaatatgaccaccttttgctgcattgttgcttattagtaggataatgcttttggggaaagaaagctgaggataagaaaaaaaaaaacaggaaacatgtattagtgctggatgttacaaaataaagaaataagaaaaataaacaataaagttggtgtccatagctctggcagtacaagtggaaagttccttgaagaacttattctatctcatttttaaaggatttttaagggaaggatgaagagtgttggtagcagaggcagagtatcagttcagtttacactactactacatcattagctctgctcattgcagccatggagagtgcaaagagatcttgccttgctatctccctcatcctactcctactccttgttccaagtatccatggagcaaggcatgttgctgcagctatcaagggtacaggtacgcagtgttccttctcttctctgcatgtctgtcttagtaggtttcttacaccatagtatccttatatgcatcgtttttttcagctctatgtttctatgaaacaaatgatgacaactcccgtgtatatatgttttgtattgtatctgcatagaactgtatgtttctgaatgtttgtaaagttgttattaacatgatttctatggttctgttggggttggacatgatgttcgactattcaacttaactttcgttccactacttacaatattagttttgtgggaaacacatgaagatttgtttgtttattacaagcattatgcacgatgaattttttgattatgtcaaaagtacaaccaacaccagaagtgggtccctaaaaaagaaaggcaagattatagctgtggttggttccctttggctaattgccataagtttagataagcaaaaccttagaaaatatttgaaatttatctacaccgtgtatttcttgaggaaattatctacaccctattatttgtaaaacgtttctaatttcattttgggtagcctcgcataagttgtcgtcccgtttatctatctatatatcttccttcctcactaatcaaatgcatatccacctgcaaaatgaacaaaagtaattgcaatgtcaagcatggccctactgattaattgtgtccgtcgatggaccgaagaattcagtactaaattaaaatgttcagatctggaagaaatttcttggaaaacaaagcagttgatttccttattgttaaaatattattcagtccaaacatgcctatattagttagtaattaacttattcaaaacatatcaagggtctggctggcctagatacttgaatctccagtcaaaaatcaataaacaagacaataataataataaaaacttgatgaatactcatgtggtgtgtgagcgcgcagatcaggcatcctgcctgaaaaccctgtcaagaacagatgctctgtcctgtccatgtgggggaacacagtataattaatgagatattattcccctgcatttccggagacccttgcactgcacgccgttaatgatacttaattatattcctaactaatgctctcgtgatatcacacaaagtgattattcaccaataataaatataacatggcatcatcacgtcctgtttacaaacaaacaacctgatgatcatgtgtcatgctcgatccagaacaaaccataaaaaagagtagaaaaaaacaattttaaattttgaaggacatataaaatcaagtactcgctctgtactactccctccatttacttttgatagttatatttccaaatctgaaaaatttatttttgatatgtatatttcaatccaacaacctatcaaattaatgatttttttggatttaatgcgtgactcttcattcttccacacaagattagctatataggcatcgagaaatgtaaatattaatgaatcgcttgtttacgaggaatgactagtagcatgtttaaatggatgataagtaggattatttatccttggtctatatgctaagatgaaatatgactattaaaagtagatggaggaagtagaatataaggatttttagggttagacacgtgtaactagataaaattaaatgggattgagaagtggaggtagatgaaaaaatttgaatggtgaagggttgtgattgattgagaatagaattttggtgaagaagttttatattttgagacaaatcttaagggttagaaattgttatattttgtgatggatggagtaattaacttgaatatgttattttatgattatctaaaaaaatatgttattttgtggcacgtgaagaacagaaacttgctgatacaatttcaattgatactatacgtgtgtttttttttatatacaggcgccgacagcgagatggtggtgacggagaggacggccggcggcggcggcggacatggacgcggttacacaagccaccggtcgcacaaccccaacaatcccaacgacggtggctccggcacgccggtggtggacccgcacaatgtcgccaccaggggccaccaccaccgcggcgcggcgacgaggacggccgccggcggcgacccccgcctggcagcctgcatgcttcgtctgggagcgaccttcttcctgctggttcttggctgaattatttattggaggatggatatgtggttatttttcttaagtttttttactgctttttaaatttaatttttctgcgtttttgatatagtgtggtcatagttttgtgacatgttaaataccaagagatgatacaaggtgtatatataccatgtgcatgtgaagttgggatgtgtgtgtgttttgctttgcgtgtatgaagacatatgtatggagtttgtttggcagaatgtgtggtttatatgtccatatcatattgttcaatgtagtactaggacctagagatcagagagcatctcaaatcctagtgctatcagtacagatcttctatacaccttagtgtaatacacccattttggatttgcatttatacacttcagaaaattttatatgcaataaacaggtaaaccatgcttgtgcatactcaaaatttagtgtaataacacaacaatatgtgaatatatataaattgaaagttgcaaacaaatacaaattttgtttttttacgaaacacagtacaagcacacagatgctcatatacacacgcgtgcattgatcccaatgaaagcacacgcagaaatcctagccttaccaattccgagagattgggctggcatattttgaaattgacaaagccaccattgacatcttgttgtcaataacacgtcgtcaccatggaaataataatttgctgtaaatacgatcactcatgccaagtctagcacttcagtgtcagctatcattggcaggttccttaataaaaaacagccgagctaacctcagtttgccaagtttcgtttctttcaagattggggaaatatgtttataaatggattatttcaaagccgtgaacaaattattagttgcatataggagtgtttagaacttgaaagtttcatcaattttggaatgaaaataaattttcttgtaaatatttatttatttggatcaatcaactattttttgtggtttcaatcgtactttgctatgtatgtaggtctcttaatgcaaatgagaaacttttggagaaaaaggtgtaagcactcagaaaatgtttcagccataggctcggccaaatccccaaaactaactaattagatccatgtacgatcagacatggatcgtccctggtttcctttcacaaactagcgtgacctgaattttgcaacctatagtagatgtgctacataagtctagtttgatctagcaataggagatatcaataagtacgaaacgaagaaagaacaaaaaattaactgtatttaataagtaaaagaaatacattgctttggaccagctattggccactcaacacacattttaatggaaaaacagatagatttttaaaccatatgattaacaacacgtagcttacactagacaatataaaacacataaaaccaattaataagattaaaataataagaagttaattagaaaatacatattcccctgtcccaaaatataaaatttttttatggatgcatggacatggatttagattcgtagtactatgatatcctattcaactaaaatcacttatattctgtgccacaataaatatgccattttagaaaaatgccactactattcacgattttgcggatggcgtcaaggatggcggcagcggcggcactcgagacctcccatcgcggatgcgatcgatgacagaaacggcggcggcggctcccgagccctcccacgcggatggcatcaaggatagtggcggcggcggcggctgcaggttccgagccctcccgtcgcggatggggtcgaggatagtgacggcggccggggctcctgagcccttccgcgtggatggcgttgaggacggctgctcccgagcctcctgccacagacggcagtggcagcaacggctcctaagtctcccgccgcagatagggccgacgatagtggcgacggtagtggctcctgaggccttcacggaggtggccgatgacagcagcagtgacggtggtggtcgacgacagtggtggagagagaggaaggggaaagagaagagaggggagggaagtgaagatgaaactaacagctaggtccctcgtgcagttggggttagcggagatttttgacggaaaacgtgatggagtggtatggttctaattttttcaaattccaatggcacgtagccaatattgtgaatagtaatgatatttttctaaaatggcatattttgtagtggcatgatccaattaacccttaaaaaaatatcacttcatactgcatgcacgcaactggccctcctcgccttctcttccctttcctttaatcttttctttatagtagttgagataatatttgttatttatcatattaaattctaatcaactacaaattcaaaattacacataaaatttttacatacatataatgtaatagttgagataggcttaaagtggtgttgacatattttaaattataataaataaaaatgttttttgggtcatataatgacccttttcatcatatatgacaaacaaatggcgacatatattattttattatatatcacttttacaaacatgcataactaaattcgctctacaattgaaaacgaagtttagaccatcatattatttaccattaaattaatattttactatctgttttgaatatatttcaacttataaaataaaattatatttcaggttgcattttgattcttttcatataatccaaacagacatgaaaattatataacaaatgacaatataaagcatatcattatatatctgttatcagttgacaaatatttatgactaaataggatgacaaaatccaaaaatgctattgacaaacgcccaatttcaaccaatgtcatcaacaattttatttataaatactctacacaaactaatttcatttatataattgctctcttatttcaattttaaattcatttttccaagaacatagtaagtatatgaaaaaaggaggtagcagaagtaaatataaatttgttataattggacaaaattttcctcttaccatatatatcttaatagaaagttttttccattaaaatatcctaaattccataaagatatctatagtacacaagaaaagctattacttaaagtttagaaactccaaaaatatgatatactaaatattaaaaacacatatagtacaaatgataggtccatacgaatcaactccatttccacgacacgatattttctcataaactcaagattttatgaattccaataaataattttaatgtagaatttatatgttgatagggtagttagaagaaaatcatgaccaacatttaaagcagcgatcctaaacaaattatggacaaaaacatatttagaatataataaaaacatattacaaaaaaatcacccacatgttaatattattcataaaatttcaagcaacattaaacaaggtgtcagtaatgtgcctgcggctaccttttctagttacaaatataaagacgggacaagtttttctggagctacctaattaagattcggcaatctccattattcgttgttgaagcactctacataagagttatgctccctgccttgatcaggtagttaatatgtactctcttcttggtgatttttctccggtcgggaagatgaaccctaataaaacctttatgtagcatcctgagtttgactcctttacttaaaaacgctttttattacgttttaaatttcaaaattttgaaatctcgtgccattaatgatttcaaatttgatcaatatatccctccatctaatgttccctccaaaattcatcaagttttaaattcataataaaatcctgaataaaaaaaataaaaactgtactccaattccaatcccttaataatctatatacttactgctataaaaagcaccagttcatcgaacacttatctttttcgacccttagatctattcatccaacggattatatcaagagttggatcaccctgcaattagcgattcacctctgctaatccgcggttagagcgatcggtaaaaaggagagaggaattaaatcccacgtcgtccggcgagagagagagaggaaaaaaaaaaaagaaaacccacgaacaaccgctcgctctgcggcttctccccacgccgagcgccgacgcttccctccccttctgtcgacgcgtgatctcctcccccaccacgagccacttccctcgatccctcccgtcgaccgcgcgccgcctccgcctcggcgagaacccagccacgggcatgcagggagggaatcgctcctcctcgccgaccgtctcccatgcctccttccatcgcctatgcgcctcaccggtctctgccctccccttcgccgttgcagcacctcgccggcctccacccccggttgaaatcccgtttttttttttgttttccatcggttacctgcaaatttgagcctacattgttttattgaaacgtggtctgtggatttggttgtttcagccaacgtggtttatggattttcaagtgatctgtggatttagtgagttgcattgtaatatggtattgtagatcatgtattttaggactgacttttacattaaacatgccccatggtccatggatctgtgcatcgtaatatggcctttacttatctgaaaattgcttgtgaattttgcttctttatattcatcagaattttacttatctgaaaactacttgtgaattttactttattatttactaataatagcttatttgtatcctgaatcatttgaatagcttttagatataagggaagaaaaatggaggagctgttggcctgtgcttggctaacaaaattggtggagaggtatcatgtaaccaaatcaagcacataatcccttttcccttttaacatttatagtttctaatataaagtgttctaattggggtgagactgttgactggcttaccatcttggcccctcttagtacaagagaatatatcacatcgaagttttccttctggacttcatgaaggaattaatttttcacaagtatctttggcctaatcactaatcatcacactttgtgcgaagaagtcgagcatttctttgtcggtcatctcacaagtatcgttggcatggatgtcatgctggcctaccccctgaatggtgctgcttcagtatttggtggacttcaatttcagaatgatgtggtgctctaaattttttttccttttttttatctcaggtttgacctttggattgcatcttaggcttttgcatggtcttcgactggtaataatcttcagaatattcacatttcctgtgaccaatacatacctaaagtctagaatgtcactatactttggcatggtgcaaactttggcgagttctgaaataaatattcatgaatcatgagctaacctctggttaataagttttaacattaagatcattgatttactacatccaacattgatgttttaatttgttgggataaaaatacatgaattgctggttgatcaaaataaaagttattgcttagggagcaaccatagaatttgctccagggaatttttttttgtcctaatgacacattgattttcaaattctatcaatccttttgtgtgtgctgtgcaaatctaattcattggaaaagatgttagaaaaaggttttccgaaaatgattgataggttttgtgcaaatctaccccacaaattggatttgaaaggctggttgcttagttagatccaaaaatcaaacttttctatggccttgggccctaatagtcaaccttttttcagaaaccaaatcttcatttcgccggcacaaggattgctgcacctttacatttactaataacactcttattccatatagtccatgcaccgctgccaaccttgatccacatcaagcctccgcctccaaagctacaggagaagatggttgcatcaaactcctgccttctttctcttcaagtaacatcttatctgtgttttgatggaattttggaacatgcatggataattttggtccgtgttttgatgatttctctaatttctaagtattgaccatccagagaaaattcaggtcttctgttactcatagtaaatatcatgatgataataatagtttactcctaatggttctctttgttccgctagaaagaagtggacgattgtttgaggaagtaggggagagagtgaagcatgtgatttttcaggcaagtttgtcaaagccatttgaatgagaggctcaggatagctggtggtaaagcacagaacagcattggcgctgctaaggaggctgatctccgggcaacctaatgttcattcatttgcgacatcagatttgggctgcaactgtgagttcttttcaatcttataatcaaactcgatgcattcttgaatgtggtgcaacagtttttcttttataatcatactatattatataaattcatattgtgaatataatctagatatagactaatataaaaagcacgagttgtttagttgcaattagcgcttaaccctccaattagcgcttaaccgtcgccaaatcgaaaaaaaccgcgccccgcacccctcgcctcgcctccgcctcctccgctcgtgcgcgcgtgaagaagaaagaggaacgaggagagaagaaatcgagaagaggagaaatcgagaagagaagaaaagggacactgtcaggtgggacccatgttcctttaattaatcttgcacagtaatcatcctcttaatcctgcattattatctcattgacacgtgggtccggttgcacaaattcttgattaaatctatatctatactctatactaatctactaatataaaaagtaccagttcattaccaatcccgcaatcttctagacccactctcacgtgggtcccacctgtcatccctaagaaagaaaccgcaccgcgcacgaaaaaaagaatcgctgcgaaaggaagaaactgcaccacacgcgccatccccatgccgccgctccgccctcctcacctcaccggcaaatcaatccaccgcatccactggccgctgccgccgttgccgcgatcccagaagattatgcgggcaccaccacatccatccccgacgacgtgttcttctcccacatcttcgtgaacctcccagtaacatccctcgcatgtttcagggcagtttgccgctcgtggcacgccgccgtcgacgaccccgccttggtccgctgccaactcgagcggttgcgcgcgaggcagctgccaacgtcatccttgcttgctgtcgcgagcacggaagatatatgggacgagaaagcacactctccaacttcgaggttgtcagcttcaccggctaaggcttaccctgcgggcggcggctagaccaggagcgagagcggtggcggcgccgccgctagacatcaccgccgagactgatccgatgcaccacaagtctatccctaacggcggccgtatcacccgccatatcatccccacccactgcgacggccttgtcgccttcgccacctacggcagggccatgctcgtgtgcaacccggccacccaggagctcgttgtgctgccgcccggcaacggcagcggcccatgcccacggtctacagaatcaacggcggcggttggcttcgacccgtggcggaacaggtacgtcgtcgtcaggtgcttctactgcaagtcccacaacgatccgccggtctacaacatcggacacgagatcttcacgctcgacacaggcgccggcgatggatggcagcgcatgcaagacccgtcgcgtgccatcagtcccggcgggaggagacccgccgcctgcacgcgtgggggttccttctactggttcatcaacgagtctcagccatgcgagctgctgtgattcaacctgcgagatgaggcgttcgacgcggtcccgtcctctctgggctgcacggcctgacacaacgacgaccgtctctcggacctcgccggtgagctgtgctacgtgcatcacgtccgcacgagcgtggccacccacgaagtttggatggcggcggcagtcgatgacgatgactaggagtggtggctgcgataccgagtggacctgtgacacaacccgtggggcgcggcggcggcggcaacggccaacgctggttccacaacttcggcaccacggtggccggcgacgatggcgtggaggaggaggcgacgttggtggccatgttgtacaaggagctgtggtggcacagggagcggagcaaaccggtggtgaaagacgtgaacatgcaggggagccggtgcagttgtgagtcggctcatcttgaaaataacttacacacgttgacatgtttagtcagtgtttgttgctgcttcagacatatgcaaagggaaaaatgtcagtgtacggaagaaaaatgtcatagagaggcatgggggtaggggtttatttttacaaattcaaaataaatttgatcaaacaagaaatctttaagtacatacataacctcaaattgatatggtaagctcgccaacatgtgaaaagataaccaatgaggattgatatgggacttactatcaacatcttcaggaatgatttattccaataagataacattaccagaacatagtttttttatgatttatgttaccacatactaaccctcatgattgatttaggcagtggatgtatatggtcaatatatgtcgacgtgcctcactagttattaataaagtagcactattcatcgtcctctttcccctctctctcaggccgggctagccttctctctcctatccttttatttttcagcccatcagtaagccggcccagtccactccctcctctttttttcctacgcggcccagctagcacgggccagaccgaccaacacgtgcccacgcacgcagcttgctcgacgcatgccgcgccacacctcacctcgggtcggccctgcctgctgcagcctgcatccctttagggcaagcttcacagtggagatgatagtctcccttaattcagttcacatcattaactcattaatgaaaatgtactactccctccgtattttaatgtatgacgccgttgactttataatcaacatttgaccatttgtcttattcaaaatttttgtataaatataaaaatatttatagcatgtttaaagaacatttgatgataaatcaagtcaagataaaataaatgataataacataaattttttgaataagacaaatggtcaaacgttgattaaaaagtcaacagcgtcatacattaaagtacggagggagtatatactacaacaaattacctctagcacacttaccataatacatcatattaattttgatttatttgtttgctatcaattcattggtctcttgttcttatatctcttaaagtttgtatagaggttgttccttatatgagaggtgtctctttctctctcctttcatctctctcatccacctcatcatgtgagcttacatggcacctaggggtaagtgtgtagaggcttagaccattcccaacccaatgattaggatggtgtctatagcattaaataagctgtcacctaggatgaaagatgatgcggcaagtgaataaatgagtaaagagaagggaaacaagtttggtacgagacatggtttctacacaacatccaatacatcatatgagataagcagcattaaatttaagtatggaaaaattgtgtttgcgttgaaagagtagtgtagtttattgattatgtgaagtttatgtaaactatgtctagtgttttgggttgagactggccttatactactggccactatccacttctccccaccgtcacaaagaagacatacgcatgcattagagtaagttggtttaatagtgtagccaactactagctccaaatcatctatggccaaattaatagccaatttgtataatacttactcactacgctattaatatctggtcccacctgtcatacacattatgtcttggagtccatgctgtaggcctgtagctggctatagatctgtagcccactgtttttctctcatcttttatctctttaaaatatgattatatctgatttataataatgctattgtacctgctcttgtatcgaagaacacggcaagatcacactttctgattcactttcttgtatgattttattagatacaagagaaaggtactactgcttttaaaagtaacgagctaaaaacaatcacctagactcattaaagtacttgactccttaattacctaactgactcttcgattatctgaaaaaaaaaatccttggttacttaattgactgctgtatattattacctccggattgataatacttatcgttttagaaaggatgaggtcaaac

SEQ ID NO: 58101 - DNA, 3033 bp, Oryza sativa
tcctgcagccctgaataagttgaccagacgttcctcaactttacgtcaagttcgtataacatccctataaaccacagtaccagaaagataaaagtacagcgaaggtccctcaacttgtcatcgagttacaaaatcatctcccaaccacaaaaccggataccggaggtccctcaactaacaaaaccgttcgcttgaggtcctctggtggttttgaccccggttttgtctgacgtggcgggtgagtcagcgtgggcctcacgtggaccccacctgtcagcattgccacatcagtcttctctcttttcctctgtggacccccgtttttataacaggaatcattcatgtaaacagtaccatttccctggatcaagtagtctggtacacaagttcatagctgaaataccaaaagcacatacacgagagtctagtgctaattattacatcataagcccgcaggcattgtcttaaatcatcggaccgagcggtccggaatacatccaacagaaatagataaggcagcggaattcaggcagcggcatgccattgccacaggcaacgaccgtactaagaccctcctggtagtaggcatagggatcctccgaagcttcatctcccgcttctgattaattttatatttgcaagggtgagtaccaaccgtactcagcaagtcaccacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaagaagtggctccaacagcataaaaattcgtcatgcaacaacccatcccacacaagttaagaatttagagactagccaagtgtaatacatgtcctggtgctcaataaccgcgagcacggctattcgaatagatttggtttactcacactgcagtggatgtacactttacccgcactccgtgactgcccaacatatgagcttcgtcccaacacatgagacgcgtcacggcaaagcttttcgataacctcgcattggcagtatccgctccatgaacttaaatcctcatgcactctaggcgtccatgtttctagcagtgtgaggagttctggcgctcccgggaaagagaagtcttacacatattaaattatggttcaagttaagttctctctctcacacactcatggcagtcctaccaatggcgacaccgatgtagggcacgcctctcagccctacctcaacggctgtcccatcgtagcgcacctgcctcactcaggggtgaaccatctatgcagggatactgctccgctcggctatctaatccgctaggtctatacccattcgagaagtacggttgtatgggggtcgtttcatgcttaacttcatggctcggtccttaattgaccggggacggtactagcctttcctagataccacccaaatcctccgtccgccccagtcgaaaataattgtttaattttatttctcctttcacaaatcatgtcatcaacatcatggcaatgtggcgctcatgtctccacatgccgtatctcaattaccttcccaaaagtaattgcccaagcatcatttgataaatatgagtatgcatgattctagaatagcatttctaagcaattgtcataatcgactagggactcatacgtaaatatggttacgaaggaacaaggggcaaacaataatcaaggcatggcataatcacaagtatgatgttcatcattgcatgcaattttatttgtaaacaaaacaattttgcaattgggatcaacatgttcaaggaatagtgatgacttgccttgctcaaagtcttgcgggtcttggccttcacttggatccgcaactccctcgggctctatagttatgtgcgaaaattgatttgaattcggttagaattcaaataaaaatccaaataaatccaaatggaagtcgaacgcgtaaatcgattcttttatattaactttacttttcgcgaactagggcaaacccaatttcgatttttatatcctaaactattttgcgggtataaatattttgttatcataagtttttaatttaatctacccgagcattatatccatataataggttggaaatttctatcgcaagctaaatatcggacagaatcctaaaattatcttataatattatacaattaaattttagtataggactaaacgactaaatataatatacgtctaaaattcctagtgattaaatccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgtctataactagtctataactaaatgctaattattttaaattttctaaacttccctaatctccctctaatttcctatctatttcccttttctttttcttcccttctttttctttttccttcctttctttttctttttttttctttctctctctcttttcttttctttttccttctctctctcccttttcttttctttttccttctccctctccctcccggtttctctcctccttcctttttctttctctccctcggtttctccctctctctctctctctctctcggctctctgctaccaggggcggcgacggcggccgagcaagtggtggaggcagcggcttaccgacggcggtggcggcgacggcggcgacagcgacggtggcgacgtcggcgcaaggtgcggcgcggcgcggcggcttcgtggcggtggcgcggcggctctatgcgacggcgcggcggcgtggaggcggcggcgtggaggcggcggcggcg

SEQ ID NO: 58102 - DNA, 5289 bp, Oryza sativa
tttaaagatacttctatgctcagagcataatagtgatttacactgatcttaaagcggttcggcaattctggaaccttttgtattgtgtgcgtaggttgttcggttttttgctttcatacgagtaacgtgagccctgaaggggcggaggacgcattgccaccgcgcgcgcgcgagaggccgggcagaggcagagacctcacgcgctacgcgttgcatctcattctcgcgcgcagggggcttcgcttcgctttgccccggaagagccgcaggatttcctgcgtaatccaagggaggaccggccgctggctgctaccgtgctcgctatgacctactccagctactcccaggctacaggccatgccatggacgagtgcccggaccggacgacagcgagcggcagctagctacacactagtacgtagttactgtagtcccgcgtcgcacggcatccggccggcctctcctaactccgccggttggcgggcgggtcggtggacgacgcatcaaccgcgcacgtccttgcgttggcccgacgagtgcctgccctgcaaagcttgcaaagggttcaccgatcctcgtaccaaattaaaatccgctcactagcagcataatcagatttcgtggagcctatcgataaaccaataaaaaccgataaaatctaaaaaaagatttagataatggaaatggattacatctccggtctctccatgtgaaaaatccaaataaatttgattaaaaagatataattcagttttattttttgaacttgactgaaaaactaagtggtttgtgtttctcacccgctctgaaaagtcctgattttgcgaaatccaaaccggatttcactaaaattgtggatctgcctgcaactagtaggctggaaatgaagcatgatcagtagggaaaactgatgcaccttcagtaaccgttcgggcagtgggccgcgcgaaacccagcactcagcactcagatcatctgcattttacagtggtcttagcactgagtacaatcaagggagctcctgccaatgcatatgcaggttttacggtacggcatccatgtgtgcaaatcatcatccgcatgcaagggtcagatcgctctcccaagtcagtgaaggtcacagtgaaccttttccggttcataattgcccggctagccgccgggagtccggtctaagtcgccgggtctgactctgaccaagatgttcgacctcgacatctgactgcaggacaatcaatatatctttggaccaacccaatgaatgaattgaacttgataacatatccaagctaggattaggagtatataaaacagcatcaatgtgagacttctcacaagtcacaaccccgcctgaactgaatctagtgtagtgaagacaggagtggctaaactgcatcccggaaatgcttgggaggaagaaaggatcgtcgtccaggttgagtgatcccatcaacacgactgtcactactgataacggccaggaaatggctgcttcgcatttcatctcgcagcaggcttcacagctcggtaggttcaaacccccgcttcaaactttcaatggacgtttacattgttcccggcgtaagttgagcgataagagagactcatagttcttctctcctctttgtcagatgaggctgcgaggaagagactgcaaagaatgaacgagaggctgaagttgctggagatgcagatggaaacactggaggctggcgtcgcgaaggcgagcaatgactcctacgagtagagatgtttagcaatctttgttatagacaccaggtttggtgacatgcaagcaaaattagatgatagcttgagtagttttacctgaacttgcagcaaatcaccgtcacctcgttgtagaattccggatctgtttcaggtttcagcgcttcagttttgttctttcactacgagccaataagctttagtgcagatgtcattcaagttttctgccagaaggaatttacagaatttgaaccataacagccgccatgatgatatataactctggttattgttcactttacaacagtataaaaaatgatggactttctcggacaacaatagatggacaagggcatatttacattagtccctctttgattgatttcaaaacacaggctgagcctgatttttttttcttcgcctcgactaatggtacgtttctagtaaataaatacagatgcagtaccatgatgcaaaccaaaataaaagatggccatggtagcagcccaatagaagagcttcagcagaattgaccaatgaagtatgcaaccacgctgtgacatgattgtttactcacaagctagtttagtaccgaagctgctaaggcagatggcgaaagcctgaaacgccgagagaggttggcggtaatccatagtgaagatattgctgtcaactttcccaaactgcaggataactgtttcctcgtctccaacgctatctggatggctggggtcagctgtggccacaagctggaaattcttcacggatgcaactgtcactcgcccatgaaagtttaagcaccagcactgcaagtgctcatgccagcggggagctttgttccttaagacaagtggttcctgtgcacctcaaagattttgtcttgagggaattctcccaggtttcttgagttgaagggcattccattgtgcaaaacatcctcctaggtcccctagatttaagaaggttgtatttgtatgagatctgcccaacattgaagttgcctgccgatatttgggggcagatccgtctacttccaaaacggtgggtacttccaaaacgctggctagatcgagtgcttgatgtttttgcatcatcgtatggcggctggttgtcatatatcttgaaatttgtcccccaaaaatcagacctaaaaatggtgcagcagaaacacaatcaggtcaaagaggaaataataaatgcaatggaagtgcgtcaaactgaacataagaagcacttctccaaactgttatcgccaagaaatagaaagagaagacagtaatatgacaatgcatgatcattttaaactacttaatgtaaattccaagcaagtagcaactgttggtttaagtaccaatccagattccacaacaccaataaggacatgtaagagagataacatgaaagacttgcatatgctattcctgagaaagacttgcacatacagatacagcgcttccatgcataagcctgccgtgctgtaagttgtaaacttcggaagcgttgtacaggagctttaagctcctgtagcggaagcgttgtaaaggagctttaagctccgaaagctttgtaacagatgctccttttcccccttcttaataaacttcggccagctttgccagccaggtgaaaagtttcccttttcaagtcttcaccccaagagctaaggtgaaatataggtacttttcccacaatcatgtacagaacgtacaatagtcccagcacagtaataccaataaatttctagatcatgtattaatgaattggtaccacctattaattacacttactaaatagtatttagaagaatgtttatgtgcctgtttcttggtagaaaaagacaacagaagaaaacacatggagcaagtgagcaagagcaatggaaggtaaatgataactacaggatgcgcgaaagctacctcagtttccccacatatgcattgcttccttgtgacaggtcatcagcatcaagggaaataacatactctgtgtggggccccctcctaaaccttctagcggccatgagaaacttccctttatccatggtacctgttgaacatgaaataaatagataatcagcaaagcatgtctcatgaaaaatcccatttatcatggaaatcaggaaagaatatccaaaattatccaatatatgtctgcttatccagcttgtgcacatgatgtcgtattgaattataaatatcacaaatgcactgcaaacaaagcatagaaacttggcagaaatagaactagcaacataacatttgatataagaggaatcaaacaggcaagcaggtacacatgtgactgccaataactagtgagtagtgacatcagcagcagacaggagccatacaaacgtattatgtgtaagctctcaagtcattgaagaatgtacaaagcaattcaaatacaagatgattcagtggcaataaactttgtatacaggcattaaaaaacctggctaaagctgatgcagggacaagggaaaactattccaaccacatgtgaacctaacaaaccagattgagtcataatacatggtgtttcaaattgaagtagcagtaagtgaaaaacgataatgcttcaggtcattaaggaagcacttgcatgtttggattatgccttagaaacataccattcaacaagcctaggtaaagatagaacatagatttcttcttgtttcgcttgacgaagcactggattgggaagtccttagggcctggctgctcaaacaacatggaatggagcaaaatggtgtcagcactggatatataactgaccaaaagtgcaaatgcagatacctcaaacccactcttcaagttgtaagaactgtacaaatatccacatagcttatagctaatgagctaaatatgtgctacgctattcaaccccccccccccccaaaaaaaaaaaagagagagagagactagataatccttcagcgtgccacataacgaagattataggcacaaacctgtaactactgtcctaataggcactaaatctggtcagaactgaactttctgcataatcattagtcacctaatattagtgaccacattggaacttaaaaacagagatataaagcatacatttcccaattgcaagtttcttccctactcctacatactagcaaatttattaaaacttaaaactaatattctatttctcattcccaaatcctattcgaaccccagaccaaataccggatcggtggagtactagtgtacacacagattatagaccatatcgatcccaatctgatctgccaaaaatcctacttcacaaaactggtatttctgcaaccctgcaatgaatgagccctagcaccaaatagtactaagctaattaaatcaacgcctaagcaaggggccacacctgcttgagcgatgacgggaaggtgattctgccggactcggggagcggccgcacgacggccgccgcggcctcgcgccaccggcggcagacgcacgcgcacgacacgaggtccttccgcgcgggccaccgctcgccccccgacgcctccacgcgccgcaccacctcctccacgagctccggcagcag

SEQ ID NO: 58103 - DNA, 2039 bp, Oryza sativa
ccccctccccctcccccaccgccgcctcttccttgggctcccgaaccgccgccatctcctctctcctctccctcgcgcgccgtgtgctcggaagaagcactcctcctccgcttgtctcggagaagcgaagcggatctgcgagtggtgtttggcttggctgcgggctgcggtacgcgcggtttttgtagcgcaattttgacggtttcgtcttgcgcttctagaaatcctggactggtacgggcgcactctctggtttgtgtttttgctcgttggcccggaccgagacatgtcgacggccgttggattcgaggaatggacgttgctaaagatatggtaattaaaaattaaaaaaagttaaaagttgctgattaatttttttttacttttaagatatggtaattaaaaatttgctactcaaagtctataatgtgtgtccttatgtgtccatgggtctagttgtaaattcttaattattatttcatccgtttcacaatgtaagactttctagcattgtccatatttatatagatattaatgaatatatatatataataatgtctagattcattagcatctatatgaatgtggacaatgctagaaagtgttacactgtgaaacgggggagtatatgtataagagtagcaaaagttaaatatcttgtagtgaccacctcggatgctcccgatgagagttttcaagaaattcaaaatttactagtagtagtatgtgaaatgtacaagtccgttttagatgtttgaaacggctaattaaccgcacgtaaaacaatatataatcaattaagtattaatatataaaagtttgataaattttctaaataacttatatataaaagttttctcaccgtttaaccgtttgaaaaatgtgccaacgaaaaataaggagtaactaagctacaatagcggaaaagaacatagccttaaatgtatggatttcatttgaattttattagctaaattttctactactttcgttatagaatataagaatctatatagaatatgacaattcctattactataaatctgggtatgaaacatggtttgagctcttttcaagatccactgtgctaggaggctggatggcaacacgatggaattgtgcagtgaaagagagaggggtcaacctcatactccacttacatcttcgctccgtgcagctggcggccagctgctggcccctgacaccatttgattcgcccaccttattttccttgggctcctccgtttgattccgcttctggaagaatcagatttgcctctgaatacatttgtgatgttgctggaacgtgtccactgactcagtggagattatctgtaatactgcagaggatctctgtcccgttaatttggtgttactttctacttcctccgtcccagtaaaattgacgtttcaacgccccaggcttgtctcaaaaaatgtgtcgctatacagagaagaggcactcctggacgccaaagcaagtttaattgttgattcaaatttttgaatatattaatgatggctttgcccctttatcaaacgtgtggccaaggcgccaatttatgtactccccgtaacacgtggtagtgagttgtggttacttcattactgctggaaatatcctctagaatattcggagtgcatgtataaatgctggaaatgacagctgaatcaaatcatggatacaatttggtaattttgcacaacagctaatcttagctactaaccttaaaacgtcaattttactgggacggaggaagtactactagtagcacagtatcttgtgctagtgccactgcttcagaaaaaaaatgctggatattgcgctgctgttgatcacctacacatggcttgtgtacatcaacgggagagtcagagtgatgaccaaccagtttgctaccactagttcttagcaaatcttcggtgatcggtgcacggtaatagcattgattaggctatgatagtggcctatttgattatggtactaacttcttcgatcttctgattccaattcagacttctgaaagtctaaacagttg

SEQ ID NO: 58104 - DNA, 4175 bp, Oryza sativa
tggaaatatcctttaaaatatccggagggcaaggtataaatgctggaaatgacagctgagtcaaatcatggatacaatttggtaattttgcacaacagctaatcttagctactaaccttaaaacgtcaattttactgggacggaggaagtactactagtagcacagtatcttgtgctagtgccactgcttcagaaaaaaaatgctggatattgcgctgctgttgatcacctacacatggcttgtgtacatcaacgggagagtcagagtgatgaccaaccagtttgctaccactagttcttagcaaatcttcggtgatcggtgcacggtaatagcattgattaggctatgatagtggcctatttgattatggtactaacttcttcgatcttctgattccaattcagacttctgaaagtctaaacagttggtccatggggtaggttaggttaggctccccatcagctaaattatcaggaaaaaaccctgtactagtggtacaacttattagaatttagaagtcaacaatatggatgcatctgcttaatttgctttgtccctgtcaattgctgcgtaatttcgattgcctcatagcactaattttttgaatggaacacgcagcattatttttttgaatggaacacgtagcactaattaatcttagtgtctgtctcgaggacaacgatgagtactccctccataattgtttaggacaatatttaaattaaacattaggaatataaatcataaataactatcaaattattaagtttaaaaatataaaaaatatatgaataaatttgtcttgaaaaatactttcataaaagtatacatatatcactttttaataaatatttttatagaaacatgaaatcaaagttgtgttttggagaccgtgtcgctgtccaaaacgactttctttacgaggacgaatggagtatttatccagtgcagcggggcctgagttcttcgtcccagcctcccagggaggtagcagcccagtcatttccttggttttttttggaaaattccaagagtctctatccgacgaagtagcattgcaatggcaatgtactcgctctgttttttaacatatgatgacttacttttatcattgaaaacaatttgagcatgatttatattctacatattttaaagttttgaatagcgtgagcaattgaacgtatgtctacaagttaacaaggtcgtgtatttgagagagcgttacatgagccatacgtaaacatatgattatggtatttaattattcgtattattaaaaaataatcattatttatttttgttttattacgacttactttactttagacatgacgtatacttttatatacttaagaaaattgaatgagataaatgatataacgtatgtctaaaagataatgatgtcatatgttaaaacaaacggaaggagaattatgcgagtcataaaaggtctcaattacatatgatgaggacaaattcaggggtagcgtcattgcccgtgaccatcagtgcagccgttggcaaaaagaactgcaaccagcaatccagcatgcagattgcagagtggttgcttcttggctatgattacgtggccgatttttcaaacgtgagattagcgtgtactaagtggagttgcccatggagataacgatgggttagtagtctccgtcttcgtcctcttccttcttgtttaataatccctgcattaactgatcaacacaaccgagatgtttgacaaagagagaagaatacaagggaatgcagtgaaccaagagttttacccattcctcctgtatccagtttagtcgttgcagaaaaatctcccccttttttttttctttatctgaagatttgctcctggttcttcaactactaccaagaatcgagctcctgttgcttcctctagcctctgtctagtctgaagcctgaacccttgcatgctccagtttctgcactgtgtgagcagaattatttctgaagtctgaacagcagccaagcaaaaggtatgcgctttcaattgctttcgaggtgatgaagtatcttcagttccctatctgtttctgaaactgaggttgttctttgcctgatcttggcagaaggcatctgacagtaagatatgaacacctgtgtttcaggtgaatttggctgatgattctgcccctgtgttctgatttattcaagacactagcaactgaatcatcaggtgttggtcgcgaatatcccagtgatggattcatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaataaaggatcaagcaaaggattcaagaagtggctgtatatagttgtgattccagtggctggtttgattatgcttgctggcatggcatggatgttcttgccatgccgcaagaaatccgttgcgactattggcccttggaggactggactcagtggccagctgcagaaggcatttgtgtcaggtaatactgcaatatttgccattttgatttgtaatattttcttatattgttctgttacatcctattcttataacggtaagttcttgactgtgttcaagtctggttttcagatcaaatattcatgttgtgtttctggttttcactgtgttctgatctgaatgtgcttcaggagtgccccaattacagcgtccagaactggagcgtgcttgtgaggacttcagtaatattgtggcaagtcatccatactacactgtctacaagggaaccttatcatccggtgttgagatcgccgttgtatcgacaacgattaaatccagcaaagattggtcaaagcactgtgaagattgtttcaggaaaaaggtagtcataatatgtgtactagatcctcaactaatccttttgcagaattgcattagcatgaaaaaatttaccttttttttcccttgtgaacaagcagatagagtcgctctcacgaataaatcataagaatttcatcaatctgctggggttttgtgaggaggaagaacctttcacgagggtgatggtgttcgaatacgcaccaaatgggacgctttatgagaatctccatggtaaatactatgtgaaagttattctcattgttgcaatgaggaataccaattttttttcttcacattcaagtgataacatgctggtaaattatttgtgcagatgaggcctttgatcacatcgactggagaagtagaatgagaataatcatgggaatagcttactgtattcagcacatgcatgagctcaaccctgccaacgtgcaccctgatctgcattcaagtgcagtatttctttctgaagattgtgctgcaaaggtacatatggtctaactaaatccttgttatgccttatggtttatcaagaattaggcatcttagccatattcagttgctatggtttcagtagttcttttaatgtccttctgatgtgaaggaggtttagagaaaaacgcagtttcagtacccaactttattcagtactcagtaaagtacagtttgatgctaaaatctgtatcctttcttcagattgcagacttgagtgtttggcaggaagtggtttccgacggcaaaaagtcgacagcgaataatgatcatcatgaaccaatatctgctagactggcagggaacgtttacagttttggcatactgcttcttgaaatcatctcagggaaacccccttactctgaaaacgagggctccctggcgaatctggtaatcacagcagcctgcaaagtcaaatgcttcaacagtttaacttacacaaaagaaatccaattcaacatcagattaaagaaaataaaactgttttttatttttcttatcttacaggctttggggtgcattatcaaaggtcggagtatagcctccatgcttgattcagtactagagtcacacaaagaaaatgagctagatgtgatctgtcagataatcatggaatgcatccagagtgacccaacgaagagaccaggcatgagggggatc

SEQ ID NO: 58105 - DNA, 7374 bp, Oryza sativa
ttacaggcccagtttttttctccaatactgttggttttactgggccgaaaaagccataaaatcttagtgagtggtgtgctgggacgtggctgggcaggactagccctctgttaagagaaaaaatgtaataaaatgcaagcaactatgatcgttttttgctgtgcaaagctgatgattcacccatgatcgattgctcgatccgtttaagatgctactccctccgtttcatattataaatcttaatttttttcttagttaatttttttaaggtttaataaaattaatagaaaaaaatagcaacgtcaaattagtttcattaaatcaaacattaaatatattttaatattttgtttcgttttgtaataaaaatattattatatttttctacaaactcagttaaactcaaagaagtttgacgaataaaaaggttatgaatgtcaggagtaatataaaacggatagagtagtaaaaatattctacagttccatcgacaatttacatcgagatttctgtctcaactcccatttttcaccttgggacagagggcacagacgcacaggatccctcctgttccctgaaacaatcagaaagaaatcaccataagcagtacactgctgttcatcacatcgcacagcaattactgggcgggagtacactggagtacgtacgtgctgaattaatcacgcgaggattaaatataggaatacgtacatttgtacgtataaatttcatcccagctacagcctgacgcagctataaatatctcgtgctccatgtttggaacgtccctgaatttccaagccaggcaggcaaaaaaaacggaaggaaaagaaacagagaagaagaagaaatggtgtagcttagcctcgcctcggccgtggtgtgatgctgacgcgtcgtcggtgatggcgcggccgctgctgaagatcgggcacggcctcgacaggttcaggtggcggaggtcgacgtcgtcgtcgtcgtcgtcgccgctggcgctgtcgctgtcgtcgtcgtcggcggcggcgttgtccgacgacgacccggggagccccatggacccggagatgccgcccgcggcgaggcgggcgctgtcgaggagctcggggtcgagggggaggctgtcgttcgagctgccaccgctggccggtggcccgtcggataaggaggaggcgccgccgaggacgtcgtcggctccggcgccggcgaggcccgcacccgccgcgctgcatgagggcccaccttcaggtgactaatatatatctcttctgggatgatcaatgccggccaaaattgttgccatctctcgttcaagaaatgatgggtttcgtccggaaattgcagacgcggagatggtgagggagaagttctcgaagcttctactcggggaggacatgtccggcaccgggaaaggggtgtcctctgctctcgctctctccaacgccatcaccaatcttgcaggtagtgtgtaattcacttctgtttttttctgaagaaaagaagaatctctggttcgatgatgatgttgttgcatgcttcgtttcttgctaaattccagcttccgtcttcggcgagcagcgccgcctccagccgatggccgccgatcagaaggcgcggtggaggagggagatcgactggctcttgtcagtctccgatcacatcgtcgaatttgtcccgtcaaaacaagtctccgaggatggatccaccatggaggtaaaaaaaaagaaaaaagaaaaaacttaacgtgcaaaaagattgcacgttaatatattagaaggaaaaatagtttttgttacacaacgcaatctgccagacatgcttataccgggggaaggggaaatcgctactccaattagcaggatggtggaggcagagccgcacaataaaaaaagaaaaaaaaatgacccccttttatttccattcggtagacacactgtacaacgtatcagtgaacttcattatggaattgaatgagttagtggtgcattctaattctcaatacttctatttccgaattgtttgactcattcttgtcaagcagatcatgataacccagcagcgtcgggatttacagatgaacatccccgcattgcgcaagcttgatgcgatgctccttggaagcttgctgtgctgatctttgaaccaccagaaatcaacatctatatatctgaaattctgaatcaaacaatcgtccttctgttgcacatttcccttgtggagcaggaatatctcgataatttcaaagacaagcaggagttttggtacgtgtcgaaagacgcgagtgaatcagagaagggaaacacgccgaggcaggatgacagatggtggctcccaaactgtagagtcccttctggtggtctgtcagatgcatcaacaaagtgggttcaacatcagaaggatctggtcaatcaagtccttaaggcagcaatggccatcaacgctaatgttcttatggaaatggatgttcctgaagcatatatagagtctttacccaaggtgatcaataatactacattgcacaaagaatctattttgacaatttgcaacatttttttttctagttactgactgtgttacttttttttttttttgcctgatagaatggcaagtccacccttggagattcaatgtacaagattataaccgaagatcatttcaatcctgaagaactcttaggaactgtggacatgtcagctgagtacaacatcatagatcttaagaaccgaattgaagcctctgtggtcatttggcagaggaaaatggtgcacaaggaaggtaaattgtcatgggggcatggtgtcaaatttgagaagcgggagaaatttgaagcaagagcagagaatgtcctcctcctcatcaagcacagatttcccggcattgctcagtcagctcttgatataagcaaaattcagtacaacagggtataccatgagaatcatctgcttttcatgttgtcttttcggatttgctacagtacgtatgtttactcattgcaaaaattctctgctatttttccccctcaggatattggcttggccattttggagagctactccaggactcttgaaagtttagctttcacggttatgtctcgaatcgaagatgttcttcatgctgactccctcgcgcaagcttctaatactagaacccaagaatcaatgagaatggccagcttatcaagatatgacactgataaggttgtcattgatgctaaggccgaggtagagagactgggaagaatggaaccagtttcagcgacactatttgactttgtcagtcctcgagatcaagatgttgtggcgacgaagatggactcaaaagaaaagggatgtaggggggatgctcatagtcgaaagttgacaaaggtctcaccgattgcaactaagaggtattcttacctagaaaaacttgagaatttgagtggaacaagaagcccaatatctagacactagtttatgtgtagggggaaagacatatggatgatgctcgctgcagcagctcattcagaaaaatacatgtatgtaaatagcttagatgttcatagcatcatgagatgcagaattgagcatgtaccagtgtgaggtttggcaaattttagccatcttcacctccattcccaatggaagcttggtgcacaaagctatgataattagttgatcttgacctcctgtacattgtatgaatcaatcagaatttacaccgaccctcaaaatgcctttttagtgttaattggaaggtataatacctaaactaaagaggtatacacatcctcaaaatacacgtaactgtaacagtgtctcgtatgatctcaaatcttgtaggtgggctatgcaggggttgtagttgatatagacaatgtagtatcactcaatctggataatcatatgctctagactagatagaactagaggtaatcatgcacgccattttcagtttttcgtagatttaatgaaactactagtggtgaatactgaggagacatatttactagtgacataaacgcaaaacagaagtactgaagtagtaagtagtagtatcaaactactaaggccgggtaatcatgcacgccattttcagttttttcacactaccacatgaatgtcgagatgcaaaatcgaggggagacagaaaattaaaaccgaacacatgggatcgcagtacgtcgcatgcagcatcgaattggatcctttacaacttatatagccataggaatagtacaattatatcaacatcataaacagggggaattaatccatggcgatccggccatgggggactagcagtacagtacagaggatttgcatggatggatcggatcaagaagaaggtgaggcagagacgaggaatttaatttagatcttgccgcgtgggccgggcgtcggcggcagctgcgggcccttcttgatcggaagcaggtctggcgacgccgacgcgctgacgtaggccaccagcgatccgccgccgagcagcaggaacttgagcaggagccccctcttggtgaagggccccgcgaacgtctcgaagaacttgctctgcatcgatcacccacacgaattattcagtaaattaatcatcgagctaagtatatattttagtcaggtaatactaacctggagagggttgtacggcgacggcgcgtcggagccgtacaggtcccactgcccggtggtgttgccgatgtcctcgaggtcgaagtagacgctcttctcgccgtacttggccaccacggcggcgcgcggcctgtagcaaagaaattatgagcgtgataagaattgaacacgggatctcgggattgaaaccacatacacctcttgccactgcaatatcaagtgcatctccactgttactcgcgtactcctcgtatgtacctgcgggtggtgcggcagagcgcccggggcgacggcctgacggcgagcttcctgccggagatggagctgccggcgaggcccttcacggcgacaggctggacggcgacgagggacgccattgctgcggtgaattcgcgggaggacgcaaagctgagtagatagatggatagatagccggtgtactatctgcggcggcggctacacgtacgtgcacacagacttaattcggcggatgctgttaaggatttggaacgcgtagtccgcgtggctcccgcgatggccgacgccccatagggagctcgccgcgtggcctcttccggatagccttatcttggttctcctggatttggagctcgctgacatggcgcgcctacgtggcacagcatgcctatactgaatagatcgcacaaaacacacacattgagtcgcatcgaatgcagatgaatcttgtcttcttcttttttacacaaaaaaagagcgtgagagttctttttgaaaactcggcaaaacacccatatatctgcacactcatctttgtaaaacacatacgtgtgcaccttatctctacgagcatttcagaatgactaggccggtttatgtcgagacaaagctaccacggacaccttgcatcgcctgcactaccattaaaaaaataattagtcataaatacgagcatccatattaaatataacttaaatttatctatccaattaagttaggcgcacttcgaaaagcgtagaaattttttttaatgatggttggcaagtttcactacaagaacctaaccggttaggtcgcacacacttcaaaaagtgtagaaattttgtgtggagatgcatgaaaaattatatcatggtgtaatttgggttgagcatctatcaccgaccatcactagtgatgccaatgatctgatcaatgcttggggatgtactcaccgtcatcaatccaacagtactcccctgtatcgtagagagacaacatacggcgatccagatctcgtagaatttttttattatcgtcctggacgctgtcccctacggcgtcagtatatttcagcgtactgtaccatacgtcgcatcaaagatcgtccctgtcttctcaaccgaaaatatcagcagcccaaatactgctattcgggcctggcccaagaacacccctacctcgcagcctctcatcaaaatgggcctaatgccagaagcccaaggcccaaacccacttccactacatgggccgtcgccgcacttgcgcgacggggaggcgcacccgcaccatccacggcgactttaggccgagatccacccactgctgcgcccgcgcgggccggcggctcagatcacaccgggggcgaactgctgcgatcaccgacgcgggggaaccaccgccacaccaccaccccggggcgaagccactaagcctctctctttctctctctctctggccgccgccacgaccgaacgcgacgcgacggggcccagcccacgcccaactccccctacatctcccccccgccgcggcggcgggggcgcggtgaagcttcctccccgctccgctccgccgcgctgctttgctctgcctctgcagccgccgccgccgttcccggcccttcgatcggggcggggggccagatccccccgcgcgtcggccgagtgggagtggggcgcgcgggacggaggtgcggatctgattggtctacgcgcgagatctagccgggtgctgctgttcctgctggtggttgcggggatcggagcggaggcgggggaggaggagggatggcgtggtggtcggggaaggtgtcgctcggtggcctgcaggatatcgcaggggccgtgaataagatcagcgagagcgtgaagaacatcgagaagaacttcgacagcgcgctcgggctcgaggagaagcgcgacgatgaggaaggtatggtagcgtcgctggtacactggaattgtcactctcgcccccttctcctccgtgtaattcggctgcattggggcactcgtgcttgtttgcaagtgtttgatcgaaactatgatgagatgaatcagtgtcggcaataacttttttcccatttatttcgttctacatctcgctatctgtagagattgggtaatttgatcgtaggaggatggatcctgcttatcacttgttccattacatccgatgtaccccgtaggttcttaagtcatactctatatactggccaactggagcctaagtactgccagtacccggcagctgaatcatgtgtgtttgattggtttagtgacatatttcatacttcttttccaactggttctatttgtaacagtcgttggtctatgagtagagcggtcatatttggggtagttaagcttattgtttctttgtttacatggttaaccgaattgtgtgtctttttgttgtaggatcaggatcacatgcatctaactctgatagaatagggttctttaatcctgtcatggcattcatgggaaataatggcgaggaggactctgctgaagcatcagaaaag

SEQ ID NO: 58106 - DNA, 7118 bp, Oryza sativa
ccatccatttttttttcgcatcgcgctaatctactaagccccatacagcagatctgaagcttggcgtgtttctttcgaaattcaagccgtgacaaataccgaaagttcatagccataccagtgtgaaaatattcgtttttgtacatcttgaagcacaagtctttttggacagttgagcacccttgtttaatttagtaggttactctgttgtatactagtttggatagctttacggtttttaagcctattgtttgcaattctttccagtgaagtgtatcaaatttgtaattcgattaaaagtgtatcacagcggaatgcaaccccaataatatgagagctcgtttttgtcattttcctcaggttcgaccattttccgtgtacctatcatatattcatatgtctttgtgtgcgaagtataaaccgcatcataatgatgaaaaaaaatcaaaaccaaatctgttctattcatatgtctttgtgtgcgaagtatcataaaggaatcatgcaacattcaaatattcaaatcattcccagatccttcaattttattgaattcgaaggaggcatgctacatcatacaccacctcctgctttaaactacatcatcatgctacaacagtgaaacgctcggctccccgccgaagcatattcatcgcgccgcgaccgcgagcccagccaccgtcgtcgcgcgcccaggcgacgcgcgacgcgagcgcggcgaccttggggcggaccaccagcgccgcgcgcacggcggccctgaccacggcgtagacggcgagcgcgcgcgccagcctcaggttggccgcggcgacgtcggcggcgcggcacgcggcgtgccccgcgacgagcctgcgcgcgtcggacgcggcgagcgcgaccgtggcgagcagcgcgcccgccgcgaacgcgagcagcacgagcgccgtggcggcgaggagcgcgccggagaagaggcagccgtagaggagcgcgacgaggaggaggtccagctgctgcaccgccgcctgcatggggaacaagctggtgatgatcgccggcgccggcgccagcgaccagagctcgccgcgcgcaccgaggtagaggaggccggggcacatggttattataaggagaggaatcatgtcatgcgtcgcggccacggcgcgacgcgattccctcttgggtttttcttttctttttttgtttttttttggagaggttttcttccagccctctcgttgcctgtactgaacgcttggtatgcttgagcaaggtggctatataggtgccagtacgaggcaaaagggtaacggaaaagggtggtgctagaacagttcatggaaaatgcatgccatgcattctggtttaaacatggaagatgagtagtttttgatagggatgacaactgggtgcatacaggattgagaggaagtctatctcttctatattgtagccatctttataagcgtgatattattattgtcttttaagtagagtctacatggcgttttgtgatgctactgaaataaaaagtagctagcgttaccataagtgacggtacgaaagagaggcgtgacaaccgagaagtggcgagtgcggttaagttggcaagcggccacctacttttgttttttgtcatcatattgaaaagggttaatattatagctgttggcttgttgtagccatggaacaatgtgaaaagaatgacaagtggacggcgaaatggtagtggatgcatagttagacttacgacaaacctacaacctattttctatatacggatgaaagaagtgtcatttttatacctgatacacctattattcccgctaaatttcataaaaatgagccaaacttaaattccttatttgtgagttctttatattattcctttttatatcgcataaattgtgaagacacggtatctatgaatgaggtttgacaaatgctatcaatgtttacaaactactccatgtccttcctaaaattgtgcttcacggtttatgctaaaatagttttgctcctaccagaagagcttgtggagcttgtgacgattgacttgggccatgatcaccggccacgcagagcacatatgcaccaccttgatcacaaccctcgaggcctctccatgactccatccatccacttatccacagtggcttagcataggagtgtaagtggctaacctgcgaactcacttgtagattagaataagcgggttcaattatttattttggtctataaataagcttcacgggttagccgcttatgcacccttaggccttagctcagcagctcagctcacgtgttcctctctccctctcatgctcaatcccaaacccaaaccaaacttgcttagcttgctgcctagagtagcatgatgcacgcagccaattatagttcagtgaaatcacatgaaatgcatgattccatgtgtattttctctgtctcctccgtgcaaccatgaactttgcatcgctgtgatctatcatcatccatgggccatggttgattgcgcgcgtcagtgtatcctatcctttgctcgccgttccctcccccttcaacccactttcataactgagctcttactcggtctgtctcgctaaaatagccaacgttgacctatagataggaggcccaattgtgccatctcgccgaaaaagctactgatgggctcttactacattttttggtgggctgaaatattgcccaactttgtgtggaggtatggaggaagaggttgtgtttggcaacgatttatgctacaagaaattggaaaaaaaatcacttaggtccctcatctcgtcgtcaagtttcaaaatcgtcatgaaccagaatactagatataacgcatctctaatcttgcaaaatatggatacgttatatcatgatgcacacagcaaaaaaaaaaaaaaaagacagacattgacaaacacaatcacatatatgatatatgagcctactccaaaataataccttctagataagtgatgacctttgggtgaaaaaattaaatggggaaaggttgttattagttgtgatgaaaagatatgtgaagaaatagttatattttgaggtaaatttaaattctagagatagctatatatcgaggcagaaccgcagaagagagtatgtttggtttgctctcagaatgtgacaataacacacgcaagttgtcacaaatttgacactgtgaaaacttgaaccaaataaaccatgtaatcgagtctccatccaaacaaggtgctaaatggctgtgtcagggaaaaacgaaaaaaaaggcgtcgacagcaggattcgaacctgcgcaggcaaagcccaacagatttcgagtctgtctccttaaccactcggacatatcgaccatcgcgtttgttatgtatgtgccttttatattactcgaaattaatggaaatcatgctttgttaaacagttctttccaaaacaacgagagcggctcagatacagtttcagtgccatccaacgaattaatatttgacttaggaaccatcattcagaccattactggcagaggacaaattcaatttattacaggctcgtgcagaaacagcacagtagcagctctgcgagaatggccgatcgagattgcagtattgttgcaatatttgaagcatatacgtgaagttgttcacaatttaggtacttgcagaaattccaggtacagcttatcttggcccagcgaagacttcttgtgcaacagaaaaacaaacgactgttttattatttgttttacttcttgcagagatctcatggcgaagaaactccaaaaggaattcggcgacaatgtacagcaactcccagtcacaacctaaattatttgattcaaatcttttcatgtatcaatagtgttgtctttgctcttaacagttacaatggctgcatgattttacatctgtaaggtaacacacagtaaaacaaaggaagctaaaaaatctataggggaacatctagctggtggatatctgggggaaaaaatgaacagaatacaaaaaggaagtacacatttacctcaaaaaaaaaaaagaaagtggagaagaaaaaaaaaaggaaaaaaaatttggtcaggcatcttgcttggcacagctactgataatctgatatgacaattgctgaggatcaaaccacggcaacttcgtgtaatccagtgtgcggtttgttcaggaaggcatcactgagcagcctcatggccacctgtcaacagcagaaagttgatcaactcatttttacaatctgacaactcagaacctccatgccgataaaaacgaaaaaaaaaatcgaacttctggcttggcaagagaagtgacctgtacgaggtacgagcatacacagtgggtggcatggcatcaaaatattatgttacaggaataacggcatcaaggttcttatgcaatgaccagccaggggggacattgagtagaggaggttccaagttaaaattccaaaccataaccctgttgcaatcttctgggagaccctctatctggcgctcatgtttaacaagcttctcaataaatcttgactcctgcaatgaaacgtttgtcagttcaggccatatacagtgaattatcgttttttagttatctgctgtatggtctcatgctcattcagaatgatagtcatgatatgttcctgcttcttcatgagtagcgtctatagttgctttaggagatcatatgtctgcatcttatgcaattttattcattacataggccaagttttttttctcaactccaagctacaacttcctcgttttccgttagcacgcttttcaaactgttaaatggtatgttagcaaaaagtttctacatagaagttgtgttaaaaaatcaaataaattcatttttcaattttataatagttaatacttaattaatcatgtgctaatgagttttctcgtttcgcgtgcactgaaaatatctctccaactaaacagaacgaacggggacaaagtaatgaactttcatgaatgttacttagcaataggattttacacacaaaaaatagttccattagctatgctactatgattgatttatgcagtttattttgagaacaaaccagctaactcacctgcaaaccacctcttccacctgagtggacaataacagaatccataggtgggcggttccacctctcaggatcccatagcattgtgctgttgaaagcaaacccagagaaaccaactggaaatcgacgaactgcactcttcttctggatgttctggattgtattccatccagtgactcgattacctttacatataggaccttctaaaaccaccctgtacttgatcccagtatgaattgctacaggccatgcaccaaaccgcctgcaaaaaaggtagagagacatgagagagagagagagagagagagagagagcgtggaggtattatggccaaaaataagcatgctagtcttattgcattctgctttaatatgactacgggggttcctttgatctgaaatttctgcaggacagtttaaggcaacagcccattaatgttgtttcacctggtaccagaagtttttctcatagtaagtttcatcattgaaagattgcttatgatcagctcagacagagcatgacccttttgcgtaactcttcaagttttactagcctgattaatactctgatcattaggctaaactgaaagtaaagtatcgaaatactctttaattttttttttgccagtaaaagactacatttcatgaatattggacaaatcaacaatggagtaggaatgtgggggttaggtttgccattaaaaaatggtgctggttaaaaattaatcagtttcccaggactagcattctgagactagtccaaagtaactataatcaaatggagtaggaaagcaggagttaggttttattctcagtgggattgtcaaccttaatcatttctatttattttaccgaagttgctgcttcacatgtcagattactacattactgggctgcagtacacactgggaagttttttgctctactagtattcattggtatgacaaaggttcaactactaaggtggagaaactctttttatttgagttaggttgctagtcaagatacatcaagttattaaatcattcctcctactatagtggagaatataaaccatgctttggtatgaacgttacgtcatgcaactctaggagcaaaaagaattcaataattttcagttattgtactgaaatagttagtgataatttctgggaaatgccagccatgggtgcaagactttgaaactcactatgttggctggctattgtcaaaatcctacctcccatacaattcaagaggatgcattttcataaattgcgattaaggataatactcgatcagaactatttctcaactggataattcaattcatgacatagaatgcttgagacagaagcatttagcagtccactactagttcactgatttcataagcaaagaatgtggcagtcaacctagcactgggcagtggcttgtatcataagcaaggaacattgaacatttcactcacccaatatactatagaatagcaagattagaggaacaattttctaaaattggacacccacaaaagagaaagggaagaaactaaaatataataatttctgaaaaggtagagcggccataaccttatttatacaatatttttttaagagaacttaatagtcattcaacgtcaaatatgtaactacagcaaatgaagtttccaaagagaactgtcacctgattttccgcatttcttcaaatacatcactcatgtatgaccgctcttcatcagcaaaatgcattataccatcaagacgatgctttttaatatgatagattgcagtattcctctgacatacagcaattttccgtacactggtagtattcttcctgcagatgagatgcctgtacataaccccagaagacctaaggatttctgctgtttgaaaggactgatcaggccattctaccactaaccacagaagaggagactgtacagttttcaagacatgagccaaacggttcaggtaatacggctgttgtggccgaacagtagtgatcgtaccaatatccagaagctttctcacagtgatgtccaatcattgaatcaggtattgcaggggtgat

SEQ ID NO: 58107 - DNA, 728 bp, Oryza sativa
tcagtgcaagctattaggaatggaaaacactggcttatctagacgcctagaatatttttttagataaaggagatttcttgggaattatcctggtcacaagacaacttcctaagttctcgtcagatacttgcagcataaacatactagcaaaaggctaaacgaccagcatgacacttggtacaactactccaagtatctcgcaatgtgacttggcagctcagcgctgttcccttccatagtcaggagcttgtagaaaagatccctgcgcaaggcagcaaccctaccctgcgacagacaaatgatggggaatcacggttattattcaggttaatcgaattggtggaaagaaaaagaggaaatgtatcaatgcaatgtgctcaccgaatctagaacattgctcagcttgccatcatagaactcgcgcgcatagtataatgtgtgaaaaacagagttccatctgcagcaggaagatgactcaaatttgttatgggatgaaatttcattttcttttctttcttgtgtatgtgtggcattggcagaagctacccacttttggcacctcgggctaatctttgtgtggtacgtacatgtccatccatccgggttaatatcccagtcatcgaagaatttgtttatacatgttagcaagcctgtgtggatcatcgtaactgtctgacggtgcttagcactcacatcggagaccctcccgtggttgcagacagggtcca

SEQ ID NO: 58108 - DNA, 5739 bp, Oryza sativa
cagtgctggaggtcgcggtgagcgaaaatcggtgttgccctgccgccgcgccctcttccctcgctcctcgcaatcaggcattgagcgatgggattagttcaaagacacaggacccacgattggtaagttagtttggatggccaagtttggccagcgaaagaaggaatttggcaactcatttgatttagccatccaagtatagaggctgatggagtgatactttttactaaagttaccaaattttggtttggagaggttattatagaggccgctggaggcctggagatgctctaacctctgctgctgcgggtgcattgcagcttctggccctgccgaccacccgtgtccgtgtgtatttcttctactagcttcagatcatgcggtccccgcatccttcgcaagccagggcctggatgagatcacaagagtgcatgttaggatccccgcaccacttgagccgcttgacgcactgccactgcaccaacggaaccctcttcccccggcggaatccttcagcggtcgcccactcgccccaccttctactttcgaaaatctcatcaggatttgccagaacccgtgccgtgaacagcaggaggttagaaacctgatgccgcatcgacccttgtcaccgcgctcatgccgattttacacggcacaagtgatggaacattcatatttgttggtgacttgtatcaccataaacaccgcaaacactgcgacacaaagatcaaaaaaacaaaaaaaggaacactgaggtggtgtttgaattcagggacttaattttagtctctgtatttaaacactaatttagagtattaaatatagactacttgtaaaattaattacataaatgaaagctaatttgcgagataaattttttaagcctaattaatccataattagaaaatgtttactgtaacatcacataggttaatcatagattaattagactcaatagattcgtcttgcgaattagtccaagattatgattgggttttattaatagtctacgtttaatatttataattagtgtccaaacatccgatgtgatagggacttaaaggtctagttccatctaaacagggtctcatcgacactttgtctattgatcccacaaaagtagacagacagcaaagcattctgctgttggataacacaattatcatagtacaacaaaccaacactacaaacacagcagcgatctacacatgtcctctctctcatctcaaaatacagaaactagtacaggatttgacattacctaagtactccagtacaataacttaaaatgccccatgcccatatcaactctgaaccttggagcaaacttctgccgatattaccttcagcttcttttgtagagtacttacctatgcaaatacgcaccaggatttacccctgaatctatttatttctgaaggctcattttgattaattaatctccaaatagactactagtgagtagtaggtctgcacaaatgttgctctgatgcctgcttacttccgttcctgtcccctttcttcacttgtgagggacgagtcaatgctgcaaatgaaaagaagaaaaaaagagaagcatatggttatactgtcaaatttaactactgaattaaagagttactcagaaaactcattcattcagtgatgcacttcccaaagagtcctaacatgccggaagccatacaaaaggcttttgctacatgctactagtaaacaacttgctgctatacctttattcagtgcaagctattatcaatagaaaacactggcttatctagacgcctagaatatttttttagataaaggagatttcttgggaattatcctggtcacaagacaacttcctaagttctcgtcagatacttgcagcataaacatactagcaaaaggctaaacgacccagcatgacacttggtacaactactccaagtatctcgcaatgtgacttggcagctcagcgctgttcccttccatagtcaggagcttgtagaaaagatccctgcgcaaggcagcaaccctaccctgcgacagacaaatgatggggaatcacggttattattcaggttaatcgaattggtggaaagaaaaagaggaaatgtatcaatgcaatgtgctcaccgaatctagaacattgctcagcttgccatcatagaactcgcgcgcatagtataatgtgtgaaaaacagagttccatctgcagcaggaagatgactcaaatttgttatgggatgaaatttcattttcttttctttcttgtgtatgtgtggcattggcagaagctacccacttttggcacctcgggctaatctttgtgtggtacgtacatgtccatccatccgggttaatatcccagtcatcgaagaatttgtttatacatgttagcaagcctgtgtggatcatcgtaactgtctgacggtgcttagcactcacatcggagacctcccggtgttgcaagacagggtccaaaatgtgcatttgcctcttctcccatgtcccaaatgtagcatgcccatgtatcactagctaattgaaccggggaaatgagctgtattttcgaaataaaatggttcactagtcagtatatgtgatgatcaaaggagattggataaagaaacacaatatataatccgtaccagttggcagttctgtattttgtagccgctaatatgttgatcaaacatgtcactgactgctttcatggaactgaagtttcgttcaaacatcaaagctttctaaaaccaaaatcaaggggaaaagacaccaagctttggtcattgttttaaccatgatttcttatatacatgtacatgtatacatatgtatatacatgtacatgtacatatgtatatacgtatatatatatatatatatacgtatatatatatatatatatatatataggacattcatatggggcaccatggtgcccgggcaccatggtatctaatgcacaaaattactcaaatttttcaaaattttcaaattgtgagtatatacctagttataataatttgattcatacctatacttatcaacaaaaaaaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaataatggtgcccgggcaccatggagcaccaaacaaatttactatatatatatatatatatatatatatatatatatatatatatgtgtgtgtgtgtgtgtgtgtgtgtgtgtgtgtgtgtgtgtgtgtgtaccgcgaattggggtaggaagaagtgacgccaccgctgcccacatgggtttgtattcatcttggcatctaactgttggtagagtctgatcaatgctgaacaaaggtccgcatgtagaataccaccgcggatgacctgcattttgatttccttggcacttatctcaattgatgtaggcttgtcgtgcttgaaccaaacccttcatataggataaacaattaaaaatcagtacaaagtttttgtgtaatgagaattcacgcatttttaaagaactccttttgcacacacccggttatatcgtcatcacatgactcctcaagccaacggaataatctcccagctaatatagagtttggccaccattcatgaactgtgcgcattgaaaacgatgacatgcaagatggccttagatgattccccgcctctttcgtcatctgcgtctcgcaacgttctgattgcccttggtacttatcctgtgcaccattgttgttttgatccaatgtggcgccgtctcctgcaacagcagcaacacaaacacgatagatgcatttcattctttaaaatctctcatttaatttgttgtgtgttgggtgggttcaaggatatatacgaggtgtatacgtactcatgttagcttctcccacagcagctgctgataccaaccaatcgaggaaacatttgtcttgcgtttggaaaactgtgttttggacttgtgggggaaaaacaatagtcacattactgcacattactcagaagtgtttttaccttttttttttcttggcaagctaaccttgatccaacccacgatggtttgtatgaactgctgacgtcgcttgggctggtgattttaatagatggtgatgtgcgatacgggccgtgcgtgacaccgacaacggatttgcacggtcagcagctggattttgctgccctcttgctgcatttgccaatttgtttggccctaacaagtcacctttgcctgtgatggattgaaatgtttgtgtcatgagtacacatatatactcgatcgaaaaatgcaacatcatgtcaaacgcaatacctctcaaatcaatgggggtttgggatctatttgctgcagaagcctcatgtgacaacttgcttcgtttacgagtagtcttggcaccttctttgacatgcatacggtgcacagaaactaattgtaagtgtttttcttttcactttgaaaatgtagaaacctttactagtatgagcttaccaccatgtgatgcagttcttcgcatcgttgctgctagcatatcgtcagtatccacaccttcgattgcgccatgtaatcgagcgttggatcgatcgggatttgcttggacagcttgatccattacagccgagtaacatttctcaccgtgttccgctgccaaagcctgcatgccttccgttaaagatgaaaaaacgaggccgcatttctcgttgtgcttcgctaacaatgccagaatgccttcctgcgttgcctgaaatgaatctttgatctctgccatggcctcatccaacatctgcgtgcatcgttcgccaaaatgacgcgatagatcggacagctgcaacgagaatagaaaaaaaacacaaatattaaggaaaaatctaatatcaaataaatagaagaggtgaggctttaaacccaggctagctagctagcccaccaccttggaggtagcgagaagaccctgggcgtttctcaacaaaaggacgggattaattagtttcagaatcgatttaattagcaaggtgtaatatgcaactagttttgttgggatgaagggattagcggctaaccttggcaggcaggtcgttgccatggctatcgctattgctcgggtcagtgtcgtcgtcgtccgaaacgtctatgggctcctcgtaagcatcacaccgagctttacctttgcccttcattgatgaagaaacaactgactcaacaacattttttcgcttcaaaatggagtactacgcagtaatacgcttagctttgatctctaccgtcttagtaaagcacaatcgtattttttcccttcccactgaaaaaccgctgaaaaaaatccattgtatataaaaaaaagagaccaaacctaaagagattctgaaaaagagagaaaagaaagaatcacgttcagcagatcccgtcccgttgcaatgcttgagcccgaggcagcctgtgactactccctccgtccctcccaaactaataagcgtgtgtttggtttggggacaaagtgggatgggttagacctatcccagttttttaggatgggatagttccagttgtctgtttggtttgtggtatgggatggttatagttttttgtttggtagaagggattgaggtgggatggg

SEQ ID NO: 58109 - DNA, 16431 bp, Oryza sativa
tcccaggtgggacgagttcgtccggctctttttcccggatcgattggtcccggatgaggaatattactctccagggaccaatccatcctacccacccctcaaccaaacacctctaaaaggttcgtcccatcccatcccagcaaccaaacactacctaagttcatttttaaccaatctcacacataccaatacaaaaccaaccaacaactagaatacatatactttattaaatcttaatgcaacgataactctaaaaataaacttattttaagataaatataaaagctaaaaacaaatttattatgaaacggaggaaataattcctactactagtaacagtgaaacaccatcatctcgctgcaataaacccaccattttggccccaaccccttctagtgaacgatgccgtaatggcgtaatgggccatattttgcttacagatactcttttcgtcccataatataaaggatttttaagggacatgacacatactagtactacaactctagactgatttgtcacattactcgaaaatcccttatactatatgattgaggaaatatttcgtctaggctgaagaaaaaaaaaagaacagtagaaaaaaaaatgcacgaagcgggcggagcgatgagaggggggattgtcacctaccttggctggcatcctgcacctcgtcggcgccggcgggccgcgtttgccgctacttgggaacgttggacggcgaggaaacggcggggaagacgacggcgatccttcctcatcagtgggagtgggactggaaggatggaagggggaaccagcactggacctggagaagatcatggccatgggtgctactactagtccaagagggaagtgagctctgctgctgctgctgctacttctactactccagtcaactgagacacagcaccagtcagcatggtgcttgtgtgagaaggaacggcagccgaaactgttgagagcatcgcgaagagcatttgctacttctcccagcagtagaactgcatttgatagaaccgaagaactgctactccaacagtacggttgagctgacagcattttctatcaaccggagaactgttactccaacagtagaggttgcacagtcgcagcctgtgggccaccacggcattggttcctttactgctgtagctgccacctgccgcgcggccgccggaaacacccgttctgccttccgccgcctctgtcctgccgaccaccaaaaaccacacagcacaccgcatagtgatagattagtgtatggagtaattaattaaggctgtgtttagactgtggaaaagttggaagttgaaaaaaagttggtagtttatgtgtgtaggaaagttttcgatgtgatatgtgatggaaagttgagaatttaggggaactaaacacggcctaagaattagcaaaaatttaaaaataagttaatatgatttttttaaacatttttatagaaaactttcaaaaaccactattagtagtttggaaaacatatgtgtaaaaaacgagagagtgaaattggaaaggcgtagtaaataacacaccgggggtttagaatttcagatcatgcgatcttcgcaagctggatgagatcaaatgacaaaagctgacaaattaggctgctttcatttctcctataagagttggatgaaattttggatactcgtggcacgtttttcaaattgctaaacggtacgtttcgtgcgaaaactttttatataaaagttgctctaaaatatcagatcaatccattttttaagtttgttataattaaaactcaattaaccgcacgttattaccacctcgttttgcgtgaaacacttaatttttatcttcatttttatctccaggagatacaaacaccaccttaatcttcattgtcccaacttagggtgtattttagagtagaacgaactagaagatagaaaagatatacaaaatgagaaaaatcattagcgcacgattaattaagtattaattatttaaaacttttaaaaaataaattagtatgtttctaaagtatttttttcttgcaaaaactaggattgctagcccacacactcccaagaaaataaactagcaccaagcccagtcgacaattgctagccctacaaaggggtcaaatacgctatgcccatcaccagctccaagtagccaaaccctgatggacatccagccattgccacagagaaaggttgtgaggggagagcgtgagagaagattcactcgtcccccacaaagactcaatggcgacatctaagtgcgtcgtgcgcagaataaaccatttgaaggctgagatggtaagagacaaggcttcttagacaatgcctccaaggaagtcacggtgctagaaacactaccacaactgccttgcctacctatccactgattacacttggctttcaagtaaagaatctcactaggaaggagagggaggtatctcgacaacaccctcaggagagatcacaacgcccaaagcgtcaccattgtcgaccaagatcaccaagctatgctttcacttgtaggccctcccctaacattgcagctctgtcaccctaccaccaagcaactactactaccagtatgcgatcttcgccaagctggcgcccctccactgaccagctctccattcgaagcagacctcaagggaccttatgccgcttcctccgccacgttaatagccctttgtcaactaccatcacttctttcgtgcatcagatcaaagtgcacccatcatgtccgcctccaagcgtcgttcctcgttgtaagcctcccacacgaagcgagggcggcaagatccagccacctctgttgcccaaacaccactccgtcctttttccaaagcttcccatgatctgatctgataagtagatcagccgtagtatgggagaagcactgaggatgaaaagagagcattcccaacgagtcaacgccaatatcgctcacggggaggcatggtcgcatggggaagagggaaaaaggttaagacacaaagaggcatgattgcgacaaactgacaatgcatcaacttttggttggagggatatctctccatgggagatggcaatttaacttttgagtgtgtttaattggtgggctggatgagtcgtcgagagaggaaatattccacaaagatatatgaagatatctgcccttgctaattttgactattagtaattgattagcgataatatattttgttgttaattacttcctccatttcacaatataagtcattctagcattttccacatttatattgatattaatgaatcaatatagtatctagattcattaatatcaatataaatgtgggaaatgctaaaataacttacattgtgaaacggagggagtagtaattaacgtgtcactaattagatgtaagtagtccaattttttaatcaattagtatagtttcgggtagaattaatgatacctaatctttgtcttcattaccattacctaatagtttgttgtttatatttaatccattctagtcaatctaaacaaataagaaattgaataggcaaaaattaaactaccatatcccttaaaatataaatggtcaatatcttattcaatcttgacaaccaaccaaatacatctttattagccacaattcacacacggcccaagcaatccacacacggcccaacccagaaaccttccagattcctgcacctctcgacacttttggcgtcaccctcgcctatgccaaatgccaatgacgcactggcgctgcacgaactgaacccacctgctacctctgaaatctcttcaggatagccaggaaatcttcaggataaccacactcgtttccgtgcacaacaggctagaacccagatgctgcatccctcgctccttttcaggttagggctgtgtttagattcaaagtttggatccaaacttcagtccttttccatcacatcaacctgtcataaacacataacttttcaatcacatcatcaccaatttcaaccaaaattcaaactttgcgctgaactaaacacagcctaaaaacacaaataccgacagaattatagccgtattaaatagactaaaaaataattaattgcacagattgcgactaatttactagacgaatcttttaaatccaattgctccatgatttaataatatggtgctacaataaacatttgctaataataaataatttaggcctaataaattcatgtcgctatttaccgacgaattcgaattctataattagtttttttattagtgtccgaacacctcatgcaatactctatataatactcgatatgcacgccaaaactttacaccctcgtctaaacaccccccatcccccatgtatcgatccattccataagactgttacagcgtcatgcagtggcacggtacaagtgataccatcacgtacaacacgttacagatgcttcatcttacagcataatcttccaaaaccaaccagttgtaaacttggtttattatactctcacagaagtagacaaactgcataccattctgctgtcccgtaacataattattacgttggtacaagaaaccaatgcttctaaacatagaagcgctacaaacacaaccgcgatctgctacgtgtatcgtatgctgatcgcggattgttatggaactggagatacagattacagaccggctacaataacacttaagatgcccccgggcccacatcaactctgcaccttacgggaggaaacgacgcctggtgccgcagaagcgtgcctatctgccatggatattaccttcagcaatttgaccgggcacttatctatgcaaatatgcaccaggatttacccatgcatctatcgactacttaggctcatcttgatttattaatctccaaataaagtagtgagcagcaggtcttgcacaaatgttgctctgacactcgcttgcttccgtttctgttccctttcttcccttgtgagggatgagtcaatactgcaaatgaaaaaaaaaaattagcagatcattcaactgccaaaatttgaaatttataatgtatacctcccaaatagtcctaacatgcaggaagccatacagcagcttgttctacacgctactcatcagtcaaacaacttgctactggacatttattcagtacttcgtacaatgctattatcaacggaatatactggcttatcttattggactcgaattattgtgatcaaacatgagctcatgttctctgaacgtattgtacttaaaattgcattgaaactaaacattgacatagggcacgagtacaacaatagcttttatgaaattttgtgatgagtcagatagcgatgctagttctgaatttgcaagacaaccaagtctcaggtgttattcaggaggataacaaggaacaaggtaatcactacaaccttcgagtataccacgtgtttctatctagcacgaacaagagcaaataccttgaatcccatggctgagcaggtgtctcttttatcacagatgcatcatctggaatggaaataggtggttttgatgtttcctctgtgtctgatgttggaaagctaaggccaaacgatgacagaagagggtcagctgaaatatttgttgtgttgctgctgttgtttgacctatgtcccccacctcccagaagcacctgcaaatgggcttcacgtagatctcgactcagcaaagatagggcttgactgcctggaataacgaatctgcgcaacctgcgacgattctgcaggttgtataaaattagcaaacctcaagcgtgaacctctcaaaactcaaaaatatatatcttttatgcatcagctgtcatccacagcatgtattacatggggctgattggttgagtaggcactagataaatatacaggaaagcggaagtaccttgaacaagtacccatgttgcacagtgatatgattaagcatatcttttgcaatcttatcagaacatatagggcaaggctgaaatgaaggaaagaaacaatcaaaacaagacaataaactgttatctagaatattacaaggaaagaaaatatatttccagccatgtatagagcttgcagtagaacagataaacacaagattatgcagttgaggaataagaaaagaggcatctgtgtgagtccaacacagaacaatttgatttttttttcacaaaatacaaaagctaatctgtttttacaccttacgcaaagcagctgcacaacaagatggcaagagcaaactttctctttcactccaggttccataacacatactcaagttttacctaataaacgaactagtgaccatatgaacttcggacaagctgatcctgaaaactgaggcaagcaaaatttaggcctcctttgaaacaaaggatttgtggaggaattttgtaggattccaatcctataggaaagtttcatatttggtcctctgaaacaaaggattggagcttctcaaatcctatgaaattccttaggaatggctcaatacatgtagattttagaggaaagctagcaagagatacaacctcttggaaaatttcctttgagtctatctttgtcatctatttcctgtgcttctcctattcatgtattttaccattcctcatttcaactggagccttaacttatctttggagagctgatggctatatatattaaccacagttaagtacgctatcatttcctcaagcatttgcttataacatcaacgattgccaacatttccacttcttttttttttgcctctccatatacctatttttgcgcagccccaaatctggtcgtggctccatgcaaaactacaaacttgattactactttcgatgcccaagagaatgatccaactaaaattgcatcgctgtacaggtcaacacctcaagctttccatcttttaattcagcaacatatgctctaagcatgagctcgtcctccaggtcaaccaaaacaaagaacgccatctcttctactcatccaacaagagcagattacgagggggacgaacaactcaccgccgcatggggctcgaaggggtgctcctcctccaggtgcgcgcagagggagacgacgtcgtggtcctcgtagcagtaggggcacgcgaactccggcctcacctcctcgtccatgtccacctcctccatccccgctcgatctgcacccagcaaaaccaaaccaaataatcagaaaaaaaaaatccccccattaaacagcccccgcaccgcacggcaaaagggagaaatcgaacaaatccgaggagaagagagagagagcgaggtggacgcaccggcgtggccgagctgcgcggcgtagaaccgcttggcggcggccaggcgcgagatccagtgctccgagtccataggcttcggcggagcgggtaagataaggctcgctcccctcccctcccccactctcctctcctcgtagcgttggccgccgctcctctcctcggctccacgcgatcagcacggcggagatgtagctcggcggggtcgtcggcggggagaggaggaggagggggaggagatagtctcctcgtgccttatcgggaggtgaggtgaggtgagatgcggggcaggagtgaggaatggagctaggtataccgcgggtttttttttttattctttgggcaccgggtcgcgactcgcgaggtcgccgtcccccgccgcgtcatcgactcctcaccagccaagccggtggctgccgctgcctcccggtgtttttgggcggttttactcttaccccgccgtgaaacggaaacacgccgcgtcgcctttgtcgccgcccaccgtatggtggattggtggggccacgccgcggcgccggcggcgttcgcgccaaatgcccacagcgtacgggcgtgggagtaaaattcgttggcataaaatcgcatccgtcaccgtgagcccgtgagaccggaccgtggccgagacggcgaacggccgaggacggggtgagccgggctccgcttgaccgcgtgaggtcggcgcatggtcgggctagcgtgggccgtggggtggagttcgtgtgtcggcaacagcgtggtggtgtcgctccagcgacgcgtgttggtagccatggcacatcgggacgaccggacgagtatacgtccattcttctctcagtactccctagtccctagtcttaaaaaaaaaaactcaattcctaacgttagttccaatttttttttccaaacttctaactttttcatcacatcaaaactttcctacgcacacaaacttccaacttttttatcacatcatcgtaattttaaccaaaccaatttcagtgtgaactaaacacagcctgtttccgtatataacgtttgaccgtccgtcttatttgaaaaaattataaaaaaatttaaaaagataagtcatccataaagtatgttttatcatctaacaacaataaaattactaatcataaaaaaaatcatataagacgaacgatcaaacgtttgacacggaaatccaagaattgagtcttttttggagcggagagagtgtctttttagaacggagggagtaggagttactagcagtaactcagttcagtcattataatttttaaacggttaaatgtgtcaaatgctgcgtttcttgaaagaattttctatataaaagttgcttcaaaatacgaaataaatttatttttcaatcttctaataattattaaaacccaattaacatacattaatgatttttttcctaactttaatctacggggccatgaccggagttgggtgcaaaagcactgataagcctactaccattctttaacccactcctaaattaaaccctctaactaaggatgcaaacggaccgacccacgaatttacttataggtcaaatactagatgataaccgcatctaaatatgcaagtgggtcaatatatactcatttttaggtcaaattattaggtaacccgcgggttacccactaatttaactcgcgggttacccactaattttatctataagtgggttcgcggacaagcccgcttgcaaccctacctctaacccaaaactatcttgacttgtcaacaattacggattacgggtacaacttcccagtccatttcagaatgaacattttgtaccatcaaaatttcgtgcaataggtacaacaacatctacacctaggcatttttagttttttactccaaagcaatgtgaatcagactaccaacctgaaagagattgtacaaaggaattcctcctctatgcaccacaaaagctgtgtataacgtttctactagttctcatcagtatctcacacatctaaggccgcattgcctttttgcatcgtgtcacatgacctgaaaaagctctcaacgagaaattcgtcgcggctgccggatgatcaccagttcaacaccaccaacacaagaaaaggctttgatactacatcggtgcagttgctcgatctactgccccagcagccgcttgacgccggacttctggtcggcggtgagcctcgccgggaacttgatgtcgaacttgaccctgagattgcccttcttggaggggtccttggggatgggcatgccctcgccgcggacgacctcctcgtagcccgggttgatgacggaggtgatcgggatcgtcaggctgcggccgtcgagcgtagtcaggtggacggtgtggccggtcagggcctcggcgagcggtatcttctgcgtcacgacgaggtcgttgccgtcacgggtgaacaccgggtgcggcttctcgtcgatgatgaagacgaggtcggccgggatcacgttcggctgctcgtttcctttctccgggaaggtgatcttggtgcccttcttccacccaggcttcacatcgatggtcaggatctcctccactggaattgtcttcctgcacaatcacaatgagcagcattgttcagtacacaatacgaactgaaacataaggctctgccacattggattattagattaaggaccgaggagaattgctcaagcaattgattaaatactaatatagctaacaaatacaactagcttaaagaagttgtctacacaatgcagtttgtgaagaaatcataatattagaagcgtggcacaaataatccatatctcaattactatctatctagaacacgctgtaatttggagaatgtatgaaattaaaactatttggatggaaacagttttaagcatccatcccaaattcaattgacacaagtgctgcagtactaaataagtactgctaacaaaaatcgctaatggccgttcgaaaaaaacaaaaatcgctgatgctaattgcatactaaatcaaaacagttttaagcatccatcacaatttccaatctgataacagtgctacaatactaaatcagtactaacaagtgacaaatcgttaatgctaggacatactccagtaaacaagattgttaattttgtgatctgtgaagcaaagggagagagacttacccactggcgtcagcgatttccctggaaatcttcatcttcttggtggtgcctttgtagagctcctccaggctgcacggcagcttcctctcgatcgccggcgccttcaacgccctcccggcgccaccgccgtgcatcccgtggtgcccgtcggcgccgccgccgaacgccgagccgaagatgtcgtccccgaagatcgacgacgagaaccgcgtgccgcctgtccgcatcccgggccctccccccatgccgccgcccatgccaccgcccatgccgccgaacgggctggacgagccgaagaactccgcgaagatgtcctccgcgttgcgcgggttgaaccggaacacgttgggcccgtcgccgccggtggagaagaacgtcgcgcctcccgggccggccccgccggcgcccggcggcgggacctgccccttgagcccctcctcgccgtactggtcgtacaccgctcgcttctgcgggtcgctcagcacctacgccgacacccagcacaagcacaaacacaaacaccatggaagcgtcacgtcattgcccaattcagcaaaaaaacgaatccactcagaaacagatctctgtctggctgcttacctcgtacgcctcggagatctgcttgaacttgttctccgcctccttcttgttgttggggttcttgtcagggtgccacttcatggcgagcttgcggtacgccttcttgaggtcgtcgtcgctggcggccttgtcgacgcccaggatcttgtagtaatccatccccatgggctaaaaccttcttgagctcgatctgttcggcctcttgggtgtggtcgcgtcgcgttcttggctattctcgccggagaggagagcttcgtgttgccgtcgctgcggttgtgtggtttggtacgatgctggggggagagagaggggggaagaaaagaggggagagagaagagtctggagagggaggagagaagaggagtgtggagatgggtgtggaagcttccagaacgtcctggagggcgcgcgcgctatctcggtgcacgtgagacggacggacgcgtagttggttcggttgggtcggaaatattctgcgctcatccgtcgtcagctgccagcctgccacgtttgcagcttgggtccaaacttttcgatgagagaatttacgcaagaatttatacgattaaaatgttatataaaattttccatggagagctttgattttaaggatttggagttttccaaatcctacaaaaattactatgagtctcattggttagcctaataactcaaaataagagctaaaatttgaattttcgaatttggttttgaagttggtgggactatggaatggctcattgcacgtaggttatgcagtaagtttgacaagaggtctaactttttgaaaaaattcctttgaatctatctctctcatctaattcatgtgtttttcctgtggtccaatcaaacgaccattcatatatctgtttttgtgttttacaatcctccattttgtacttgcattcatatcagaatctcgtgtttttttatttctatgattcaaagggcgtttcgtttttggaattcgatttggcatgtggtctttgtttttatctcggattagagtttgagtttctgttcttcaaattttgttcgacattgacaagttttggcaattcttagattgctaccatgtcaattttttataatgtcaaattttagtatggttaatttaacaaaattaacagcccataacccccataacgaaagcgccaccgagaccaattaccggcgatgccttctcatcaagccggatcgactactcggcattgctacatctgcccagcaactcaaccaaaggagagatgaactcggcatgcatgggagtatcaatccggacatctctatcgccttcggcataaagaatagtacgatcatgttaggccaacccgagattagaactcgcagcaaggaatgcaatgcagacagcgggttccatattggatgggattttatcgggcttcccctcttaacttttcctgccgtacgaggtaactttgtacgggaatgatttccgacattgaatatactgtgtatacatcctgctacatgttggtaaattaccaatacacttctacaaaaccgataatcctctactatgtatggataaaccatctgtttgagctagatagaaccagatgtaaaccgtaccatcacttggttgccacgtgaccttcaaaaggccagacttcttaattcattcgttttattcgctatactcggaagaatatgatgtaccgtcttcatcctcgtcaccgttctccgctccaccaccgccaccatcgccatcgtcattgtcctcgacatcatcctcgcccatctcagcatcgtcgttgtcttcgtcaacatgctgttctgcatcgtagtcctctccatcttcctcaccatcttcatccccttcggcatcttcttcattatcgtcactcccatcatccatcatctgaagagggctggacccagaattgtcccttgaataatctgggagcagctcatcgtactcctcgttcatgggttcactattttcctcactcgattcctctgactgagaagctgaattgtcctcatcatccttgacatatgacggccttctctccaagccccactcttctgcaccagaactctgaggagactccatggctgttgtatgctttgcattccttagcatgctaaagctgcccagcaagtttggctttggaattgatctggctccaatatctgatggctgccgaggtctaacagttctaagtccacgcccacgtccacgattacgccctcgacgagcatactttcgaggagctttctcagatgacacggcgctggcactgtaacccctgaactcgatcttgggggagctgctaatacctcttgggaccttgccaccacgactccgggatctgcctcccctgctaccgcctcgactacctcgtccacggccaccccgaccgcctcgtccgttgcttggagttagccatgtttcttgtcgatcaaaacctgttcccataggttcagtttcttgtttggtcttagcaggagtatatcttggcggaagcttctgcatagaagtatcaacacaattacacaaagggacagctagaagggtgtgattcaaaaagaacaaactgctatataaatcacatttaatgaatgaataacagtattttacgctatctatttattttccttgcgtaaaaacctcaatacaatgatcataagaaataagactcaccatgaactctccagctccccgctccttgtttgatcccaccttctgacgaagagtgtatgagatggcagaatctaggtctaacaatcttaagacaacagcagcaacagtgtcaggaacccatggaagtacatcagcagatccagaacgtggaacagtatttcgagaagctgaatcttgcgtgcttaaattaagtaactcagttgttgtctcaaagtcagatgacaagaaatcccgtcttatggcaccttccagaatggttagcatctggcaaagcatgacaaagcacaattcagaggctgataggcatagccaatatatacgaaaaagctgctatcaaattgccaagatttccattttaaaaatcaaagcatttatcttgcagaatcaatttgtcacggcaggttttttaacgacccattcttccaaagagaaccccttgaactaaaaacacttcctaaatagaccaaacaggaccaatatgatttagtcttccagcaacatgtgtatcatggcagctaaaataccagtacagtaaacacagcttatttagtgaaataatttcctataagtatcatgttactcttgccaaagaattatcctcttaataatttcctatagagcaaacacagcttatggggttccaagtgaaaccccaatggaccaatgcaacttatgtctagcatagtaatactcttttagcctgctattgcaaatacagtagaactcagtgtaaaagatgtcctcaaaacggaagtaaggaactgctgggtgtattaaagaaagagaaggaaaagatgcacaaacctcaaagacttcttttgtagacgatgtggaatacaacttcacaccccaagatttccgataaacatctgtccagaatggttcgagagcttcagctggaactgaagcctgtaaaacaaaatgttaacaagttagacacactcactacttgcactcaacaaaatagaaagataaggccacatcagaaatatgttgcttgacctcaacggttgctaaaagcagctttagcaatctcaatcctacaggaacagaatagtctgaaatttgcatcttccaattaggatctgttctccgtttctcttcacactgtgaagagtgttctgagatattgtgaatggatttgaatgtcttgtggcaagaagcacagtgtgtttcttcagctaagtaaatctgatagcagaaatcacaacattgtatcagctcagagcatcgtttctttccatgtttcatggcacatgttggttggtgattgttgcattctttccacatccactttataaacagatcagccctttctgaaattgcagtcttttcaacatcattacgcccaagttctatcctgaaggaatctgaatatgccatagcactatcggttgcaacaccagaaagggtactgcatggacttccaaactcgttactatgattcggacttatgatctcactagttccatttttcaaaacccttccggccgacggttctatgctggcacaccttttcctcccaatagcttccttgaaggttggttcaatgctttgcaacattgaatgaagatgtgactcacggatgccacgagtatcaagagaagatactaatgcatcaaaagtctgcatttaattaggcataacattgaaattatcagagacccagaaagtacttggacaagggactcttaacatcaaaagctggttcttagataaacaaaacaaaggacaatataccctaaatagagcacatatccatttacgatgcaagtattcatatatatataaaccactactgcatgtagcatctaggttttctacaactagtcctgggaattgttcagttgctgttatcaagtacgagcccagaacaccacagaaaaatcttgaatcagcactccgataggtatcaatcatccaagagagaagttagaaaagcctaatctttgattgaatccaagcaaatgcccgtacaatttagtaccactgctccaccagttaaaacactggatcatgacttaatcatttaactgatgtaacccagaagttgtgctcgacatgatatgtccctatccttagataaataaaagcaagctttaaaatagaagcatatgggatagtgagaactactatctaagcaatatggctcatgtcaaccaccaagacggtttacattttcaagaccctctaaaataattccactttactattacaactgtgacatcgtctagtggtatggacaaatctctctttatctaccataagtaaagctgatgtagcgtcctatttcaagggatacataaattacatgaaaaagtgattaatcggcacatcgaaacacaaacctcaccagctgaatttgtgctgttagtataatatgtattgtgaataagctatgggttacaaaagaaataaaaatacctcaattgagtcaatcagcctccagtatccatctctagattcaaaaaagatccttccagaaccagggtcatcgggggatgcagaagttgaaaactgccagtaccggtttcttctccgatcttgcccgaggggtagtgatctgtatacatgaagttgttctgctttgtggcctatatatgatttcaactgagatcttgttttctcagatgtaacatattgttgaccagacaaattttctggattagcactaaattcctgccttacaccgttcctttcatgaaccacgctgcaagcattaggctgactctgctgatcga

SEQ ID NO: 58110 - DNA, 2246 bp, Oryza sativa
gcaaagtggtgtggactgaatttttgtgctctaatagcagcacccaagctatgcttagctaaactattgtctattccatttggacttacaaaaatgttgggcaaattattattctatactaatgatgaatacataagccaatgggaatgtaagaggatgactatagcacaaacctctagttacataacttttgtatttttcctcctaggatttccagctccttttaggatatttagttaatggtgaaaaaggtgtattgtaaagtgcataatttacatgtggatttgatttttctaaactaaagcatatttgctaattcttccatttatacacgggtttttaaatgagcaccaaagttgggcaaatggttaggtccatggagatggagatcacacatgttggtttgaagatttttatatgaaatgaggggtgggaggatggatgtagtgtaaagcactaaagcatcaccaccttcttcaattgaaaattcaatgtaacaatacatgcatatatatttgactacagggcacatgatatatttcgcaattcagcacattttgcaagtaaaacaggccattctagaacaacacaaacacatccacctatggttagtgcaagaattcatgatgtgataagtttcagaatgagcttaagtttaggaacatgctaccatctgtctagattcatagtactaggatgtgtcacatcccgttctaggtttgatttttgtgggacggagggagtacttgattgcttggcttgcttgctctagataatttttcaagtagaactttgttctgtagatattgatgcatagacagccaaccgggataaactgcatagctaatatttaacatgaattttcccacttcctcttgcaattgtcttcttaaaaaaaaaaccaaactacttatcataactcataactagcactatctttcttgccaggttcaaaactctgtacaggtgctgcaggataagcaagagcttgctgaaacccagaaggaactaactaaacttcaaatattacatgaggaatctgcacagaaaagcgaaggtactgctccatcagttcttatgacaaaggaaattgacggcagcatgccagttgcaaaacatgagcttgcccttgtgcctctgcatcaagtaaatgctgcccaatctcctgctatgcaattccaaagttgcaatgggcttgttctgcagcaactggtcccagtctcattgagcactcaacaagaccagcagcacatgaaccaagccaccttgtactgtatgcaaacccaagctcatgttgagcacaggcaggcccaaccatttcaacctgcacctcaacctgtgcagcgacatacccagaatacgccacagactgtagttgaggcacaacaggtgacaagtcaggccccagacttctacattcaacctcagcagcaatgggcacatcaaactggccagcaagttcaccaggcaaggcagccacagccacaggttgtgcaacagcaacattacaacaatattcagcaagttccagcacagatagttcaaatgcaaacttcttctccacaggctcaaagtgcaccacatgtcacactgttgtaccctccttatggatctcaacaacctgcctgtgctaatagtgagccacgctcgcgaagcatggctatgcagccttcctactctacaatttcctcgtcccaaaggaatcatcatgaagtcgctcctgtttatgtgcaaagcaacacaatttcagtcccactggctgagcatagcatccagtctcagcagccaccgcaacttcaatcgtttggtaatggctcatttaaaccaagcaaggtcagcctacatggtgttgcctcatatacagtacaggggaatgcccaggcctataacactgcttatggaaatccgtccaacaatgctgctactgttgttgctgtccttcctcaacaagcccagtctagtgctcccatggtgcttcatcatttaggaccacagtctctgcagaatcatccaatagacatggttgaaaaggttgctcgtatgggttactttaaggatcaagctgagagcatggcacttcgaatggctactgctggacagaatgtagagttcaaacacctcgcttgacaagcagatctctggtggcgatgaggtggcgagtaggagaatgaacaagccagtttggaaccgctgcatgtggtttgttggcttgttcctgtgaaatattatgatatcttactatcatg

SEQ ID NO: 58111 - DNA, 618 bp, Oryza sativa
tttgagtctgtaggaaaaaagtaatgttttccaaatattggagtatgtggcttcagaccgccgacaatcttatttggtccacaaattaggccaacatagaagcacaggtttggcttgtttttcctccaaacaagaaaagcatagaggaaggcaaactggcaacttgttttctgccgaacagaatattcattagagtcgtgcctagccagctgccaactgcagaaaagcatagaaatcaaatcttttttaggacggagggcgaggtcattatcagaacaagggttcaaattttcaactaaagcatcggattcagatatcgggcacaattgcccgggaggcctaggactgaaccggcccaagcaattcacacacggcactacggcagccagaaaaccatccagattcccgtgtcacttgagccgcttggcgtcacacgcgccaccgccaatgacgcactgtccactgcaccaacggaacccttcccccggcggaatccttctactagtacctctgaaaatctcttcagtgtttgccagaaaatcttcaggtagacgcacactcgtgccgtgcacagcaggttagaaaccagatgcccgcatcgctcccttccatcagatt

SEQ ID NO: 58112 - DNA, 583 bp, Oryza sativa
ccataataaaatggcaaagagaaccatgatttagcttcaacaagaagcgaatggggttaactgcaaattacacgcaacgaaaaccctgcatcgagggcacccagccgccgtttgtttactcctcctccgcctccctttttcttcttttttttttctttttcctcctctatccacctcgatcgccatcaccaactctcgatttgcgaggtgaggacgagctcgccccgggcttgattagctcaagccctgaaccccccagagcagcagcagcagcagcggaggaggaggaggagggagaagagtgcgggcgcctcgggaagccggctgacagtggtacgtgcatccatcgctctctcctttcccctcctccgctctctctctcgatccatctttccctctctgttttcaatctacagattcggttgattcagtcggttgtggtgagggaaaatgtcctcctttcgtgatctttatgatgcgttctttgtagatcttgttgttgatgagaggttatgatttagtagcatgtttgtgggtgagattagagggggggggggggttgaatcttgagctgaccttgagg

SEQ ID NO: 58113 - DNA, 645 bp, Oryza sativa
ctattctgttgctatgtactgatactactagtatccagacattcgataccatatagtaatgccaatgtacttagattcctcctaatcctagtgccaataatgtggctacaaattaactctctcaatcatggagtaggagcacacaataaccaaaaatttaatgtcagcttcagctgccttagtcatgtttaatgatatggtgacactgtcttgactttgttgctaaggcactgacttttttcgctaatcaaaagattagccacggacaagatgcttagttagttagattagatattgagttggtgagattagttaccgggatgatattgagaggcttctggataacctgatcctacagaatggacggcttcgattcatcctgatccgacgttgttggcttgttgccaaccgacgtggctaccattttctgacgactcgccggtgctcgtgtggggccacactgtcattgaccacccactatcgtgagcaattctcagccgttggattttccacatggagaatccgatggcgccacgtaagcacggcaggagggtaggcgcgtctcttgtgggcccctgtaccgctcctactactacgggtgtaaagctggaggtaatttgcagggacagccctgcttaatattgg

SEQ ID NO: 58114 - DNA, 631 bp, Oryza sativa
accccatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaataaaggatcaagcaaaggattcaagaagtggctgtatatagttgtgattccagtggctggtttgattatgcttgctggcatggcatggatgttcttgccatgccgcaagaaatccgttgcgactattggcccttggaggactggactcagtggccagctgcagaaggcatttgtgtcaggtaatactgcaatatttgccattttgatttgtaatattttcttatattgttctgttacatcctattcttataacggtaagttcttgactgtgttcaagtctggttttcagatcaaatattcatgttgtgtttctggttttcactgtgttctgatctgaatgtgcttcaggagtgccccaattacagcgtccagacgtg

SEQ ID NO: 58115 - DNA, 611 bp, Oryza sativa
agtcactattcattgccccctaggtgtttgatcgcgttccctagccctagccctcctctgccgcgttgccctcgcgccccgcgcgccgcgcgccgctccacctcccctctgccgtcgccgtcgccatcaccgcgcgtgccgcctgccgccgcgccgacgtcgccgagccgccccgagcccgcgccgacatcgccaaccctatgccgcgcgtgctgccgtcccgttgccgcgtcgcctcgagccccgagcagccgtcccgtcgccgcgtcgccgccgtcgccgtcaagcccgcaccgcgccgcgccgcgtcgtcccatcgtcgctgtcgcgccgtgccgtcgtgtcgccgcccatcgcatcccgccccgagccgcgcgccaccgctgtcgccgtcgccatcaacgtcccgtcgccgcgcgcgtcccatcgccgctgccgcgccgcgtgccgtctcgtcgcctcgcgccgcgagcccgccgccttgcgccccgcgccgacgggccgccgtcgtttcacccttcctcctccttcccctctctttcttcccctcttccctataaagactccagcccaatccccccctttttcaccccactccattccctcctctt

SEQ ID NO: 58116 - DNA, 817 bp, Oryza sativa
ataccttgcaacctattcttctggcatactccgtactatgccttcgatgcgtctagctaggctcgcctgaagttggattcttgctttccaaatttcaaaagtacaatttctgcagcaatgccctgaaatgagcaatatatataagcatctaacatttgaatgattccaaaggttcggatattctgtagagctgtatgggggtaaccgggtaacataattaagcttaccaaattaaagtaaagtccgttgcaatcttgttgatcaaaagcgtttgtacgtatgccagatttgcttcggggttttgatgcttcaatgaaaggaaaatcgctcatgtaggtacttaaaccagtattttgaaactaatgagttgctaatgagtatttattaataaatcatatgctaagagcacctgcaatggtaaagtaaggtgctatctataaaacatatacatctcagcaatagactagattaataataaaccgcctcaatagtatgtctacatgggtatctatagctctctcatgcattgtctcgtttttctctatagactatctctaaattagtagatagctttgctctctctcttcatttaatatcttccatgtaggaaaatatgctgacatagatctcttatagagagcctatagataaccattgtgggtgccataatgagttgtttcgttttgcgtgtgctagagattagtttccaacatcaacattcgaacacagccttaattaatcaaattcgacactcttcttggtattgctacccaaaacaaatactcacaataaaaatttatggagggagttttaaata

SEQ ID NO: 58117 - DNA, 6110 bp, Oryza sativa
agagaaaaagaacagtccagtttggaaagagaagggtgcatgtggtatccccttgaagtataaaaggaggaccttgcccatagagagggggttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcacattttaaaccatatcaatttttgataaagttgttaaagatgtgcatccatttagtttttttaccaaactttagtaaatacataagaaatcctgctaaaactaggcaatatcactaaattgtaaaaattttggtattgccaaaatttggtaagatttattttggctacaatatgaacagccccttcattttcaaagtgtgttttcaaatctaatcatagagagaaatgaacattgataatatttcatatatatgtttttagaaatagaaaaatatcaacacttaaactgatcttgtttatttttcccatttacttagcaccataaaaatgcttcttgagtaaaattacaacttatcagcacctaaaattataaaggaaatatatattatcaacaagaatctatctatacatacaattttgattgttgaatatagaatctttattaattcactaatcagtattatatagatactagtagataatcagaagtggtagatagtatgtaattattcactaatcttaaaataatactttggctcatacagtactcatacaattttaggcatgggcccctagctaggacgggccctaggccgtcaccctcattgccatgccccagagccgggcctggctgtcttctttcaatggccgccgctgctaggagctccacgccatgggtgaggtgatgggggagggaggaagcactagggatggccttcctggctccagcgatggcctcggacgagggaggatggaaaaaaaaaaggaagaagatggaaaatgtgatggtgttgatatgattattatttttttttttcgggggtgatgatatgttttcaattttgcaaaatttcaatgcaggatgacagtacgtttgttattagctagttggccaatgtttcgtaatccaaagttacaattcccaatcaaaacacaaaattagaattcgtcaaactagttaatcccactaaagtgttcaattgtcggtacaaaacgatattttcatttaacaagctaagctagcacataatatatacattgtgcaaaaataagcatttcgacatgcccgtgttcattgagatagttgcaccaaacgagatcaagtagtctggtttatagcaagtatgtcacaactagatcctaagaaattattggcgagctacaccagtcgaggagggaaaacaaataatgcaggacaaacgtgtctatctgcatcaccgatgctttcatttctgttcgtgcgtagctcttcatcatcgcaaaactgaaaactcctgacgtctctcatgcttaactgtgcatatctgcttgagcttagctcgatcttggcactagtatgtattcatggagtatcatctcaagcgtgcagacacatgtagatatctctcacagaacagagctatgtatatgcaggctatatatggtgcatcctgtgatatatatgtacatttattcgattacctaatcatgtgctacggtgcatcctgtgatttatcgggacatgcatgtacatttatgtgagaaaaattttggggaaaatatatctgaattgcataaatcatggatccaatcatctaataaccaatcgaccctaactgatgtactaatttaaagcaacagtcagttatcaaaagtactttccaagctaccagtaatatgtgaccacctcagtgtcatgtctcatcccttgtagaacaccaggcaccaatttgatttcttccatgttgcctgagctatgcacccaaaattcctctgagagactaatctggtttttatttctcttagaaagatgtgattttttttgtgggcaggaatttaggaaagaaattaatgatcatggatcacacaatgaggtcatagtggagtgctgcacttggtcaaaacaattgggagaattgatattcatacaaatataaacaccgtagttttggtcaggcacttgatccatgatctgcaggatttgttaattagatcaaccgatcgtttttagtgatctcatacgatctcatgctttcatctgtatagattgcatacatgtcattctagaacttcacaccgtctcgtgcaagtcgttcaaaaaaaatatacatgtcattccacaaccattagtaccagctcccggggcaagagtaatgatgcaagaggcatggaagcagaatggtttgcatgaagataacgtggaatctagttatatttgcaggagagggacaatcatcttcccggtgcctcccagatctagctagtaactaagcttcgttttttagacacaatggtaactagcttcattgcacaggccgatcaatgtagtatatataaaaagcttcatgagcctaaaattatagctatggcgtacagtgatggagtaaaacacaaacttactattacttcgaattcaagatgaagaatctatatagcatgggaaagaaatttaagttgtacattagaattcaaagtgttttttaattgtagattagatttttccgagcccagtcgtaaaacaatactaaaaatatcttaaaaaaaagtatcaaattctaacacttggaaacaaacttcaaattataatctttagctgaaccaagcgggctcaagctcttaattgctaaaaaaattataagatgattaaggaataaaaacttattgaagcactaactaattagaaggcgtttatgtggcgtgaaatcgttacttgataagaacatagctcacgctcattcgcttgcgtcttgcattgcacgtcgaccgagcatccaagccaagttgtttaatttctttgcttgcttatcagctggctatcacaaaggctcaaaacttcctaataatcactgtttaatttgactaaagccggtaaggaccacagaccactgactccgtgaggtacgcaagctccgtcaggacgtgaagcgctcctcctcgcggtcgagctagcgtcgtcgttgcctcaccaacagatgtcattcagccatggcaggtcggcagctcaacggcgatgtagaagactgaggtgtatgggggtattggtgtcaagggacagctatggcggccgccacagcatgccacaagggagggtccgcccctgtctgaaactctgcatgttatgtttatctccatgtatggcactacacggtgtctagcttcaagcctatatatataaagccggtgtgaaaacctatatgtacagtacatttatttcatccatggcggatatagattttcatccctcaaggggatgtcccctcgttgcttgcttgaaaaaaaaattgataacatagattaataagaaatatatcactccacaacatgcaaggccaaattagacttttacaagttacaaccaaagaaacaaattaaactggaaatagttatcatacactcgcagttatatttgtattttttttgttacagcttgtaaaggttgaattttaacctgcgtgtttgtggaatgatacatttcatattaatctattttatcaatttattttaaatttttttatgactatttagatgacatgtatgaaacaagagaatatctcctcgagggatgaatacactttcccatccatggcactctatatatatcttctaaaatgtgggatactaaggagctagggactcagtaccaatgtagcttgagccagttatatttctatcaaattttggtgaaataatattgggaagaagtagagcatggtcaaaaagatttagtctactgatttagtgagaaaatggggatgaacttgaggactgaacaaggcaaactgacacacctgtgcttctccacgaaccgtccgatgtacaagcagcggtctagattgatcaggagccaaggtggcaactttccacgatgcacgattaatttttaagaagtgaacaagtagatccaagaccgtccaaaatcgggtcgcttcttaccgttagatgggacataaacggttaggatgttaaatcattttacataagagcccttcaattgcagtcaatgcatgcagctactcccttcattccaaaatgtttgacgccgttgattttttaaaaaatgtttaaccattcgtcttattaaaaaaatttaagcaattattaattctttttctatcatttgatttattgttaaatatacttttatgtatacatatagtttatatacatatagttttacacatttcataaaagtttttgaataagacgaacggtcaaacatgtttaaaaaaatcaacggcgtcaaacatttagggaatgagggagtatttgtcaacccgtgtgggtacctcatgctaccctaaatagcctccagtgtcattatataattttctcttacaaatactccgtatttggtattggtaacaaaccaaacatactttacctatgtctgccttaccaaatatcagcaatagtaaaatttggcactacttgttttttcgcgaacgcgcaaaaggattacacatcaatatattagacgaaatcagaatataacctgccaagcctatataaagcatatgtctgcatgtgcatgaaaactctatgtagcctgcctcaagtgattatactcaagtctgccctgccctaagatcagttaatttcctgatccattacattctcatgaagagatgtacaccagtatatgaattgatatggatccataagcctatgactatgaattgatatggatcccatatcagtcttccggattttcctcttggatgaaaaagaatacaataggcttgggaggcatcgcgaatttgaagttaatagtactacttgaggaagagcaagttactgaatgatttagagctcttctggttgctgctcttgctgggatcattctgcctggagcaaagccggagaggtatgcgtgtgggttgtttgattgccaccctaaatttctccctggctcaggcaactcaatcatgttccagccaccacaaagtgacaccaaactcactcaagcatcaagtagatggaagattatttttgtgatgaacccaaaaaacaaatgtgtgatttgaactagtttcagtttattgtaccaaaacatgtaaaggcttaggtattgaatcaataattacaatagactgatcacaaagacaatcatgagaattgatgatggaggatatatttgttcttttgagacatgcatggtttttcagagtgctgccaatctggttactactcctttagatgagatcgcttattgttatttaaccttcagatgagatcagacattgtcattatcaaatctcattggtgtactccatctgttccagcatatacagggtttatgtgattaaattgtccgatcccatcagcatacgcggttttcttaattggctatagtactggtgtcatttaggagtatttacacgaacgaacaattagtatagcacatttagtttaacttcaattatcaaatcacagtatctccccgagtttcccatattggaatcacccttaataactgtatgataaaggcagacagactgggactaaccagttttttttttttgtggactgggacacccttattaagcattatacatgaaacaagtgtaatttcagttagttcttttgtaaatatcaaattaaaaaactcccactttgtttggaaagtctgcctgatctcatcctccagttgaatgcctgaatgtgcccactgaactttcttcagttcattttcatcagtcagtcacctttttctcactactgtacacgccaacttaaatactggccagcattcatgctca

SEQ ID NO: 58118 - DNA, 32592 bp, Oryza sativa
  unsure (1)..(32592): unsure at all n locations
cagaatgctcccaaatctcaatgtctcattggtcctcctctgaaaactcaccttcctgattaccatggtcttctcatggatatatgtattggcatgtgagaatttctctatgtatgtctactagaacgtctcttgatttttgtgcttccatagcataataataggcctaggaggtgtcaggagcgtcttaggttttaccctttctttgctagctacgatcaggggtttgtacagttgttcgatgtacatggaatttccttggaatattcttttgctagtatggcggcatctaatccaaattgcgctctctagagttgaagctggtagaaatacatcagtacgagacaagatgaaagtgtgccgatcgaaaagaactgggagctcagagtagatggatcaaaacacggatccttcgtcgctggcagccgtcaccggagaattaggaggaggatgaggcaaaggcagcaatgctcgctttcgggagaaagcatcggaggtgttgtgaaatgtgaaagttctaagcctcacattgataatggtttaatcaaacctaagcaataggaaagaacataagattagaaagtctaattatttgcaattttagcaccaaccacgcagcaggcgcagaagattgcttattaatttttctttttttacattatgatcgcttattaattatgaggtgatattgtcaggcctcctcgagaactaaaaacagccatgttaataggctaatagccaccataaagctcactctgtgactatgtggcctctctgtttcgcctatatgaagtctagatgattacagtacatatatgctagtctgctcgcaatgctcacattcgtctccttagccttgctcggtctgcctctagatcaaacttttgccgtttcttttacttgcatatgttttgcatcaccatacaagatatgttttatgtgcatatcatagtgggcttgggaggggtcgagaatgaattcagacagtggaggcggttcagcatcaaattattatgcacatgtgcacaaaacatatgcctaggtttcagaaataaacaaggaattggtaagaacaatatgaaccttgcagcaattgagggttctggtgaaaccgatggagacgacaaggctggagtgcttgatctcatcgctgcttgatgttattgggagttttcacccccaagtaggcgttggctgatggtgaacaagttggtgacctgaaggaagcttgatcgtagtgttgcttcttcagttcggcgttttgtttcagtactgttatctgttagctagatgtttggatgcagtcctgagatcttgtcatctggttggcctgcatacccattgttgcgtgaaatttaagctggttcccagcaacaattctatattgctttcagtcaaaagcagagcgtaaaagccttttttctaaaaacaaaaaaaattgatccttggcaaacagaaagtttatcgaagatcggatagatatactagaggttccattttttagtgaaaaacctagaatcgctaaagggaagttaatgaagatatatattttttttagaataagatgaagatgacatttttgtgtcgctaaacttttcagtaaactttgttttgtgtggcttcaaccaattaataaaaggtgagcaaatccaatactagagatacactaataaagttcttcaacttcttgatgtcatgaaagagattagacattcagagtctgatactttgtttcagacagacagttcaggattggcatccctttttctttcagaaactttgtattactttgctcagagtcctacattatgcagattatttttcttaagttcaatccaaatgcctgaatgcgtttgcttaaatccaacttattcattcatcagcaacagcatgtgcaaataattaggcatttaccattccaagtactatacagtttgcagacactgaatatcactttggtcagaattcatgtgcagtgatgtactcccttatcacaaatattagcaaaatatatgtatgctccatccattttggaatctataaaatctcaatgtctgctctcaatgatggacatctcacaagccctgctcccagtgccacttgtctcagtatgctacacatcgatgtatttcttcgaaaatatgcaataggcttgggaggcatcaggaatggatgatgctgcaatactgtatcttttcaagttattttacatatccgcacgccaactcggatcagctgcagtcaaacatcaaaaaggttgcattttgtatcagctttgttgattcagggccatatcaacttgttcatgcgagtctgactgtgagacagcggttcgactgctgcaatcaaagaaaaaggatcactctcctctggcctacatcatcagcggagcgaaggatctcatattgggagtgagaacttattgtgacaaagattcacaggccccaaaatggtgttagtcatttgttagctaatacagctaggtatgagtctgtttcagacttttggttggaggaaaattgtaatctaatctcacatttaagtatgtgagggcatttcttatgagtaatatattcccccttcccgcaaaaaaaagaaaaaaaagaaaaaagaaggttcatgcggccacaagttgaacagaggtgttacttgtattgaagccttggccgggctgctccagggagaaggaagccaacttttcaaaacaacatgtcatgtcgggatttcctgtggtttctaatttaaaaaggtagcccagaattgaatctccatttgtgatacagttcagttcaatcatcagagactcccagcccatgtgactaatcgttgacgatcatatttaacacagaaatatcagcagtacctcgtttcctgcattttcaacttcaactaatgaatttgaggtgaccgcgtcaggacatgcagaaattagattgtaaaatgtttgacaaggtttggtacatatgcatatccgtgtattaaccagctgacataattctccagatggaagacaatgcatcacgtttcaaacacccaacccacattgctgccacagaagcatatagaatcttggtaatacacatattcgtttaccttgagagtttcttttcccatccttgcaaggggcgttacatcttacgacacaaaatttgagcataatgctcagaggtgtacacggatggaatactcatttgctcttcttgacctatatggtacaacacaagacacatatcaggtaaagctttatcctatcaacacctacaaaactgtctggcctgtagtcactctgatacagttcagtctcacagtaactcattgccagaaatctctttgaagcgtgtagccattttgtaaagatctcagctctcgtcgtcttcgtctatgctggagagcaagctcttcagggtctcataggtcatgaaggcaatccctacactaggaacaaccttcaggtactcagggactatccctctgtagaagccacgaaggccttccttctgaaagatttggcggatggttccagttatgcttgatttacagactgacgatgtcccagctgccccttgcagttgcattcgtctctttacaagatcaaggggaaatgtggctgcaatatttatagcattttaccaatggaaatgctgtgagtcagtattcagatgacagaagtcatggtgttctttattcaataaagttttacaaaaataagaagaaaggttaagaggagttaaacatggcttaccagtagatgatgcaataccagatagactcccagaaaacaaactaacaactgcaggggaatcttggggcctgaagcacgtccacagccatcagttggaaatgaccaaaatagatactcaaatattattcaaacgagagaaataatgatgtattgatgttcacctttccatttgccaatgagacctcaatgattcatatacagtaaagctgattgctatgctaggtccgactccctgtaacttcaaaaattacaggcagcccaacttaaaaattgacatatctcagtaaaaggttcatggcctaccaataatgtggccccaaggcccttgtacaatcctttgacaccctcatctctacaaatggtagacactgcatgaaagatgcctttgtaatacctggttgttttctgcacaaatttaagattaaatttctagtgaatgccaaatatgaagcctcccaatagttgaaataaagtaaaatacactaagcccgaagcctgcatcatacaaaaattaatattttggagatattaaagatgatgtttaaattcatcaataagcaatgttttatttggaaaaaggatagcattacctgtgttgccaaacgagtacggacaacatccaagggataagttacagatgcagcagtaattcctgccaaaccgccactaagtaaacgagcaacaccaacataatttgagtcttcatcaaggccaggaaccctttggagaaactgcaatgatatttcacatcatttagctaatgataataaaatgcagaacctcatcataattcatgcattaagtgctaacgaactgcttacttttttgtagcgctcatatgaataaaagctgatggcagaataaggtaaacgatgcacaattgtcaccagattgcctttccaaaatgctccaaatccttcttctcgaactattcgtgaagcttcatgccatatgctgtacttctttagagctgccacatctgaatgcatacctgccacctgtcagatcagtatgtcaagcacgtgcaataacaaaccttattcagtagttataatttaatctaataccaggcacagaacagaaataagtagctcgttattatgaagcaggaatcacaaggtttagacacatagttaagcataacaatgccatgcatcaactctgtatctagtaagagaataggggaactccatatggtatcgatttgctgcttttgatgcacgattggaccaactacctattgttgaccaattattttttatacaaagtgaggtgagaacactttatatcatgtatggaagtaatttgagcactaatcagtatgtacaacaaaaataccaaattagatcctttctggcacctttacagtgaacaaaggaatacttaaatgcgcaaaaaacaatatttataagaagctttttcttcagcgacacacgatggtatgttcctgcctctatacaaaccactggctgccatcacattgggaacctatttttttcctataaccctttgaacaataatagactgaaattaaagaaacaaaaggaatacttgccttctgttcctgttagatttcagtccctgctaactggaacgcctacaatggcatgaaaaggattgttccaaactgccgttagccttgtgcgggcacaaattgaggcacgtatataataagatttccataggtgcccaaatctccaaagttttctaacacgctaagaaaggaaaattattcttcagtgcgatattttgcatctaaagttgtcaacataataaatacaaattttaccggagaattgaactagtaagaaaatgtcaatacacgaaaactctgctgccgtttttagcttccattgacgactaacaatctaacagcaagatgcttcactatagtacctcactattacaattcaattcctttcaaggtgcttttgtgccaagcaataagtagcggtacagcgcttataaacaaagaaaagcttccctcaggcttacattttcaccagtcactactcactactggagtactcccaccgtttctgagtgacaaaagaagtcatatttgtcttatgctttctttactcccagttccttattagggcacacaggattccaaaacaacaacacatggtatgctgtactacaattgtactggtttcacccacaggaagagaaatccctatgtgttcaaaagggagactcctttatggtcaaatcatttattaaacacatgttaaagcaacacacaacaaggttattagtaacaaacgtcgtagctgctcgtgccaaccaatccctacatccaaaaaaaaaaaggaggggaggaaacatcttcctccccgaattccacttgcgagacaaggaaaattaacaaaattcgcctccgcagtagcagtagctcccaatcccctcctcctcctcgccgtatccagtacatccacccccaatactgcccgtacggacgaagagcgaaatctcaggcagggaaatgctggggggacgcgctcacctggaagaggatggtgaggcgggcgagtggggcggtgcaggtcttgctgacggcgccggcgaagcccccggcggcgaggtgggcgacggtgccgatgtggcggcggcccatggcggcgcggccgccgtcgacgacgaccccgacccgcgcctccgtctgcatgggattcggataggggtagggctagggttggaatcgaggcgaagcgaagcggctggtggtttcgccgccgcctggaggtgaggtgaggtgaggaattcgaagcagagagagagaggggggggggaaggttgggcgcgtagtgtcatccacctcctcacgtttgttttaccctaccttattttaataatgataattttttttccattattgtgtatgtagtacgagtaagtacatgtttatgtttttttaaaaaaaattttgtgatgtggcacaaatttgagtaaaaactgaaggaaaattttgagttaaacatataaaagatattttgtttgggtattgaaatttattttgtaatgcgtaatatgttgttttttttgggaaaaatataatgcaaatgtgcacgcttatggccctgtttgggggagcttatctcagctgcagctttttccaaaagctgcttctgctagaagctgccccaaacagtccacaacttttgagaatctgtagttatatattctgaaaaatgaactaagaagctagaacctggagaagctgggtttagaactttttcagatcagaagctggctaccaaacagctgcttctcagaatctaaagctcccccaaacaggccctatataggcacacgcagattgttcccaacaatcggcacacgcaaatgttatccatatgaacatcctcgagaaaatagactaagattggcaaagtcaagtcacaacaaatacctcactattgatcgtcattttgtttattactagaaaaataattaattgtaaatacgatcatctgttatgagtcggagactcaagcccacatgtaccaaaaggaatttaaccaacggagcgtttatgtcatgatcttcaaatctaaattgcattcatggagatatactctgtgtgaaccaaatgtcggagcaaaccaaattcggtatatcagtatatgtcgtttaaccttttctttgtacgttgaaatgacttgttggtgcaagctagtatcaaattgatgtagaaaatacgctaaactaaattaatcaagtgtgctgagagttcaccgaatttggcaagataaggtcatgtattgaggacatgtctagctattggctaagcaataattaatgaaaaatgaacacatcattataacttgtatatcttgtccaagttgcaatgtcatggattcatgaaaacagatgcagtaggaagaggataggcaacagcctgaaacaggaaaggaagcctgaaacagcttaggcatttggccgcccctagttttcttcagaaaaaccagctgaaaccttgccagatcatgcagcattgagcatggtcaatgtcacctgctagatagtgtcattgtcacttgcgacggacagagatgcttgacgattgtggattaattggcctcgttaataatgccattataaactctgaatatccaccatacttagttttgtcttgactttaagcaataataatatacttaaatcagtaagataaaagtatttacttttataaagatccttctgtgatttgataagacgttagcaactcgatcacacatgtcattatcaatatttttttcaaatctggattatcaatgattattcgcagaagtgttctctttcaggctagcaagctgtaagcctagcagcgattaagaatgtgactctgggcttctcgatggtacaagaggatcgatcagcccattttgaggcccaaaattcggagctactacgaatttggcccataagtagagaacggataataaagcagttgggccttcggaacgggatactggccaacatgcgggccagatctactctgggcctccgtggctccaagcgagggagcaacagtttccggcccacgatatccgaagcgatgggcctcccggacgtatggaacgttgggccttcactaaggcccaaagtttacaacgcgaacacaaagtccggtccataatccgacgaaggcctttataggacgcagatatttgggaggatcgctatcaattatagcgatctgtcattcttacatttaggtccctatctggatattaactttttacaatcaggtcctcgtcggcctcgtcatcgtcgtggatccatgggctactccgtaaccgcgaggtcgtcggccgctacgccaatccacccatgacttcttcatcgccctgcttccctcgcaagcatattccgatgatctcgccgtcatggagcgggatgccgccgccattttaggcgctcacggtggttgtcggggtctgggagtgggagtggacgacagttgggggcggtaagcagcaaggccacttcacggaggtagcggcgccggaggtggcaggccgaggtggaggcggaggcggaggagcggcggcgccggagatggaatcgagcctcgtgagtcgtcgtcgacggcggcggcggcgagagagacaccgagcccgtatcggtatcagatttaagttgggccggaatccgattccagcctatgtaaaacaaacgggtgaataatcaattaatcatattattcaaaatgtggccgattcaaatgtgaataatccgattccaaatgtggccgaaccaaacatattattcaaatccaattcggactacactaatcgattcctactacgaacggatgaattatcatggcgcgagttacaaatagctaagcgaagctattgttttattgttaggagagcttacaagggatcaaggtggtaataattaattaacacatccacgcacgtacgcgtaagtgtctcactcgtagggcaccatggtgaccacccggagcatggcagtgagggaaaagatgatgaagaggaagaggttgtcaccggtaccggcggcgatggagttggcgctttaccacgataacatcgtccacgtcgcctgccttgtggctgctacctcaccggagccaattgccgacctactcagtctacgtgctacatatgttaacttgttaatataaacttatttatatatgtatatggaaatactttgtatattgactgtgtgtgtattggtggtaaacacgtactgcagctgcaaggccatgcacgcggcggtcaaggagcgcgacgtcgggaaacgtgtgcgctggagaggctagataacatgaagtgggtggagaacgagcgctacctcgtcgccgcggacaacccggacacttgcttcatcatcggtgtcacgctcgtcttcgcacagcaggacatggcccagggccttttcctccttgacaaggctgccaccgcgggccacaagacagcggcctacgtgctcggcctcctcctctacaagtccgatgaggctcgcgccactgggaaaaagtacatcagccaagttgagggcgacggtgatgaggcggcgacgaccgatgccgggaacaagaggaccaaccaggagtgccgacggtgccgaaagatcgctgaggatgccgtccaggaggtgatgtggaaggtcgttaggaggcgtggccaattgctagtcctacctgaggacaaccaccagtgcacaaccatcggttgtggtctggagttgggatgggaaggctacgaaggcttttgcagtgacagttgtaggattaagcatgaatactccaagttcttcacagaggtgatgaactacttgccatagttcccaaacaaccaccagttgtggtctggagttgggatgggaaggctacgaaggcttttgcagtgacggctgtaggattaagcatgaatactccaagttcttcacagaggtgatgaactacttgccatagttcccaaacaaccaccagttgtggtctggagttgggatgggaaggctacgaaggcttttgcagtgacggctgtaggattaagcatgaatactccaagttcttcacagaggtgatgaactacttgccatagttcccaaacaaccaccagttgtggtctggagttgggatgggaaggctacgaaggcttttgcagtgacggctgtaggattaagcatgaatactccaagttcttcacagaggtgatgaactacttgccatagctgtgaagaactacttgccatagttcccaaacaatcagaagacgtgtgaatttagagaaaaactatgtgttttcagcaaattagatttgcatgtctggtacttttaagtaacgagtgcacatggctaaagggaaaggaatgaaacaaagcaacatcagtgtagatgaaaatcacagaatatcctaactgaagcatttccattggttccaacatccaggttcatgactcatgagccattatgatactgccaaaaaacttggtcacgacaacgaccttaaacgcctaaataagcatacattcacaattcatggtccatgtatacttatagaaaggagcggttcacagccctcaaaactaatcttatggcaaggaaatgattgtgttaatcattaattcctaacaaaatccttcagccgcctcagccagatgaggtattctcggctgtccttgttgatcatgtactcgtgtaggaagtttgtggccatgggcgtaatcccgcgcatctccaggtacttgtggaatgccctttgcaggttttcatcaaggtcactgcagcagacaaagggcaaggtgttgaacattagcactcggtgacagtgattagttgaagaatttgagtgttcaataaatttaaatacactaggtttggttttcttacttgaaatcagggccctcatacgtgatcatttcatcttccccactctctgatggcatcacagacaaggcatcgatgaggatctcatcaggataggcagtgcagatgaattcaaggcttggtccctcttctcccttcgagatggtgacagttagaggaatgctagattttggggccttctgagtttcttcctcctgatcatcctcgtttctgtcctcatcagcctcattctcacggtcaggttcatcgccagtcacaagactgggcatggaaactagaacctcaatattctcaccctggtaagttcttgtgagagtaattgaattaaagcccttttcatcactaattttaaaggggaagttgtcaggaatctcctcaacctgtgtcaggatgaaaaagaaaatgaggctctcagacagacagtgacagaaaattgctcctggaaaagcatggaaattgttcaaagcaaagatgaaagtaaaacatagtgttctcagaagaaaaatataactgggagttcaattatttctgaccctcatggtttctttttgcattgtatgtgtacaactctacactaaatcatgccataattaaaatttgatgcaagactagatcaccagaacgagatgcttgatgtcaaaacagcagggattgcaaagtcttatatctgtgtgatagaaactacacttcctttgttggtttttcttctcttcaaacaagcaagaaatatcaaacagtgcatgatgcaaaagcatggatgcttttaggcttggaaacttaggagcataacccaaaaaggtcgttagaacaccatttttccagcccaagtacataacattaaattgaccagcactttaatgcattaagcttatatatgaatacaaaatataagtatgtataatatgcatagagtaatcaagctggcatgaaaacttaaactgtacagttcgagaaaaataatcaggtcccctcaaaaactcaagaaaaaggacagggactagacacaatgattcataaaacaccaacagagttttaagcagcagaaaagtttcaaaataaaagattttagaaaccaacattaatagaataagactacaggggggaaaaggtaataataaagagcacaagaggttataataaagaacacaaggaacaagagcaaaaggaacattgagttcttacacagagaaacacatgaatcattgcacaaaattaagcacagtacaatatgatcaaacacaaaaatagtgccataactgcaaagaagtgacacccaaaatatatttataatcaagagatgttgaggttaaacatgggcatgaaaaagtggaataccaaatatatatttgtaccaagtactacctcagtctcagcagagcaatgaccacgctataaacataataacgctaccaatatatccttgtaccaaaatactaccacacaatctcaacagaacaataagtatgcttcacgctaccaattgcagaaggaagtagaagaacaaaatacctaaaataagtgagtaaataacagacgcccaattcccactactgaaatatactaagaacgtaatgcaaaccagcagatgaactatctaacaaaggcagggctgctactttgattccatccatgctaatatgaacaaaattacagaaaataaaggggattcaggatgccaaaaaaaaaaagaggctcttcttttacgacatacggacagagcgaaatagcaaaattagtgagatcccgggaactcgcgcacgcacccggtcgtggtcgtcgctctcctcggcgaacttgatctcggcgtcgatgatgcggaggagctcgccatctgagctgggcctcgtggagggggccgacgagaagggcatcgagcgaggctgcggccgcgccgcggcggcggcggccagggggcggagcagggcggcggcgccgcgggtggtccccgcggcggaggcggaggcgcggaggagggggagggtggaggtggcggcgcggcgagcggcggcgaagagagccatggcgacccgtgcggcggcgcggacgaaaggttagggttttcgggggtttaggaggagtttttttctggaagatggggaggcgagaatttgtgttgttttaagaagggaattttttttttaaaaaaaaggtaggggcatgggccccacctgtcattctgtcaaaacttggtcagtatgttcattcgatctataagcaatattcttcgcttcttggagaggaagaaaaatagttctgtcgccataacttattagacccgttcctttttcattaaaatttaaattttacatcgattttccttagcaatattttttaaacggctaaatggtgtatttatatgaaaactttgtatataaaagttgctttataatatcaaataaatctattttttatgtttgtaacaattacaactcaattaatcatgtgctaatggattttttctatatcctaattttgtattcattttcagtaaaaacaaacaccactttactcccttcatcgaaaaaacatttctagataggaacctcggcataggcatattcaggttcgagatagaagtttttttttacgcagggagtaaatgttcacatttttgacaaaaatgcaagaaactgtgaaaattcaaggttttgatgtgggacaaaagctattccgtgtgaaatttttgaatcacttttgagaattcaaatttgaaacattaaatttgatggggatttttggttttaccaaaatttgatgaaaaccttcataccattaccattaggagttggaatccggcactcaattgaaaagtnnnnnnnnnnnnnnnnnnnnnnnntgcagtggagcctaactcccataattttgaggtgccaatgactatctccttagtttaactcaatttgatcattccaatttgtaagctagctattcaataacaaatagtattatacatgatgaataaattgcattaatggtacatcaacttaacatgcaagtgcaatttagtgtaaaaacttgagaagtaagcgtggtagcgcaacaatttgatatgtgggtacaatctagtacaagaatctaacaagtgagcgcacggatgcaacgccttgcaaggttggtgtgatttgctataataacataagaagtgatggaacaactaaatcatttcgagcattttttctatactcattttgtttttttacttattttgttaatatactgtagatttctctaagtatacttaatttgtgtcattcaggtaattaaagtatacttaatttgtgttatatggtgggacaagtagaaagggcaaaatctccttatattatgggactgagggagtagtagcatctacgcacagtgacacccttcgccggtgaccatgccaattcttatggacaaggactgaaggacaggggacaacgaacaataagatgaatagatgatgggatcagggctggatcggcggctggccctgcatctgcatgttcctctcttgctcttcgcgcagcttgcgcctcgtcaccagctccatctcttgctcttcgatcagcggccgcctcctctcttcctcctcaagctgcatatgcaatcccgagttaccgccgcgcgactggagcgggtctaccacatgagcatgtgtcagcagagcccataggatcgttataaactcgccgccggtcgccatcctggtggcgtgtgccaccgccctatccgacggggagatgtacagcatcaggttcgcccagaaagcggcgagcaccttccaccgctctctcgtgtcctcgatcctatcgacgaggtacacggcgacactcgcgccctgagacaggatcttaagcacgttcaccgtgtcgttgctcgtcgagttgtccagctcgatcatcttcttcaccttctcctcgtcggagtcgtagctgtagatgatgtccttgcttttctgcgccatctcgtggtccatcactattttcgagcgccccagctcgatcagcttcttgtacttttccccgtgggacttgcagccgccgaggaagtcccgggcattttgcagcgtgccttgaactgtcgacgtgctcctgtacgtgttgtcctgcactagctccggctggaacgctagcaggtacgcgcagtaccctgacaacttcattgcgacctcgtgattcctcgcgaactcgtcgtcggtggtggtagcgccgttctccatgctcagcccgtagtcacagatgctagtggcaatgtgccacttcaggatgtaattagcgtatgggttgccgagcaagacgtcacgatcgaggtccatgtcgatgatgcccttctgatacaaccacatcctcccgtcggtgatgttgccgttgcagttcttgagctcacggagcacggcgtggctcacctccggtgtcaagcggatggagcgagtcatcagccatgagtccagggccttggcctcgatggagaaccatgataggaaggtcttgatccagtgaggatgaatgttgtctaggaggaagtattggccgatggttcccttccagtacctcgtgatggtactgaaatggcacaacaccttgagtgggacctccatgagcgccctgtgccatgactcattgcgcacgtaccgacacatcatcttcaccttgtgccaatcagagaagatgaaggtaaagaactgataggactcgaggaagatgtaccaaacgattaccaaacgggtgacaaggaggtcaaggttgaagccatggatgatgatgttgctggcatctccaccgtctccgggaccaggccgaagcggccggtatcggagaaggtccggggagaagagggtgaataggcttgtcgtgaggatcgcgacatacacagcaaggtcaggagccaggctgttcttgatagatggataacgggcatagaagaaatcaaagaggaacccaagctcggcctcgaccacccggtacgccctatcgaggtcttggtcatcggcgaggagccccttgacgacgaagtcccatgacttgccttcttggaaagggagggcaaaacgaccaacatgatcgacggcaaaccttaacctgagcatcttgaagagggcgaaggacaggcataggtcccgccgccgcgccacaccttgatcccttcgaccgtcgctcaacttcagcagtttccctttgcattgccagaccttctcgacatccaccgtctccggaaccccgtaggctacctgtttgacttgctgcccgaactccaccttctccacctctttgccatcgacgaggtagatgtactccttcatggtttcggggtcatagttgcccttacaagatcggacgccggtgctgctcggtggctcatgctctatgtaatccaacacgacctggttctccttggtgagcccacgggagcgattcgtcgacaggtacgccttgaccctcaaccccaaccgcaccacgctcaagctccagatatagttggccatatggcccgaggcccgatggcccagcccatggcacgggaatttggcccggcccaagcacggcacggcccggtagcaatcgggcccatgccggcccggcatgactattgggccatgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcgccgtgtgcgcccgcatatataagccagcgagcgccgcccctcccctccccagtcccctctcgcctctcgctctccgcctctccgcctctccgcctaaccctaaccctagccgccaccgctcaaccgcctccgccgatccgcctccgacgctccaccgcccactagatctcctcctccaccgtccgccgctcactcactcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccagatccagccttcctcttcgtctctttcccttttgttcttcttcgccagatcccttggtcttctcgtagatctctgagcctatcgtcttcaacggcaactctggtgctccggctgcgcagttacaagcatggaaccatcatttttcttttttttttctccatttccgaccctaaccttgagtgttgttggctgcttgcaggtcgcaagcccgttgcttagcggcagccgccgttgagggaccagagtgcctgcgatggacgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgccgactggctctagtgcgacttgtaccaacaagaagaccaaaacctccaaggtatgggatgactttgaggaactttatgaaacgaccaatggtaatagggttcgagtctctgctaaatgcaattactgtcataaaactttgagtgctcgttcttctgctggcactggacatttgcttaggcatattaagtcatgcaaacctagaaagcttgggtctaatgctttgcctcagtccatgcttagatttagtgcagatggttctgttattccatgggaatatagtcctgaagttgctaggtttgaattgtgtagattgattgctagagaggatcttccaatcagttttggtcaatctcctgcttttgtgaactatattaaggttgctcataaccctagatttgttcctgtctctagacaaactactaccagagatttttataagttgtttaaggatcgtcgttctgttattattgatcgtctcaattctgctagctctattgctttgacatctgatatatggtctggtcatgctaaggaagattatttgagtgttgtagatcactttgttagttctgattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatggacacccttactcctgctctgtctggttatattggtgatttatttttgcatcaacgctgtgcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattgggcatgtgctgaatctgttttgtgtttccttgaacaattttatgattcaactgttgttttgtctggtgtttattatccaacatctccattaatcatgcatcacattttagagattgctggacatctaaacacatatggcaatgttcaaaaccttgcaaatgttgttggtcccatgaaaactaagtttatgaactactggtctaaaattccaattctttattcatttgcatttatcttggaccctagggccaagattagggggtttagtaaagtgcttcagattatggctcaactcattggtgatgattactctgcttatttaacaactgttagagcttcattgtctgatacttttgctaagtatgaaagaaagtttggttctgttagattgcatagttccactattccaggcccttccactggtaagaaaaggactgcatgggggaagatttttggttctgttgttgctgctgggcttggtgctggtaatgcaggtgccagtccaggtgctggtaatgctggtgccagttcaggtgctgggcttggtgctggtaatgctggtgccagtccaggtgctgggcttggtgctggttcattatccaggatgacatctgctactgctttgcttcaggcagcttcttcaactgctaatctcaatccttctgaactgtctgcatatcttgacagtgacactgtcaaccaatatgatgatgacttcaatatccttagttggtggcaacagcacaaactaacttatcatgttctttcaatcttagctaaagatgttatgactgttcctgtttctactatatcgtccgagtctacttttagcttaactggcaggatcatcgaggaccgtcggcggcgtctaaaccataggctggtggaaattctggcagtgatcaaggactgggagctagcagatgcaaaaagtcagcatactactgagaatgtggagcttcaaaatgcttatgagaatatgtatcttgatgatgaaattgatgtaaacccttgaactggatgattgtaattgatatgaacattttagctatgggctgtactcttttcctttctagggttttctcacgaggtgtgtgtttttacctagaaaggtttttaacgaggcaccattgcataatcacagcttatataaaccccttttatattctaactttctgaggtttgtgattctaagatggacttgatggaaaatagtagatgacttgatgtatgcatttgatgaattgatttgaactgattgtaaatctgtgagactgtgacttgatgaattggtgacttgaagaattgttcatttgtttgtaaatctgtgcttgtaaatctgtgacgtgatgtatgcatgatttgatgaactggtgacttgatgaattgtttgtgattctttgacttatttgatgaattacatgtgaatttcatgaatttgatgtgttatgtcaatttgttgtgttgaattgaacctttgaaggggtttttttgccagggcgtgcctaggccggcacgggcacaatgggctagccgggccgtcgggccagcccggcacggcccgaggctacttgggccgtgcctgggccgtggttgtagcccgtgggctggcacggcacggcacggcttgttcgtcgggccgtgccggcccgactgacctcggcccaggcccggccgtgcctgggccgtgccgtgccgggcggcccatatggccaactatagctccagaggaggaagaggctgacgaggaaggtgccacggagctggcctttgtagtagaggatgaggaagaggaggtagacgacatagagggcctggttcatcatggacctcgtctgctggctgctgtcgttgaagctgaacgccgtcatggtgtcggcggtgccgaggaggaggaggaagcaggcccagacgacgaatagctcgttctggatggacgactactgcatcaacccgattgtgtaggagatcaccgggtagttgaacatgaaggctccccagacaaggagcctaagtagggcgccgccgtggtggcgccgcctcgagttggataggacaaggacgctgacgaggaggtagcccactgtcactaggacctcgatcctcgccagctgcccggaggagctggaggcgaactgcttcccggcctgggtcgcattcctcgctgaagcaacaatttgatccatggtggtgtagaagaaaggaagcaaggtcaaatggaggagatgagagaggctaatgatggagtggtacagagcattggcgtcttggagtaggcagtctctatataatcgtcatgaataaaactggacgctccgagaagaccgcatcgaccgcctcacaccatcgtggagaaagaaatgactagagccaagtcaatatctatatgcacatggagagacggtagagtcaaaactctcatcaaaatcaaatacgaataaactacatcgatttacgcatggccagctttatatggttgattattgcacgcaactcgaaattaatacctctcaagcatggtaaaatttttcatatgtatacacatgcgcatccacctaatagggaattattctaacattaatttctttgtggatcaaggagttgaagacggtgctgacatcttgatacataattatggagtaaactctattgtcagttcttaaaattgtattgggatgtcactttgatccataatgttatgaattactcacctagatttgtaatctacgtttaatgtatcacagcattcaaacatctttgactaagaataactacctcttggttgttcgatcccggtggccgaaacttcacatttaggctttccaggtaaccaccgtgacaacaaattaaatttgcatatagtcccttattactaacattgcctgtatttcgctggtgagcgtgccgatggtgtattgcaggcttgcagccaatattaatagtggtcagtcattcccaaaaaaaaaaagaaaaaaagaaaaaaaagtggtcagtccacatctcaggcttcaccattggtgagagaaatcccgtacgtcattggtgatgatcgggacctaatgtatgatgctgcttcccgcgatctgtgagtgagtacgagcaattccaggagatggaatttttagaaaaatatactgtatattttataaatagaccctagaaaatttattacacgtatgaacccctaactcggcgccaaagtggagtgtgctgtaaaatttcaggaagactaacaatacagtatattctaactcatttccaataatttatttttatttatcaagacttaacctgggaagagatttttgaaaacaaaaggaaactcaacaaattaggtgcactgaatcatgatatattgatttgtgaaagaaccttctcaaatcatccagtgagccaggtatatgcatcagaatcctccaatgagccaagcatatgcatctgatctgcccacaattgtcattatactatatgattagcattcctccatgcaagccaagttgccaacggagaatcaaggatctaacaagttccatcagatcagggccggccctgcttgtgcccttttatcttcctcttcttcaagtagaataggcaatcccggggcaccgccacgatgttgaagcttgtctactacatgggcatgtgacagcagagcccaaatgatcgttacaaactccccgccagtggccatcctcgtggcgtgtgcgaccgccctatccgacggggcgatgtacaacatcatgtttgcccagaaggcggcaagcaccttccaccgcttcccggcatcctcgatccgctcaacgaggtacacggcgatccttgcgccctcagataggaaccgaacattgtgctccgtgtggtccaagcgccccagatccatcagcttatcatacttgtcactggcggactcgcatttggcgaggaagtcgcaggcattctgcagtgtgccacgggccatcgaagtgctcgtgtacgtgctgtccgggaccagctccggctggaatgccaccagcagtggtgtccatgctaagcccatagtcacatatgcttgtggcgatgtgccatgtcagtatgtaccgtgcaagacatcacgatcgaggttcaagtcgataatgcctgtccggtacatccacatcctcccgtcggtgatcttgccatcgcagttgttgagctcacggagcaccaccggcatcaagcggacggagcgagtcatcaatgatgaatcaagggcctgggcctcgagagagaaccatgagaggaaggtcttgacccagtgaggttggatgttgtcgaggatgaagtattggccgatggtccccttccagtacctggtgacagtgaaatggcacaacacctttagcgggacctccattgccatgactcattgcgtacatatcggcacaacatcttcaccttgtgccagtcggagaagataaaggcaaggaattggtacgactcgaggaagatgtaccagacaatgaccaagcgggtgacaaggaggtcgagattaaagccatggataaggatgttgttggcagcgttgctgccaatgggacctgtatcggagaaggtctggagagaagagggtgaacaagctagtcgccaggatcacgatgtacacagcaaggtcaggagccagggtgtccttgattgaggggtaccgagcgtaaaagaagtcaaagaggaacccaagctcagcctcgatcacccggaatgccctgccgaggtcttcgtcattggcgaggagccccttgacgacaaagtctcggcacttgtcgtactgtaaagggaagttgatatgaccgacatgatcggctgcgaaccttaacctcacttgtggacacttttcgacgtccaccgtctctggaaccttgtacgacacttttatgacctccccattgtccaccttctccacctcctcaccgtcgacgagatagatgtactccgaggagccaccttgaatgccagcgctgttgagcggctcgtacttcatgtactcgtacaccacctggttctccctgatgagcccatgggagcggttcgttcataggtacgccttgaccctcaagcccagccgcaccacgctcaagcaccagaggaggaagaggctgacgaggaaggtgccgcggagctggcctttgtagtagaggatgaggaagaggaggtacacgacgtggagggtctggttcatcatggacctcgtctgctggctgctgtcattgaagctgaacgccgtcatggtgtcggcgctgccgaggaggaggaggaggaagcaggcccagacgacgaacagttcgttctggatggacgaggactgcatcaggccgatggtgtaggagatcaccgggtagttaaacaggaaggctccccagacgagcagcttgtgtagcgtgaggccgtcgaaaccattcaatcagtttttaaacggattgaaatcattcaatggtgtattgtcatgaaaccattttttactaggctttagcgggagaaaccaaagtttgttgtcatgaaaccattttttgaaaagagaggctggccgcacgaagatctctgctccctctgccaacgggaggaagaaagctgcttgcatctatttgtaaaatgcgacttcactagacgagtatgggcgctgatgcaaggatggattggcattggcttcttgccgccgacgatcaacgactcaagcctggcagaatggtggatgatggcgagaaaatattttcggatgggctacaggaacatcaatatgaatctaacaattacgtcaatatgaatcttttaagagaatcaatatagactttattatttgctaatgaaaaagaaatgatatacacctacgtaccacatgggaaggagctgacaccatcgtgatgagcaaaaataacaaagactaacagctagctaagtcttctaaacttcattatttgcttaagaaaatgaagtgatatatatacacatctaggggcgagcttcaatttattcgtggatcaaggcgctgatcaattgctccctccgtccctaaatatttgacgtcattgacttttttaaatatgtttgactgttagtcttattcaaaaaatttaagaaattattaattcttttcctatcatttgattcattgttaaatatactactactactcaagtttttgaataatattcacaaatgtttttgaataagacgaacaatcaaacatatttaaaaaagtcaatggcgtcaaatatttaggaatggagggagtatttgcttacggccaaggccgggatgttatctattccattatctaaaaagttttgcttacggcaagaaaacgattgtgctaattgttacaggctaacaaaatccttcagctttctcaaccataggaggtattcttcgttttccttgtagatcatgtactcttgcaagaattttgcggccatgggtgtgatcccacgcagctccaggtacttgttcaacgccttttgcagactttcatcgaggtcactgcagcagacagggcaaagcaaattgcacataagaactcggcgattaatagttaagaattaattagactgctcaataatttaggttttgttatcttactcgaaatcaggaccctcatctgcgatcatttcattgttgtcatcctctggtggctgcatcaaggacaaggtgtcgatgacgatctcttcaggatgggcagtgcaggagaattcaaggatctgtccatctccctttgagatggtgacggtgagaggaatgctggatttggagggaacctgaatctcttcgtactcagattcatcgctggtccatcttttctcacatttgaccttggcagtggcaggctcaggttcatcgtcactctcaaggctgtccatggaaacctgaagctcaatcttctcaccatggtaagttcttgtgagagtaattgcattcgagccctctccataattgattttaaagaatttaaagattttaaagggggagttattagggatctccttggcctgtatcagtatgacaatgaaaatgaggccctcagtcagacagtcacagcacattgctctcaaggagagcatgaaaattgttcaaagcattgaacttatatatcatatataattgcgcagagtaatcaaactggcatgaatgtatagttcaggaaaacaatctggttatgcataatcgcagagaaaggtacaggaactagatagaatgattaaaacttaccagcagagttctaagcggagaaaaatttcaaaataaacgactttagacatcagcactaatagaacaagaatacaggagacaaaaaagtactacaattcataaggcacaatagcaaggcatattgaattcttatgaggaacgcacaaaaccttacacaagaattaaacaaggcacaacaacaatgatcaagcactaaaatagtgcagtaactgcaaataaataacaccaaaatctactataatcaagagaagttgaagttaatatgagcatgaaaaagtggaatagcaaatactccacatcattgtaccaaatattacctcaatctcagcaaagcaattgcaatgctgtaaacatgattatgctaccaattacagtatgaaaattactccttttctttaaaaacaaagttaaataactaatcccaatccctactatagcaacatagaacataacgcaaacaacatatgaagtacctaacggcgacagattgcttaagtttatttcatggtaatatataatacgactaaaatcaaaacaaacaaaggggattcaatgatgtcaaaagataattctctgatgatagagcagaagatcgaatagcagcatttgatttagtgagattcaggagctcgcgcgcgcacgcacccggtcttggtcgccgtcgctctcctcctcggcgtcgttgatcgcgttgtcgatgatcctgacgagctcactgtcgaaggcgggcttcgtcaagggggccgacgacgagaacggcatcgagcggggctgcggccgcgccgccgcggcggccagcgggcggagcagggggagggtggatgtggcggcgcggcgagcggcggcgaagagagccatggcgacggtgcagcggcggatgacgaaggttttagtcagggttttgggggtttacgagctgtggagaattggagatgaggacgacaatttatgttgttttaatatggaaaaaaaaatggaaaggaccattctgttatcaatcatgtttgtttgcttcttggagaagaagaaaaaaaaatcgattatctaccaaatatcgttatccgttaattaaattcaatcaagaattgttgtccattagtatagatagttaataaattcaattgttcttttacggattttctctttacccccttgctttgctcattatctaatcatcattgtcattatcagactatattactacctctattcacatgtttaagcattcctagtagcggtttaagttttgaacagacatccatcgagtaatttcttttcacatagaatatcatttcagccatcacaattcacaattccacacaaaattcagataagcagcaccaagaaacggtaaaaggctagtaaaataagcactgatatcataagtgccaatagcctcagattgactactgggcatcagaaatcgcacattgcagggaaggcagtttccccggttgttgcattgcttcgcataattctagtaatccttgttacatatgcaggtatgctaaaaggctaagctaccaaaaatcctgccaaattgctcggcaatttctcattgccggacgaagtccttcagcttggtcatccacccgacgtactccttggtttgcttggtcaccatgtaatcgtgcatgtagttggtggtcggcagagtgatccctctttgctccaggtacttgaataggcccttctgcacattcaccggtagctcgctgtagtagaaagaagcgattcgatgaggattatgagtagagatggtgctcaagaaggattgagaaatggagattgaaaccggtgttcttacgtgaattcagggccctcgtaagggaatttctcatctccttctgtggctgcattctccactattaacatgtcgtcgatggtgatctcctcacgaaaggctgtgcaggtgaactcaagtttgggcccagagcccttggagactgtcacctttagagacacgctgctatctccagcgctctcgtcttcctcttcatcttcatcatccttgctagcattcttgccctcaccctcggcttcttcgtcgtcaaactcagggcccccttctaaatttggcatgctgacaatgacctcaatcttctcatctttgtagtcccttttcagaataaccacactcatcccttcttcgtcaaggatttcaaaagggaagttttccggaacaggttcctgttgcaagaaagataaatgggtaagatgaaacacctttggaatattcaataacagatgttaaatgccttgatgtcaaaccagcatgtcaattttacagctagatgtcacacctgcagaggtaattttacagctttgatgtccattcattcattcacttttcagggttatgcggaaaggattattcaacctcaatgccagttctaatattgcccttgcctggagcttccaattgatcaaaatattgaacccaaaccatcacaaactctatcatcagtcccactatttgtctattccaaagtcataccgctttaaaagaatcattagaatggttcaatgatttgaaacaaggaaaacgcttaagaaacgatttgcttacacaagggtataagacttctctccagacattcaggtcaaacatgacaaaatagatgcaagaaagttataggatccttgaaaaccagatgagcattgcatagctgacgcagggaataaatctaaagtcttaacaactctctgaatgccagttgcaataaacaattgccaataaactatcacttaaagaattcagacacctagactaatggcttaagataaaataaataaatagaagatatcgatgcatgagtaagatgaacaaattctctattctctaactgccaccagcataccgaagtaacaatacgtcatcagtcaccaattgatctgtattaagagagaagcgccgaacgagactgcaaaagtaatctattttaggtgaaagcaatcgtaaatatatttcccaattgtagtgttcaattagctagagatgcccattatttatcaaccagttaccagtcgacgtgtagcattcacgcaagacagcactataatttgacaaaacctcaccaaaaattcatcatccccacaagacaaaatcactgtccaatatgacaaaataatatctcatttggcgcgccaaatcagtcaagtttcgatgacagtagtacagtatcgcgcaagagaagagcgcgcgtctcactctcacctgctcgtcgatggcgaggtagtcctgcgcctccctgatctccgcgtcgatggctccggggaggttcccggcgccggaccccttcttcttcttcgccttgaccttgctctccatcaccacctgccccgaagaggcgctcgacccctgcgccgccgcgcgcagggaacccgcgagcggctgccgttgcagcgagagcaagggtgttcctgcgcgggacgcggacgagacgccggggaggaaggcggcggcggcggtggcggcggcggcggcggagacgaaggccatggcgaacgcggtggcgaagcgaaggagagaagagaggagaggggaggggataagaaaagggaagaggggttttggatgacgcttatacctaccgtttagtgggacccatctgtcgctgacactacttgcctcctgtcctctttcaacgatttcgtttttacaaaaaatcaacagaacttgcgtatgggtttcttgtgcttgtgaaattaattctccttctccaaatggtctagcactatgatttgatacaacatctgaagctgtgtttggctcttgtagttggataatccctcgtgcatcattaattaattattaggtttttttttaaaaaaaaagtatataaaataactttcttatataattttttcgtgaaaatatatcgtttaccagttttagaagcgtgcacatagaaaacgagataaaaaagctaggaaaatagatttttttttaaaaaaaaaagaaaatagagagaagaaaacaacatttagtgtagtgcctggatcgattttcatcaaagaaaggaacagtcaagcgctgcatgacaattaaaggatcatcattgggcatcaacaagaacatttaatttacaagactttgctgtgctacacattggaagcaagtgcttagattacatatagtagtaaatagtattatgcatgtttaattactgtttctgattctgattgagagcctgcaatttggcaggaacaagatcgagctactatacaaacggcagagacagagacagagacaggggcccccatttgcaaggcctttcctgtcaattcatcctgcctttattattatcgattgataattccaagataagaaggagaaaaagaagaagaattaaaaacgcgggaattattactgtaattaataatcctccaagagaagagacgaccatgacatgacatcacaggagctgggcgtcgcggctggccggagaagggaagacgggcacctcggcgaagcggaggcggccggagtcggccgcgccgccggcgaggcggacgtagtagggcgcccgcggcgacgccgacggcgactcgttggtgaacgggttgccgatcggcgtctgcccgccgttggcgtagtggacgatcgccctgtacaagaacggcagcaacccctccatggcttcttcttcttcttcttcttcttcttcttcttcttcttcttcttcttgccaagcaaaaacaatggagctaagcaaagcaagaaccctctctacctctgtctctgtttggtggtgcaactgcaaaggataaagaggaagaaagagaggcgtgtgggtatttaagggcacaactgcagattagtataataaggtgagccttgagattttttttttgactaaactaatcaatgctgattagtggataacaactggcttagctttgctcagctaagctactagctagctagcacaaggaaatggtcaaatgagagagccacatcaattggagaagatgatgatgggatgcatgcacgcatgcctgtggacttgtggataggaaaatggattttttgtaagcagaacaaagatgctgtttacacttcagggggacacacaaggtgcattagttttttgtgatgaaacagctattggaatttaaggtgtcacacaggaacaaatcagggggcaattgggttttgtggtgactgctggtttctgattggaattaggtttaaaataggacagcttctgctgattctggtctgggtgttaggggagggagaccaatcctatataatcatataaagaatatcaatggctttgtgcttgaaggaagggaaagccacaaaaaaaaagggaaaaaatgatgcacagatgtggtttgaagacaagggacatcttacctgacctcaaaagggtatattgtaatggagtttgttgtgttttccctcttctttttctgtgtttgttagtgaagcttgcaattgaggcctcaactaaccctataattaagacaaaaaagataaaaggctaaatccgaagtctggtgaaccatcgttctcaggtatcccaatagaaagaattgggtcgactttaagcatcatccaagtcgtgagaatgacaccctactaggtcagagtagcagacaaagggtagatatatattttttctctctctcttgaactgagtacattacaaactgctcacggaactgcagctggttcaccaggaataactgtaacaccaagaagaataacagggtacaacagtgtgaagttcttacatatatatcctcagggcttcaatttgcacctcttggtaacacataatttaactttccaggaagaattttctagcagcatgtggcaaatctctctacataagctacctatgctcaaggctggctggctcttaatgtgacaattcctccgtgtaaaagaagcgcaagtcaacgggggtaaacaggatattgcttacaaaaccggcgaggcaacgatccaggtttcatggatacacatcacctagatcagaacacgcctacgagctaagatggaagatttgacagtctggtttgtatttgttcttggaagcagcctgctcaaacttcttcaatggcccttcattctctctcaagccagtctggataaagtatcgcgaccaccacgaagaactccgcaactttgcctgtgaaaaaaaacagtccatgtcaccaaacttctagccttcgatatagctcaattatttatattgtgttctagaaaatactaatgcatgcataacatcaaacaaatcaacggttattccattcctctccaaacaagtaaccatcaatagcattaatggacagcctaacagactaagcaatactagtcaataggcaacagcatatttgtaactgccaacatacagaatgcaattgaaattatattccatgatgtgatatactcatatactactgtataatgaaaagaacaccatacatgcaacatcgctacaacatcaataaaatgctaagcatgaatatccagaacatcggtaacctattaaaagcataaaaccattctacaacttttataagctgcctttctggatcatggacatggaatgcgtcaaatcaatccttttgtgtcagtacggtactggtcttagaggtcatat

SEQ ID NO: 58119 - DNA, 662 bp, Oryza sativa
caaattcatatacgttgttctagttattttaaactaaatacttttaaaattattgatagtcaagttataaaagtttgattacaaccttatccaaaacgtcaagaattataaaaccgggtgaagtaattatagaacttgagtagttttgcgagcggttttggtcctacatgacagtttaatcaacaattttcttttaagaaaatatgggacccacctttcagattctatctactgatctgtatctttttcccctctcacctctatctctatctctctatccctggctgaggagtcgcgacggctacaagcctactcttgcgcatgctagcggaggcccagtaggagcggcgatgactacggggcttctcgcgcaagtgcccgcagagactgagaatgagaagtgtgagtcctctcgcatgcgccggaggaggctgagaacgagtggcacaagctacggggcatcttgcgcacgcgctggcagaggccaaggaggaactgaggtggctacaagcattctcacacacgacaatgtcagtgtgcgtggtggtggagatgacgtggccaaagcagctttagtcatgaagctcggcgagacgtgctacggcatcactacctgggaggatgcgacggagagggtcgcattggtgcaagttcgctgcttc

SEQ ID NO: 58120 - DNA, 960 bp, Oryza sativa
caaacatgaagctacattttgaatgaggcctcgtttgaatggaaatttgaaaagaatttccggcccatataagtgggtgggccaggacttcagcccatccaaatgtggcgttgtagcctccgtgtactagcacggagtaattgccgcccaccgcccgcgtctgctcagctggtttaaatttgaatccggcgagcaaaccaataactcttccctcttcagtcttcgctcagactcctcgccatttgagccatcttccgttgagacgtgtaagctcgaatctttcatcttcccatctgatttcgccaagttgtttctacaaagatttgcttgcgatttcttttgtcttggcagattcgaatccgggaacggaggttggaggttactgagaaccagttcgacgaggaggcgcgcgcagcctgttcggcggaatgctcgggaggaacgccatgctcgggccgccgcgccgtggcgagggggagacgtcccggcgtggagagggaagcgaaggcgacggcaatggcgagggcgacgcggttgaccggctcagcgccctctcggacggggtgctgcaccacatcatgtcgttcctcaaggcctgggaggtggtgcgcacctgcgtgctctcgcgtcgctggcgccacacctgggcgtccgcgccctgcatcgacctccgcgtccggtacaatgacgttgacagcgagccgccggaggagctgcgcgatttcgtgaaccgcctcttccgccgtagggaggcgtcagcgccggtggacacgctccgcctgcagtccagcgacccggacgagttgtttgacaacgacgatgccaacgcgtggatccggactgccatcaaccgcaatgctcgattcattcatctcactggacaccgtacagagatcggggtgttaaagcacagggccttggtctctacccacctcaagatcttgaagctgtcctatgtcc

SEQ ID NO: 58121 - DNA, 6062 bp, Oryza sativa
ctaatcaccatttcaacatgctgaagaaacagtttttcttttaccactcacctggtctctgggtgtccagttagcacatctgatacttctgcactgcagtatcaattaacaatagctactagtggaggcattctgggtttcccatcatctgtcttaggcattcaatatactattaaaaccctcaagtttgcagctttgggaaagtattgttcttatcttttgaaatagcttgctgttttttgttgtcacaataatttatcttttgacattagttaagattcccatagaaattcccatctgtacaattttgttcaagaaaatacactttgtaggagtaggtgataatctgctcacaatatatcactaagttattgtttttattctcaatgtattgaatatcacttgtatgcatgatgtgaagttgattcagtatttcaattaccatagttcattgctgaaaaatcacttttgtgcccaatatgaaggtggttctttctagggagttgaaaagctgcccaatttttagcaacttgaagaccttgtcccttggtgaatggtgtatggctgctgaattcgatacattaatcttcttgctacagcgttcacctaatttgcagaggcttttccttaaacttaaattggtaagttacctaacgcttataaagaggtatgaatatgtatgatagtttaataaattccattgttctgcaaaaagaacttcaatactaggaagccgttggagagcggtgctaaacctatgggaagatcatttacttgtaaagacctgcaaatggtgaagatcagatgctctaaggatgatgtaagagtgcacacactggcatgtttgttcagagcgaacggtattcccattgagaagatttatgtccgtcggactgggagttcttgtaagttagatggtttcttcatgtcattttgtatttttttttgcactatcagtgctaaattacccatgtctttgctgtttagttcaagcatgtgctaaattatgctcgtctatgctgttttttttttaaagatgttctatacatattgccatgttcccaataggcttgatatcttaccaggcttttctgttaaaacaccctaaggctatcctgttcaattaaacattgtgtttttgggcatgatcttaatgtgtgtacttacccgctttctgatatttctaccagacctccgtggcgagaagtttatgagagacctaggcaaacatgaactggagttctgggggtcagattcagagttctgtggtccaaattccgagttctgtggttcagattcagagtttgaggattcagatatggagttctgatgcaacattggactagctatcgtttatcatatcttctactcatattattagttattatctttggattgcaaccatctctaattaatgtactacttagaaaatgctctgacggcaagaacccattaagtaccgagttgcagggccgtgacagatgttgttatgtgtcttttgcgtaatagggaactatgtatggctatccaaatactgaaatgctcttatccagtgcaatgagttaacagtgaaaatgttttgaagttttttttttatatatatatactataaacgtgcatgaatgctctttgcttgaatgtctcaatggattacatgcacctttgctgcataatatgcactattttgtgcctgagacccgcttttttgaagatttaccattcatgtctatttcctattggaatggagtcatgtagtaataatgtccagtcgaagccactgtcatctttacctctatttgctcctttgcacccatatcagctttacctgtagcatatactattatttgaattttacagttcagtagacgtcgaacgtggtgcactacaggttaaagcaatgttctggccttctgggtgttgttaactcagaaaattccatttaactaatgtttctgctgtcaccttttattgtaaactgatgagttaatgtttgcctgagattaaataggtgatttcaatgtctattctgaactcgttttgatcttatttcgtgtgtattagaaaacgtattcaattttctaatggattgttagttgttacaacagtagatccaaaaatgcaatatttgttcatcccatgaacaatagcttatactgcaatgggatattatttttagttccaacgaaataaaactctctcctgttataaatttcatatttaactagaaaaaatgcatgtgctttgctacgggaaaaaaaactcatttatgactctgattgtgtattactcacttcatccaaaagtcttacgtgtaacttttttgtcaccaggactaagcagaaattaactcatctctcatgtaacaaagatcaaatgtttaataagaaacactgttttccaagcatgtgggagagcgccaagccaacactgttttccaagcatgtgggagagcgccaagccaccaaccagtaaactgattataaatgtctatactatgaaatgggaatttatgatcagttttataactaggcttataattatgtttatatttgaatatttttaaaaataaaatcttacggtagtttttcagcgattcttatctatgagccgacgtggcattgctgacaattttgtaggcaacggcgtcaatggagtccgtaccaatatggttttcatgtatggaacggtctgttattgcactggacataaacaaaaatcggaaagtgtgtgtatcatttcctatgtattaaagaatatatttctgttggtaaataattttatgaatttgcacatagcatctactgtccactaaaaccacatacattctattgtaatgcaagtaattttaatgcacaaaaataccctttgtgtataaaaaaatagtattcactcatctgaacatgttaattagtctgggctcctcaaggagagataatatggagagataatctcttatatgccactgaaaattagtctaatcccttatatgccactgaaaattggctcttcccttatatgtcataggtccaaacttacacatcctctcatgccactctcgtcagatgactgtgtgttgaccattaactttaaagtaaaaaagacgtattttctgatatataagggatcagactaattttcaatgacatataagggattatcccaaccaaataatgtagacaacgtagagaggctgagaagtgggccaacaaagtgcatttgcaattagtttctttcatataaggttactactataaaagattttgagaaaaataatgattaaaaaaatagcagggctgaaatataagaagtggagggctgaaatgaaaaaaaaaaactatgtgagacggtgagagggttagccttcattgtagtttgtagagctaggatattcaaagtgctcccatcctatttttttccacctaattgggcctttctcttctctgtccccattaactagtcctaattatctgtgtttttttcccacttacagaagaggatgaggcgtcgggatggcgagtcatatccggagtttttccccctttcttctcactccaactgatgagtggacgaagcagacgactctctccctcatcggagacctcatctgctcgcgggagtcggatctgttgtgctggagtcgaagagctcgccagcggtcaaatccatggtgcggattcaggggcagcgtgagcaagccaggctagctccctggtaggcccccgtccctctcgcctcactctctcttcctccgtcctagcctaaattgggcgcaagtgatgcggattgagtgcagccgcacccaacgggcctttcacctcatttgaagaaaacatagcgatttttatcttggttggatcagttcctatttatttttgattccgtgagattatatttgattacgcatcttctatgacttgatttcttttaatcttattcttggattcgatttcagttaccataaacatgtttctaggtccgatttatttacaagataggattattttgagggaatttgggttgcatctgtttgtttttgtgttcatgctttcaagtgacttttgaggtgagacggcattgagacacgtgcggagcatttgagacaggtgtgaagggcaacaacgtgccaacgtgagggaagcggaggctcacaccgtgacggaggaaagcggactatcacggacgaaggcgtaatgtgaagatcagaaacatatgaattttttaattagttaagactagaaaaaaatacccgtgcattgcaacgggtgaaggttattttattcttattatattatacggtttagttaagatgaaattcactttgggaattcgctttaatatataactttttagaaaatcgtgaactacaattaagagtccgatcgtctcaagttagcgtgcgagttttttttataagagatttcttatacgactccttttgtattttcaaaagcgaacgaacttaaaaaccgactcatacacagatgacgtaccaaagtactagcaaaaaatatttttaatttttataatagtagagattagataaagatatttgtaaatttctactctacgggcctatttggttctctaccctacctatttattggtagtgccaaaatctaggcaaattttggcactgccaattttttggtagggaaaagttaattagactacttttggtttaataccaatatggagccaaattttaatagtatggtgaagaatattctagaatatgtccaaattgagtatgggcactatcaattgtttggcttcaaaccaaactagcatatttactatttaaattaccaaaattttggtagggcacagttttggcttcaatccaaaacggtcctacattcggtctcaaaactgacataagtggcgacgtctgggcgtaatttgaatggaaatttgaactaatatggcccatatacttacatggatgggccagaatttcagcccaacccaaacgagacgttgctggcctccgttcagcatggagtagttgccgcctccttatgctcggtttgttgtttaaactttaaatttgaattctgcggaaaccaagaacaccatttcagccatcttcttccttcgagagacgtaagctcgaataattcatcttcctcttttgatttcaccttcacatgcaagttgtttcctcaaagatttcctcgcaattatttgtcttgataggttgaaatcgaagaatggaggttggaggttactgagacctagttcgacgaggaggtgaaggcaacctgttcgacggaatgcgccgggggaaagccgctctctggcggccgcgccatggcgagggcgagacgtcccggcgtggaggcgacggcgatggagaagcggccgaccgcctcagcgccctcccggacggggtgctgcaccacgtgatgtcgttcctcaaggcgtgggaggtggtgcgcacctgcgtgctctcccggcggtggcgcaacctctgggcgtccgcgccctgcgtcgacctccgcatccggtacttccgcctcgacagcgagccgccggaggagccgcgcgatttcgtgaaccgcctcttccgccgccgggaggcgtcggcgccggtggacacgctccgcctgcagttgagcgacccggacaatttgtttgacaacgacgatgccaatgcgtggatccggactgccatcaagcgcaatgctcgattcattcatctcactgggcaccgcaaagagatcggggtgttaaagcacagggccttggtctctacccacctcaagatcttgaagctgtcctatgtcctgatcgatgacaagatcctcaagcagctttcttcagggtgcaaatctttggaagaactggatcttaaggactgcgtgatgaccggccatcagatctcctctgcttctttgaagactttgaagatggataggtgcaagatcaatgtggacctctctatcactgctccaaaccttgtttttctgaacatagtcacaccttacatccgagttccatcgttcaagaacttggagtcgctggtgacatgctctatcatacttgatgaccttttcttgggt

SEQ ID NO: 58122 - DNA, 2229 bp, Oryza sativa
tcacaacctttcaaatgttagaagtttggaactcttagctggtgctggagaggtatagtcttttcattatgttgtatatgtattttgttttcttcaatatccagcccttttgaacataatgatatttttctgactttttccaaagaaaccttttccctttcaccagatatctggttatccagtgagaacatgtgatacatttttttgctgcagtatcaattgattaaacctacttacttactcatagcattctatgattttccatcatccgttgtgaggcatttgattggcaactaaatctcttgagattgcagctttgagagagcaatgctcttagtcgttcaaaaaaagagagagcaatcctcttagttttggtgtgattgcttgttactttttgttgtcgtgatagtgtatcttttgacatcagttaagattcccacagacaatttcgatctgtgtatttttgttcaaggaaatacactttatgatatactccctccgtcccataaaaattgcatttgtagctccaaggctttgtcccacaaaaattgtatttctagtcatatggggcccaaccaattgattcatctatataagttttcttccatcccacgtaatttgggctgctaatgcttgcaattttattaagtatgctaattatatgggttaattctctcaaacttccttttaatcatttgtatatatggaatgtgtgtatgcagtgggttcattaaataaggttattgtggtcatttttcaatcatactattttgtcctaaattagctagaaatacaatttttatgggacggaggtagtagatgttaatccactgtcaatatatcaccatattattgttttcattcttgatgcacattgaatatcatttgtatgcacgatgtgaggttgattcaatcattatagttcactgatgaaaaagcacttttgtgtccaatatgaaggtggttctttctagggaattgaaaagctgcccaatttttatcaacttgaagaccctgtcccttggtgaatggtgtatggatgctgaattcgatgcattagttttcttgctacagcgttcacctaatttggagaggctttttcttgaacctcagttggtacgtctcctctgacttatatgtagagttccgagtatgcgtgcatgttttaatagatttcattgttctgcaaaaagaacttcaatactaggaaggcattggaaagtggtgttaaacctacgggaagatcatttacttgtaaagacctgcaaatggtgaagatcagatgctcgaaggacgatgcgagagtccatatgctggcacatttgttcagggctaatggcataccctttgataagatttatgtccatcggtctgggagctctcgtaagtcagactgtctcttcttggcattttgtatttatttgcattatcagtattaaattacccatctatttgctgtttaattgaagcatgcaacgttaaatctctatcctgctttctgaaatatggttaaattatcatgtctttcctgtttatacatatgaccgtgttcctcaaaaagctaaatatggttaaatggacattctgcgctcctgatagctattctgttatcaggcttttctgttaaacaatcaaaaggctattctgttagcttgaagttttgattttctgtgtgatcttcacatgtgttcttatctgctttctgatattgctaccaggtctccgcagcgagaaggtgatgagagatctagccaagcaagaactggagttctgggggtcagatgagttctggggttcagattatgagtactgtggtccagatccggagttcggggattcggatttggaattctgatgcaacgtcagatcatctatcgttcatcatatcttctatcgtatttagttcttatgttcggattgcaatcgtcttctatatgtacttagaaagaatctgacggcacgacgcattaagcacgcatagcagggccgtgacagatcggttattcctctttggggtaatattgaatgaactatgtatggctatccaaatactgaaatgctcttatccagtggaatgagttaacattcaaatgttttggagtttgtttatataccttaaacgtacaaatgttctttgcttgaatgtctcaatgggttgcaatcacctttgcactaacataatacttcctcaatcccataatacttcctcacgtatttcgaaattcaact

SEQ ID NO: 58123 - DNA, 15886 bp, Oryza sativa
atactccacagaaatgttaagaaacaagcactttaaaaggtccaaaagtcaaaccatactagtactagaataaatgttacagtattgttttaccattctcatttagttaaaagaatataaatatcattagtatggggctatgggcttattaggatgcatccaattaaagagcactagaaataccaatgatgattgcacaaccaaacatcaaataaacgaagcttcattttaaatgtaagatctagggaaaatgaacaatcagtatgctatcacttcaggtctgaccaaactaccatgacatttaaaacgaggggaatcatcatgtacatctacaaatatagccgtttatgtgtcaactatgatcatcaacaagtatgcgattaactcaaagaaatacataccggcaaagataacaagaccatctgtagaaatccttgctaaatctggaagtgttttgttcagatatcttggggtcaaataatccaaagcatctgatacgataacaaggttaaaggaatcttggcggtatggaagagggaacttgatatcagccatacgaacaaagcccttgcgcacaaggcttttgcagctactatcagtatcctccaaatcataaggctccactccccatgcttcaaccttcccttccttcaacaagttagaaactactgtacaactatcagggccaacatggagaaccttatgcaactcattgccatatgcctttttaagataaggaagtgcttgcatgacttctggtgtacaagaacctgaatgcaaatgcaaaggaaaggttgagataatgagaagcacaaaacttttcccaataacacgtgtgaaaaggaatacaatggagattcctaaaaaaatcaattactaaaccctcccagagagggtcttataagttataactatcatgttccaatatattttatcaaaatttagagggttatctattagtatcatgaagcttaggataatacagtaaactgcgttgctgtttgtaccacacatcagacactcagacagccaaattacattggtatgacagtgtcaaaattcagcaggggaaaaaataattatcacatggtccatgttgatcatgtcataccagttgaattctttatatactgttcatggcctaatgaagaataacaccgaaggcatcaacaaagaaaaaaaaagacagaaacattcatggagaataaaaaaccaaatgcagtatctccagaatgcttatatgaaggattgcacaacacctatttcttactgcagcgagtatcagaagaaattgaagagataaatcaacaatgcattaagagaggttaaaagatgacagcagcatatgatttggcacacaaagaataatataccttcagacctgctcacagcttctctgctagtaactgttacacctggccattggagaaaaatgacaattagaagtatgagctggtccacgatatttggcactcgagtatgagctggtccactttgctatctctaggagcaggacaattcaacgttaaaaaatcacaaaatatattcatactacagggcaatctcagttaacaattgaatatcccaagttgattttgttttgatatttcagaaaatcatgacagcaacaatgcagtaccaataagaaaatgcaggtacaatgctgcagcaatgtcactgtgcactaattgtgacagcaacaatcagtgatggcatctagcacgcccacccctacctccaaatctattatttaagttgctactacctttctttaatagaaagcagagaatcaacagaataagggaacagagtgaattagtatgagttactctcactacggttttttcaccattttgcaatacaagctaaacggaacaaaaataaacaggtgaagaagaatattcaagtggagttcaagctgacctgagccgctattgaagtaggcgatcagaataatgacaccctgaaacccccaaaaaaaaaaacaagcacacttctgtcagctgagcacatgagaaatcctaacaactaaattgacaaaaagaaagatggaaaactaccaggaccacgagggcgatggtgagcacgggcggcgagcgtgacttggggtgaagcaggccaccgacagacggcaatcccccatccgccacccgccggctcggattcaccgacctcctcgacatccactccgagccctctccaatccaagccgcccaacctctccccccacccccgctcgatcgatcacctgctcgcacccaacaatatcatcatcccgtcatcacaaacaaatgcccacacaaaatcacacccccagcacgggcggaatccagatccccctacagcccacagatcggaacacccccccccccaacgcagcagcagaagcagaagcagcagcagcagcaatacctccgatggaagtggcggacgcggcgggcggcggaggaggagggggaacccccgagagcggggctagggttcggggaggagaggggattcgcggggggcggcggcgcggatctgaggcgagtgaagcaagcagcggcggcgaggtgggtggcgatccgacgcgatagggacgggaggagtgaatgatacggtggcacgggattttatacggccgcgtgcaatgcaagggtggtggtgggattagcacgccattagcgagggatttagtggagcacaacccgaattccgagacggggagatgggggaatttgggggatgtcggtcgccgtcgcctgctttcactgacaggtggggtctacctaccggtcttttggttttccttttcttttctttgcttcgctggccgtcggcctggcccggtgggttccggcccaacccactgggctgaaagtacttactactagtacatgttattactagtcaatggtcaaataggtctggaaaattgtcaatggtcaacacaggaaatttggtagctatatctgaaattttagtgtacctaacactaacgaatgctccatcgtgcaactctctggattattatgccaactgattagcacccagtatttccatttcattcctgcccaggaaaccaaatggtcaaactcgtgtcacggattcgcattacatttgaccatttagtcaacatcatttctatctcttagagcaggtacaatagcaggctataagagcacccgcaatagtaaagtaaggtgctatctataaaatatgtacatctcagcaatagactagattaatagtaaaccatttcaatagtatatctacatgggtatctatagctctctaatccattgcctcgtttttctctatagactatctccatgttagtagatagctttgctctctcgcttcatttaatctcttccaagtagaaaaatatgctgacatggatcttttgtagagagcttatagataactattgtgggtgccctaagccagctgcaaacatattttaagtagataaatgtagagagagaagggtagcaggctacagatttgtagccagctgcagcacggactccaagacacagtgtgagtatgacaggtgagaccaagtattaatagtgtagtatgtaactattgtatgaatgagctattatattgactatagatgaattggagatagtagttggctatattattgaacttgctcttaagcatttgcacatttattcatgtcatgtgatcgtgtactactcctctctgcacttggggaaaaaagagagaacatggcggcaatatactagtagtagtgatactattcagcaactaatttaatcagcaccctcaactctactggatctcttcctctgtctctctattgttcatcatttgcagaaaagagtctccttcgtggcgtttccagtggttgtattgaccctgatgcaaaaagttaattgtagctagagtgagctcaatgtaatgtacatacagggagacacaaaataagtgcaatggacagccattggtgtgtgcatgattgcaacattggttacttacccatcagcaattttgcagaggtattcacgctgatcgtctcgcagtggaacatctgtaaaatctggaaggccaaaaaaaaagagagagagaaacttagatgtttgatgatcccatcaaacaatagtcaattcagtctaatgcaattttggtcagcctctgacaaaatcaaaactctgttgaagcattttgtagatgagtaagaggttggttagagattgaaaaaataataattgatcatattaatatgtcaacaatccgatagtttgcagataaaaggagtcatttagtttggcatggccatcagagagacaggaccagtaacttgcctgctccatatatgttggaacctttgaacgtcgtgtttcctgtggcaagtgccccttccaagttggcatttgtcagatttacctgtgaaatgattcaagagacacaccatcactcgattgtcagtttgtcactaggttatgcaagctagtaacaaactatttgtgctgcaaacctgtgaaatccatgcttgacaaactggtagtaacttaatcagaaagtggtcaatgactttctgaagaaagtgaggacttatgtaatgaccaattatattatgtaacgcaagcttgttcaatattgctatgatgccaatgccaaattgctatcaatttattactggtctaatcagtaaaaaggaaaaaacaatccaggctttctgaacaatgcaatggtcaatgtggaatgtagtagcatttcaattagcttgctatcgctaatgcttttctttgagcaatatgcagtactaccttcgatacatttgccagtgagaaatctgcacctctaagatcagcatcagagagatcagcacctgaatttatcaccagaaaactctgaataatcaatgcaactagaaccaaaacatcagttttgccatttcagaacttcacattggggaagaatcactacaactactgtgataaatggaacatctaacaaattcacaagcacagcatcagaacctgtcagatctgcatcaaagaagctcgcgccgagcagcttcgcgcctttgaagttcgcctgcctcagtatagactgcaacaaaaacataccaagaaaacagcataagctttgcaattgcatttgctgacaattcagatactcttctggacatagaattcagtaattcacccacaagaacagttacaatttatctacagaaatatgatcatatccgagttcaagaactgaaacagaaaggcaatgggaacaatcaaagagagtaccgtcttgaagtcctgcctgatgagcgtctggccactgaagtccttgccggtgaggtcctgcccccgtgtcacctgctgcccgtacgggcctcctcccttgaatgccagggccgggtcggcgacgaggagcgaggccgcgacgagcgcggcggcgccggcgttggcgaggtggaaatgcagggaggaggaggcggaggagcgcaccggcgtggcggagggtggggatggcgtgagcttcagactgcccaggatggtggggatggccatgatcgatcgtcgtcgattcttgatgctctccgactccggtggtcgtcggagttggtttctttgtgtttcttctttagcgacggtgtgtttatccgtcttatctgttcgtgggttgcttgctcagtcgaccaatcgttgatcgccacgtcggctgttctttcctagtataaaggaggagaaaataaaaggaatttttccagccattctgatatgattcaggttttatttttttattaaaaaatggaaatggttcactttcttgctactacaagtttcaatataattattttgcggagaaatatgttttatttgatatatcttagtgtttgtatgttcagagttactccctctgtcccataaaataccaatttagcactggatgtaacgtataattttttttagacgaagggagtcggtgaaaaagtgtgtgctaccatcataagaactacgagtaccagatttcctaaactattgaacacgttttaaattcaccactcaaatttaccttgggtttttaagcaaaaaaaaaaactttactgccactaccgtgatacttcctgcatcccaaaatatacatatttctagcacagtacattatttcaaaatgaaactatttcttcacatacgttctcctctcaaccaatcatcactattctcctttacctacttttacttatcaaccaatcacacatttcctccgattattctcacctattttttattaataaccgtaccaacctaaaaaaaatgtctacattttgggataagggaaacaatttggcaaaaagatctatgagcactcatctgtaaaaataaataattcattagggtgtaatttgtaaattgtcttgagtctttacgaacaaatccctatcctgcataccgccatcgtctctttctcgtcgtcgccggcgacgcctcccgccgccgccgaggatgccagtgagggtggtcgacaccgcaaccccatcctcccagcccacctcaggttcgtccacctccttccccactaccttctctatgctatgcacccacccctaattttgctgtgtaatccaagctttagatctgatcatctgatagagtctaatcaggtatcaggtagcttgtggggtttgatatagtgcgattttaaggtttaatctagattggtctgagttgtactgagggtatctgtgttgatccttttggaatatactcaattttttataattttggccactcacgctatgcgttatttggggagagctcggatggttttgtagctaagctgacaactaattgtaatgtattgtatatttttgaggcgttgctatgcttgtggctttgtgtcaagtgttcttctgtttcaggaggccttctatataaaccaattgttgattttgttcacctgcaattgaaatttcattagttattttgtatgtatttctggaaatagatagcccgccgtgccaatgtgccatactgattaaaatgctgcaggtcaagatgcaaatgctgggcatccgtctcctcctagctgttccctcttaagtgctggaagagtaagtctttttgtgctgttatttggaacttgaccaaggatcgaatcttcttatcggtgttgtttatggaactgaccagaccatatgcttgtaccattctttcagtgttatgctggaacccagaatgtctctactatacaaaaagaagaagcttggaaagttaatgtgcggatcaatgactgtgatcttgaacagggttatttatgtggaacaatggaagcagttaatgttcccttagctgatacccctgtgagctactacttccttttccactttgactctgatctttatgttccaaattgttcattcgtatactaatttagtaggcaaacagtttgttccgataaaatgtaaaataatgctatgttttacttcttgttaccattatctgatttgcgtagcaatttgtaaataatttccataggtggtaacattctgggagggggagatagtggatgctaaaaattatacatttttcactggcaagtgggaggcatcgtgagtagttaactatttatgttttatccttgatactatcatctacttgttttattaattgatgccctagtttagggtaacagtccaaacttactcatcaaacattattcctgcttatgcttttgcagcccagaggatgatattagacactggtccaagttcccatcatttacacctcttctggtattctgttgcctatcttcgtgttgttagttgccacgatttgttaggatacatttctcacttatgtttctccacagagtcagatagagacagatggtggcaagtctgtggacttcagcaactatgcttacatattcatggtactgcaccatctgacctttcatgtatgtgccccatttattgaaatacaaagtcataacaacttagcattattctgatgctacatgtagagatggaaagagcagtactttgtcaatgttggagtggactgtgggttgaccatagctggtttctactatgtctgcttttcatgtagcgatggttccattagcgggtattattatgatccaaacagcaggtaatgtatatttcgctggcactttttattgcgatgtaacaactaaattctattgaggaattgaagtgatataaatatttcctgctctctcaatttacagtccgtttcagaagcttgaactgaagtgtaccaatgagaaagattctggatttaccttttcatcctacgagctgcagtgagagactgacaggcctgttgtcattatagtatttgcggatgttaatatacacaatgtgtgtactgaactcataattttgaatggcgtcccattaaaagagctgagatggcatgtttgtaacagtgattttgagcaagatgtattttattctctttgtaatatgattataagctggtaaaatttctaatttgaacctacctgtgtgttctttttgtgctaatcacggcatggttatgtccagaataaataagacaagaatgtgagggctagttgctcgttcaaagaaatatatatacttctttccagagtaattgtagttctgcagttggaggatttttgttttctttcaatatttctgtactgcctacattgtggaatttgtggtcactgattgtgaatctaatatctgatactgagctttatctgaagagacacttaagattgaaatcttgtacattagtttctggtacacagccacagaaacctccttttggtttcacatgcagccattgtaaggtatgatgtaattctatgaacaaagtatacttgggccgaacactctgtcttcgcctccggtcttcggacattgtaaggtaaacatctctctacttatcttgtttcatagagtcttgatctcatgcttcaagccgtagtcaattctctaatgagtaaaattcttctgcatctgcattgcacaggcttcaagttattgctaaaccctataataatattctgcagataggactacccttgcacacctggtgaagcttaccttcatacacacaaggatgggtggacagtggaacaggaggtaactcttctctcctttctggcagaaaccaagaatacacttcctttgccctctgtaccaaaggcctctcaacattctcacaccaggcgtcaaacatatcgaggacagcctcagtaatgacttctgagagtactttatcaccttctccaggtgccagcttcagcatcatgtatctcttgaacgatacgatcttctctaacatttgccttctgtcaatattatatgatgacatcgcgccttggattatagagaccatcctgaggactgcctcacagactatagcatatgcatgactgaatatctcggttgctgtttctgacagttctttgctgtgccaatcattttttacaggttctggcccctgttctaagattggcgcaaatgttacagtcttcggtttggttgtgttgacacggagctgctttgattccctcagcatttcattggcttccttcatttctgactcaaacctgctgctgaccttgaagtatggttgctccttgtgtgcagttgggctcgggagtggggaattctgccttgatgatgcttccaagaaaacctcaggtgcacatgctgattcacacgctacgatttacatggaaaacacaagtattactcttcatcataacaaaattatactataattgatatcttgactgaatttaactggagattgtccaatgcatgcaatattctgaagtctggcagacatacaggaatggggatgtcgagctgtgcttggggatccgtagtctgcatcgttgtgctccttgctgtcgtctgcactgggtcctgctcggggggtccacatcatgtcttcttgcggcttcttcttgtgatgcagcaggtgcatccatttcttagccttgctcttcaccttgccgagaactggcttcttctggctcccatttggggtccgcggcgatcccatcggactcaccggcggtgcccgtggcgaaggccagtatcgttgttgctcctcccattcatcgactggattttggcctgcaatattcagagacgctgagggaaatgtcaatcaggcatgatcatttctttatttctaggcaggtgaggcactaacatccctgtatcattacttccagaagaataatttggaacacattgatcaagctatacattttccaagatcgaaatgtcatgagaaattatgaaacatgcaggaatggtgaaatttgagatgagaagaaaagaaccaagaccgacaaatctattaccattttggacggggtgatcacctcgtttggtgctgatcccgcgcttcaattttctgatttcattcatgatttgtgcaagaatggaaccaaatcctagagctttgggaggagctgatcaggcaagaaatggactctatcctaaagttggcaaccctgagggaaccaatttctgagttatagtggtgacaagggctaaattctggtggagcggttaagttgccaacctattctagggggtgtttggtggttggagggtggccatgcttttcttggagccatcccagatcataaacgaggttcatatgtttttgccacgagcagctgaaaaatgtaaggacatacatcatgcatgtgcgggatgttttgaactgagcaggtttagggatattttgatcaaatgtaatgttatttttgtagaccgaaaaaaaaaaaagcgatcctaggcttcctagcgctagataaagatacagaaggttcgagtttcatgaggctgaagacccagattatggaaaattcgagtaaaaaaaaacagaaggttcgagtttcatgaaatttgagttgcagagagaaggatgaagaccgaaaattcgagtttttagggaagtttcatgaaatttgagttgcagagagagggatgaagaccgaaaattcaatttttttacccaaaaaacaaaaaaaaatttcttgtcaagaatgggattcgaacccatgccctttcggaccagtacctgaaactggcgccttagaccaactcggccatcttgacagtttcgatatggttttattgacaatttataataatgtgtgtagaattcttcgcgacggtaaattatacaggacaataaaacgctgactatataacgtaaccgaaaccaaaattcttgacgaaactcaagaccctctctgtataatatgcaagctaccattgtcttacattaaaaggttctaaagctaacaggccaatatacataataaaaccataaatgccacagtaaaattacgccgaacaccgagttgcttcaaaaatggttactgctattgcctgtcaataaattgacttgtgttctttgttcataaatatgtaacaacattgggtgtcagcatatccatgttagcccatgctgccaaagatactacaaggagtaaacaatgttgtaccgatgaaacaagttttctccatgctctctgtaatctgctaagctgaaggtgtgcctcccaaacttgctggaagctgcaaaggcagcagcgcccctccatgcatctataagggggtcggctgctctaacaagcttcaggggtgagaggtagggccgaaactgccggattccggattccagccgagggatcatgcctgggatcaaagaacagcctccagtgacaaggatggactggcaaaggcgctccttgacagcctcgtcttccattagtcgcctaagtgagatgctgaccatctcatcgataccagcctggtcaattcctatcataccaggctggaacaatatttcagggcaccggaaccgctcgatccctatggaaatcctgtaatcttctgctgtaagagtccggaccttaggaggctcaggagtctgttggacagcttcagctttgttcacaaatgtagggtccatatcctgcacatggaagcatcaaatagtttatgattgtaaaagaaactattgaggtgtgagatctaagtaagacaaaatggccatcacggctcacaagcaagattgcttgaacgtgagatcttacctggatcttagaagcaattcgagcaagttctgattcatcatcatcgttcccatcgtcgtcgtcgtcattatctttgctcatctttttgtagactaaccaatcttcatctctcgtaccaaaagtgtcctcgcccttcccccgatcaaatgcagcagatgtgagcaaccgcatcctttctttctgggcggcattaagacgttccccacggcctactccaccagatgaattatgattaccattggtcttaccaccattgagtttctgtcgcttcctctgatcaaccctatcagaaagttccgagtatcgagcacggagctcttcaaggtataactctgggttctccctggatattaaagtaaaacatatcataaaagcagcgtatagagcgcatggcaaatatttatgacagattcgagaaaaatttatcccttttcatagagtgtatatttcattgatatgaggataatagaatagtaaattgaacattgtttggaattgcagaatgcatgcttgatttccagggcttatatcagcacgaagcgtatcacaagaacaaaaactaaaaagatggctctgaaataactggttaactaacccagtgtacttaaaatttcaaaaaagaggatcttaagctgaatgcagataaactaattatgacggccgtatgaatgataaatttcagactggggacatcgcaacttacaaacgcctctcttcttcttgcttctccctcaatgcttcctcctcagcacgtctctgcttggcacgcattcgaccttctgttgtggttttaagtagtatctgtttcttcttctcttttaactgaaagtatacgaaagtgaaataagaatagtaaatatttgaaacatggaaaatatctaaacttggtataatagatatgtgctcatgtcacacagtcgcaaaaggtctccccaaaacacaagcaaaaacaaacccctttgctacagatgataaatggacagacacacacctgttctggtgtcaatgtttcatcagggacagacacaagtggatacttatcaaccccagaagcatctgctttctcttcgttaccattggactccccctttgccttccttaaggattgtgttgctttcaaaatagcagatttgatttcctgctgggaaagatacccagatctacctaaaatggctgttgcttcttcttcctcagctccatcaagttgctccattagttcctccaaataagaaagctgtttttcaagttctgctatcttctgcgacctttttgcagcagccatatctcgcaaacgttgaccagccttttccttcaaagctgcttttcttgcaagttcttcctcagatggtggttcttctacaggaggcgggacccatggtagctgccaatacctagttttttcttcagcttcttccttattgttctgccaagtggatcaataaattcatagtgttgaaagaaagagctagaaatgtaacacggtagaaaagccctgtgcattctatagatgaactggatttggaatttacattggtaagaaaacaaacggtaaataaaagtttctcaccttaaatatctgcaactctgacatataatcaagagctacgtaacaatgttccttcttcagctcttcagccttttcccatgtaatgcttgcactactcaatgtaaagtggcaacgattagacatggtaggaaaaaaaaatgcatggagcacttcagaaatatgctgcgggcacctacctgtgatagggatactttagagagaggagctgcctcagaaaatctgtgatgtgaaagccaccaacgttggttctgcagcatgcccccaacacaggttctccctttaaaaactgaatgcatatacacagcaaagcattaatcagaatgcatatgtggacaaagaaagaagattttatttcacagaaccactttgatgagtacaacataatatttttgtttattgattgtttcaggatcatgacaacaataaacaaattgtgaaaaatacactacagagaagaatagtctaacttggattggatgagttagtatgcagcctaccatggaaaagtaagcagaaattcaaacacacagggctcaaaatacaaagcaacttttaccaatgtagttgtccggaagcatcatagattagatggaaagaaaacaacatgctgtgtctggagatcaagaaaatacatcccgacttccatgagcaaaatgatttagctaagaataggggcactctttctctctctctctctttccatgagcatgttatatagcattacccactacagattatccaatcagagttttagaatctacaatgcattcaacaatactgtgttcttcaagcatgcaatgcattaattttccgaacatctgacaaggtaatggaaatgcaatggcaaaggatttgtatgttgcacaaagttaagaggaaggcatgtggaaggaccaaacttactggaacaacatggcatgttccatgttcacacgaaatggccagtccatcttctccacaattcccaagtttctgattgtacttgtaactaaacacatcgtcaatgccaaaagctgaaactcacataggaagaaacatctttagcatcgacaattcttacttcaaaactaccatgcacaattgataacaatggcacaaaaagataagtatcattaccaatggatggcacgccatatgtctcaaaaagtagttctgacattctggctcgagaaaaggatggattgcattcacactctgtcataagaatgggatggcccacctgcccagcattactgttacttccagcagcatgaaaccaaacaaatagctcatgtgggaaccagaaaattctaaggtaaaaggatgcatacaaatatattactatataaccaaaggcacataacactttctattagaactatatgatactaatgagaaaaatctgttcagaaatgcctgctatgcctgggttattttttcactgtcacccaccatacacttgagaggagaaagctcactgatgaagataattgtccatgtctgtcatatgtctaggatggatatgctgaatatgacattcacttgtcatttaacttgcctgttttagaggctgagagcctgatactaaagtttcccaaagactttgaagcattacgttcaacttgtgaacgtcaactgtgtcactatgcaatatattcataagaaacttaattctgaacccgaaaccaactgaccattttagaactcacatgctaaattcaagttttaataaacactacatagtcccaatcattgcacacacttcacttatacatagaactggcatacaaaagaacccccaaatttcatcatttttatttgagagggactaccccacatttactagtgcaaggtaaagcaaagctgtcaaaccaaggaaacagtacataagtcaactacattcagaatatattcatagtacagatgatggcagagtgcaatttacctctgaagtggcacctagtcgatcaaaaccaaagtcaagaatctgcaacccagacagtaataataccagatcaaagaaatacttaaaaaatgtttgttacacaagcaataaaggttggagtgcaaatatcaacactctgaagtaagcaatcatgtgctgcactctaaatttgtgaaacataacaatatgtattggtatctaatgtcataaaggatatgtgaactatgaaagatattatcattaatagctatagaatagagcatactcatagaagcaagttagaatatgaatttctaacttcagat

SEQ ID NO: 58124 - DNA, 2484 bp, Oryza sativa
tttcgttcatattcaaacctgtctatttacatggaaacaaaagacacgattagatcattccaaattccaattagacattttgggcaattgatcgtgataaattgggtagccttctcgtttacgtgaattgatttccgcaaccgccgccttctccgtcgctccggcgaacctctcggtaagtccgatccgtctcatctccctccttcccatctctgtactctatccctgacacgcaataatgctgtggaagttcagcgggaggtggagcgcaggccacctgttcgacggaatgcatagccctggagaggcggcgcgcggcggcggcggaggcgaggatgacctcctcagcgccctcccggacgcgctgctgcaccacgtcatgtcgttcctgcgggcgtgggaggtggcgcgcacctgcgtgctcgccgccgctggcgccacctctgggcctccgcgccctgtgtcgacctccgcgtctcgcgcggcggagtccaccgtcctccacccagggagttcgccaagttcgcctaccgcttcttgctcgagcgggaggtgtccgcgccggtggacactctccgagtgctgtccagccccgtgtgctacgacaatggggaacgagaggattactccactcgggatgtcgaggcgtggatccgtgccgccatcaagcggagagcccgggtgatcaagcttaccgaccatcaagacgacgaggtcttctctgacttcgacaatgtccccatcgtcacccgccacctcaaacacctgaagctgtctggttccgttttggaggacaggaaggacactaaggcagctctctttccagtgcccttctttagaaattttagagctcaagggctgccttctagaaggcggtgagatttcatctaccactctgaagtctgaagagcttgagcatggtcgagtgcaagatcgaggaggagctcaccgttgctgctcctaacctcgtgtcactgtgctgcatcaagccattccaccaagctcccttgttcgaggattcggggtccctcgcactggcgacgggcactatcgtgctcgatgattcattcttctgtggtggttttaagaccctatttagatgggactaaaacttttaagttttatcacatcggatatttggacacttattataaatattaaacatagactattaataaaacatatctataatcttggactaattcgcgagacgaatctattgagtctaattaatccatgattagcctatgtgatgctatagtaaacattatctaattatgaattaattaggcttaaaaaatttgtctcacgaattagctttcatttatgtaattagttttgtaagtagtctatatttaatactctaaattagtgtctaaatatagagactaaagttaagtctctggatccaaacaccatctaattctaggtggaaagacatcgatgaggattgtgatgaaattgaaggaagagatacccgatggatgttgctcggatcattctgactatggcagtgatgcaatcacctttgaatatagtgagattgtaaatgactattgcgagcaattctagatttcatttaactttgcaaactccggccgtatagttgttttggtaaaaaaaaaatttaacatatacgaacacacatttgaaataaaacgaatggtcaaacatatgaaaaaaaagtgaacggcaaataaatggagggagtaattgattgcctagtaaaattactctatatatatagttagtgaaacaggagcagctagcacctagcagcgactaaactaaagctcatcgtggtcatcctcgtcgtcgacgttgccatcttccggtgcgccgccgccgccgccgccggacctctggtagaccgccgacatgacggggttgcacacgtcctccagctccctcagcttctcctcgtactcctccttgccggcgtccgggttgccgtccagccactcgtacgcctccctcaccgcctcctccaccttgtccttctcctcgccctccatggcgtccgccatcttgccgccgagcgtgttcttgatgttgtagacgtacgcctccaggctgttccgggcgtccacctgctccctgtgccggcggtcctcctcggcgaactcctccgcctcgcgcaccatccggtcgatctcctcctggctgatcttgcggtcgtcgccggagatggtgatcttctccgacctgccggtggccttgtcggcggccagcacgctgaggatgccgttcgcgtccacctcgaacgtcacctcgatctgcggcgcccccctcggcgccggcgcgatgccggcgaggtcgaacctgccgagcagccggttgtccctcgtcatgctccgctcgccctcgaacacctggatggtcaccgtcgtctgcttgtccttgtacgtggtgaacacctgcgtcttcttcgtcggcaccaccgtgttgcgcgggatcagcttggccatcacgccgccggccgtc

SEQ ID NO: 58125 - DNA, 4240 bp, Oryza sativa
cctggtgctgccgccgacgaggacgatctcgtcgatgtcgcccttgctcagccgggcgtccgccatggccttcctcaccggcaccatcgtcttcttgaagaggtcgctgttgagctcctcgaaccgcgcccgggagagcggctccgacaagtcgacgccgtcgaacagggactcgacctcgacgcgcacctggtgctggttgctgagcgcgcgcttggcgcgctcgcactcgcggcggagcttgcccagcgcgcgcgcgtcgccggtgatgtcgcggccgtgcttccggcggatgaccttgacgaagtggtccatgaggcgttggtcgaagtcctcgccgccgaggtgggtgtcgccgttggtggcaaggacctcgaacacgccgttgtcgatggcgaggatgctgacgtcgaacgtgccgccgccgaggtcgaagacgaggacgttcttctcggcgcccttcttgtcgatgccgtaggcgatggcggcggcggtgggctcgttgatgatgcggtcgacggtgagcccggcgatgacgccggcgtccttggtggcctgccgctgcgcgtcgttgaagtaggccgggacggtgacgacggcgcgggtgaccttctcgccgaggtaggcctcggccgtctccttcatccgcgtgagcaccatggcgctcacctcctccgggctgaacacgcgcacgtcgccgtccttcacctcgacgcgcacgtgcggcttgccgttccggtcgacgacggcgaacggcagcagcttcatgtcgcgctgcacctcggcgtcggagaactgccggccgatgagccgcttggcgtcgtagatggtccgctccgggttggccgccgcctggttcttggcggcctcaccgatgagccgctcgccgccgtcggtgaaggcgacccacgagggcgtgatccggttcccctggtcgttggcgatgatctcgacatggccgttccggtagactccgacgcacgagtacgtcgtgccgaggtcgatcccgatcacggtgccgccgccgccgctcttggcaccgccacccttggccgccgccacagagccggcaggcgacggcgtgaggaggagaagcgcggcgaggaacagccccagctgcatcgtcgacgcgcgccgcggccgcgccatgatcgtcgtcttcgcttttggttttgtgtcgatacgagcgtcgcgatatatatacagcgtgcggcggccgaggccgagcccgactccgatctgatgtgtgccgctgccgaccaatcggagggagtacacgtcagcggcgtgatctgggccgttggttgatctgatcggacggtcagggtagagtgtgagacgtgttaatgacagtgtgccggtggccgtgcgcgcgtagcgtatcggtgccgactcggtttcatcttcgtacatggaccggtacggactctcaacggtttacagagttggatcgagtcattgagctactcctaaacgcagtctcatatagcttcaactttatactccctccgtccctaaatatttaacgttattgacttttttaaacatgtttgaccgtttgtcttgttcaaaaacttttatgaaatatgtaaaactatatgtatacataaaaatatatttaacaatgaatcaaatgataggaaaagaattaatacttacttaattttttaaataaaacgaatggtcaaacatttttaaaaaagtcaacgtcgtaaatatttaggaatggagggagtacttacttaataggtgtggattgattctcgaaattgctacgttttaaatactaactagaaaaaatgcatgtgcgttgcaacagaacaaactaaaattttgataaacaatagatccgtactttgaacttttccagaaattcctcaaactcaattcgaaattttgaaagtgaatatgatttttccttttgaattatttatttctttatctgcctccccttgttctaaatttattcgggttcttatacatcaaaatccatccaaagataaaaaaaatccttatagtcccatgttttgattgatgatgaacgaaaaaaaaattgaatggtaaatgagaacgctaagattttcctttaaatactttgcgatcttcctagactatctttcataatttgatatagtttcaataattattaataatattttttgaattaaaaatttgattatacaattaatcctacaccgatcccctgttgatcaagcacaagcacaaatataccgataacgttctcctcctagctcctggataagtaccggtacagaataaacagaaatcactggtttaaaactggacagataaacggtgttgtaattaatcctaggactacgtgctcttgcagtcttgctgatggactcatagtgtgtattcgtgggttgcggcggcaagcgcaaaaaccaattgagttagagacggacgtatatgacccaagaaaacaaacgcaccatcaattcagtcacagatgacgtaccaaagtactggtggaaacaccttcactttttacaatagtagagataagtagagaataattctcttatttgaataagccaccgtcaggcgtcaacatgggtcatcaaatgcccaatcagaaatattgacgacgatttcttctaagctccaaaaaattaaacaattagaaaattatcaataaaaatttcttctcaactccaaaaatttacatcctgttgcaatgcacgtgaatttttgctagtataattgtaatggaaaaattagaactatttgtacattagtttttactaacatggatcatcacgtgtgtatgcatgtctccaagttcttccgtgcatcagtgcatgcctcatcacttaaaaactaattatgtgtcaggacaggtgaatccacaaagacactgacaccaattcggagacaaccaaccgcattggccgggggcagcaggcatgcaggaggcccagctggcccacgaaaatccaacgctcctgccttgctcgttcgctcgtgtacgcgatgaggcgcagagcggaataccaaaccaatttaataagggtgatgtacgaaatatttttgacaaaaacatcttaaatttttataatagactagaaaaaatgtccgtgcgttgcaacggtttaaaaaattttaatcttacatattacttaagtccgcaggatatcctactctagaaaggaagctcaaggttgatcaacatgagctggccattatttgctcaataaaaatagaagcccttttatgatttttgcattcatgcacaacctatacgcatgaatgcatttaaaacagccagttagacagttaatactttcttgagatgaaaatagataaatgacggatacacaaattttacaagaaaaatccttatgggaaaaaaatcatagatgtcgattgacaatggaatagaggaattggatttaaatgtaggggatacattgaatttgtcgcacccttccatgtggcatacaagagatatatcaagcgaaaaatctaggagtcctaatatgaaaagacttaaagtactattaggaaactaattttgtaatacgaagtcgtattacctaactaacccgaaaatactgtatgttgaaatttggatcacatatttaataatctccgccttgagacgaatttcctcttgtagcataaaaatcttcattctcctaacaacatcatgatgtgacaaaatcattgtgcatcaaatagtcacttggactatatataaaaccgtaagacccttaattcagaagaggtacaccatacttcaaactgtcattggaaataaatcatgaatctgttggtataagtctgtgtgaatttagcagaaatgcgatatactctgcatgcaaaaacgaagtattttgatctttataaaaacctcctagtaaactgacatgtgagcttagaaaaactgaacctagagttgatttacccaaacagaaccaaagcattaatgcagatgaattgtttccctggtatgaaagagtgtgcatgaagcgataatctggaaacctcctcctagtgcaaaagctggagtggtaggagcagcgaataattttacttgtccttctcggaaaccgtgcgagtagatggattggtctgtgcttgcttgcttttcctgtgcccattgcgtcgacctgcccaggcatgcaaacggatagtccctccgttccaaaaaaaaaaaaaaaaaacaaaaaaaaagacaaaccctagtttccatgccaaatgtttgaccgttcgt

SEQ ID NO: 58126 - DNA, 2135 bp, Oryza sativa
cttaccggttggtcatcttcaatgcagattaaattcgacaaattaaagctaaatcaaaagggaaaatcataggaaaaatgatgaggaaggagtgaggaatctttttttgcaatcaattagaggaggaaatacatgggagaagcagatcgacgtcgcgacaacgctagggtttggcacgggcggggcggaggcgcgctgcacacatgggatcgcgtgggaagagatatatggaaaaatattaggtatagatagatttagttatacataataactataactatttattacctaataacttactctatggcctatcacatttggaagattatggctagtcattacacaagttacttttctagtaaaagaaattatacattacttgggccggggccatgcaagcctcgatgatttcagcccgctcgttgtccgttatatgttaatctatccgatacttgtaatacttttatttcttctcggtaattaaccgaataagcaaactggaacagaatcggatcgggagacaagaaaaattgacgacgtacgaatattttaagaataacatcattaatttttataatagtagagataaagataaagaaaaataaaaaataaaaaaaaatcttgcaaccggtgggatcaggaccccctgcagttgtaatagggactgcaactttagcagtcgttgcctcaccgttagatcaaataagaaaagctcagattcggccagggtactgtagcacgcacataaagtcctgttgcgcactgtagcatgttctgtagcttatgccgttcatcagcttgatccaacggttgtaaatggatatgactgcttaacttgcagtcactgtactaactacacttgatcttgattccaaccggggcccactcgcagtttcggtatttagggttttccttttatttttttaatcttttagcggctcatagtcatcttctccaaccgccgtcggccgccttcccccgtgccggcaaccgccgccggctctgaaacggcaagaactcaccgtcgatcggacgaaattttccggtgagttcaattcccatctcctcccctgcaacgcaatattctcgagggactcatcttcttgcaaattcctggcgcaagatgagcgggaggccccgcgcaggacatgtgttcgacgaaatgcctccgaagaaagccaagctgtccgccggcgccggcgccggcgaccgcctcagcgccctcccggacgcgctgctgcaccacgtcatgtcgttcctgcgggcgtaggaggtggcgcgcacctgcgtgctcgcccgccgctggcgccacctctgggcctccgcgccctgcgtcgacctccgcgtctggcgcggcggaggccacctcccacacccggaggagttcgccaagttcgcctaccgcttcttgctcgagcgggacgtgtccgcgccggtggacactctccgggtgctgtccagccccgtgtgcgaccccgaggtggaggattactccacttgcgatgtcgatgcgtggatccgtgctgccatcgagcggagagcccaggtgatccatatttctcaccatccgaaggacgaggcatttagtaacttcgaccatgtccccatcatctcctgccacctcaaacacctgaagctgtctggctacttgtttcgacaaaggacactaatgcagctctcttctcagtgcccttcattggaagttctagagctcaaaggctgctatctggatggccatcagatatcatctgcctctctcaagatcttgaccattgtcgagtgcaggatcatggagggcttcaccatcgctgctccgaacctcgtatcgctgtgctgcgtcacgccataccaccgtgctcccttgtttgagaatgtggggtcactcacactggatgcagccactatcgtgcttgatgattcgtttctatatgctggttatgaatacgagtatgaagacatcgatgaggatgcgatcgaaggaaacggtagcgaagacggtgaaggttccttgaatgattctgactacgacagtgatgctgtcagtgatgcaagtacctgtgaatacagtgagattgcaaacaactatgatgatgaaaaacagcttgtagagcatgatgaggtacataatcgaagca

SEQ ID NO: 58127 - DNA, 1155 bp, Oryza sativa
aattaaacagcaatgttttcctcaagggataatacttgtgcgtgaatttgggttttggcatatcggcggggctaagggttccaggccattaagcagccaaaataagagatttgctccgatccaataaaaagtatttcaaggtaccagtacctcatgatacggccttaaaatactttttgctggactggagcaaatctcacaaaataaatcacattactcctgtaaattttctcttctttttttcttttctctgaggccttaagggatcttgtacaacttttttatctttctacttgatacagctactccccgcgttctcgtacatctttataaagaaagtgttaacatacacatctttataaccgtctgataatattatttgaggcattttaaagaaagtgcataaaaagaaaagcaaaggcattatctaaaatgcctgggaagaaaaattgaggcatatgttaaaatgcctcaaaatgtgtttaaaggcaatctaaaaagtgccttcatctatacttatgaaggcattttgaaaagtgccttaaaaaatcccttttcctacagcagtatatccaacactttgaggattggaggcatttttttaagtagttgaggcattcttaaatgccttcaaatgctatccatcctatagtgtttcttatcttctacttaatacaagtacacccctcggggtttcaaagaaaagacactgcagtttcgcggcaaagagcggaggatcgagctgcacactatgagacttacaatactgactttctccgtatgacgaagctgaaatttccccaagcctctcatgcttattgttacatccatgcatgcacacacgatttagcttagttatattcggcctcattaatcaccaaaacatagtagaacgtatttaaacattctagcttcttcttcttccttggctagctagctatttgcagagaaaatatacaccttttttttcttgttcagttggttaatatatagaccctattgtaataaagctgtctagctacgcttctggagaattgttcaaacccagaagggttttttgagaaacacatgaagctgtatatataagcaaggagagcatacaatacagtcctgccatgccatgctgggattgcactacaaattcaaagcatacag

SEQ ID NO: 58128 - DNA, 1946 bp, Oryza sativa
ctgcagcattcaccaaatctggagaagcttttccttgaacttaaattggtacatatatttatatctgtcgaatttgcttgatgctttacacttttcatatttcgacaaatcaattatagcacatattcactaataattatcttcttctgcaatccaaaaaaaaggattatgacaacacacaggcaatgaaagaaggtaccaaaccaaagggatgctcatttgcttgcacacaccttaaaatggtaaagatcaaatgctctattgatgatgtgagagtccattggttggcacagttgttcaggactaacggcgtacccattgagaatatctttgtgcgtcagactagcagcacttgtgagtgatacttctcttgtaactctcatctctgatgaagttgcagtaccgtcatacattattactgtttttgttagatggaaagcatttggttcacttgatgttctttgtggtgcatgatcgaaaaccataaactaatatgttttgttttctgacatatcctccaggccttcccgccagaccatggtaatgtgaagctagagggtgggaccaataatatcttatgatcttgttcaatatgataatttcgctttatcacattgtatttagcagggttctgaagggtaagcatctgcactgatcatgctgggattacagaatatgtgatgcttcttttgagtgcattggaactatgtatatatggctaccttaacgcgaaaatgatcttatctagtggaatgattttagctatgttatctctagcttgaggtcggcttcttcctgaaacgatttgacgagttctttttgcttaatgctataactgaaagtgtaatatgttcaatcttctatgtgtggtaaaaacgctgtggttgctggattcgatacttgtgacataaaaactttgtacagcgacgagccattaccaatgcgcatatgaaagacatgtccagtcttgcatggatggtaaagcccctgtggatgcaacaagtcaattagttctctctgggaaaaaaaatagtaatacatgcaacagtagttttcatatgttgcattagtatgctatataatcagcactcagcagtaatcgtcgttccgaatcagaagtagaagtatcaatctcatctttttagacagtccagcgaagataaaaccggccagaattttatgaagagagagagagaaaccacaacatggaaaccaaagtacaacaaacgctgtgtttagttccaaaatattttttcaaactttcaacttttctatcacataacttctctatacacacaaactttcaattttttcgtcacatcatttcaatttcaatcaaacttccaattttagtgtgaacacccaaagtttattgtagcccttgactactacggtcactgccgaaagggcaactctacgaggctacgaccaaactattacaaatccgtagcctctgctcatatttccgaaagatctgtgccaatgtcatggtatcaaatgaatccagaatattttttcagacgcgtgccaatgggacatagctttatcacttgatcagtatatacagagtacggaccaacatgagacttggtcaggtcaccggttatcgaatgtatgactaacttaggaggggatgtgacctcttctaagaggatgaatctgactaggttaagttttttttggacggagggagtaagctttgctaatttggcatcgtacgttttgttcagatatatgatggacggggacggaacggatttacgattttacggttgatgaaatcatacagttcgtcatatcattatctgaaaaaaatacagtccgtcatattaaaaaggaataagtccactttccttccctcaactcatggccgtacatgaatagcatccctcaaccgcaaaaccgggtatatcccccaactctgaaaaccgttgcaaatcaactcc

SEQ ID NO: 58129 - DNA, 2941 bp, Oryza sativa
ggagccatcggtgaacttcaattgtccttcatctatggccgattgaacctatcgtcgaaacacattgcaatcattagtagaatgagaatgagaatcatgccatttacaatatactcgacgtttcaactcttcttgagatggtatgacatggcctttaggtaatctaatttgtttctcttgtaaaagataatcaaaaatcttatcacacttggccacatcaaaactatatttaacctcactttgtcgatctttgcgaggagtcggcattaggttagagcaaacaaaaggcttatttttattagtccatgaccattcggcaacatatatatcatgatcaccctcctcctcactatcactagcctcagggtaatcaaccacattaacattaggccttttgtcatatggtctaacaagttttttattatccttaacctggctttcttgagccagagccctttgcatgagttgactaacatcaagaaattgttggctatctagtctttctctaagaggagcaattaaaccattaaaagcaagaccagccaaatctctatcagttatattcaagctataacatcggtttctaacatccctaaatctcttaatgtaatcaatgacagattcattatacttttgcttaaccgatgtcaaatcacataacctaagctcagtttctccagtatagaaataatcatggaatttttcttctaattgaacccaaatatgaatagaatttgccggtaaagaagtaaaccatgtaaaagcattaccggacaaagataaagaaaacaagcgcaatttaaaagtatcactattagcctcaccacattgcgccaaaaattgacctacatgctcctatgtggtcttaccatcctcaccactaaacttggcaaattcgggaactctataattacggggaaacggcacattatcataataatcaggatacggctttttgtaaaccctagcacgattcctagtttcgatcccgaatctatccataataatatcactaattatatcctccatattattaggcccatgttgattcagcggtggatttggtggcctaataggttgtgtttgtggcacaatatgattatattggccttgtctagtatcgggacgataccccctagcaacatcattataagcattaggaacatgtgggggaacttggggattagttgtagcagtagatataggaggatcaaatgtcctaagatgatacaaataactagcattagtcattggatctatccgttgtatcggtataatcgcgccggtctgaccggcccagggcccggtcggactggcgtccagaggcacggtcggaccggcctgagtcccagtctgaccggccgtctggccggtcggaccgacggctaggtcgcggtctgagcggccgtcaggcccggtcggaccggtcgtgtacaccgttccatcggttctattacccgtttgatctaaaaccgagtttaaaaactcgagggtggatgaataggcggttttaaaacttttggctaaaaccgagttttgtatgcggaaacgtaaatgaaaacggttgagaggaagaagctagcctatgttgaggtttgcaagcctagggtggtaatagcacaaataaactctagtatgtaaacttactcaaagtaaatttgcacaaaataaaagagacaggtgacaaaggatttttccaaccgatatttggaagtttgccaacttcctacatcaccgttgaggtaagaccaacttcaccgctcaaaccacgaagccaccacaagcccccatcgtcaaggggtgggcaaggtgggagccaacccacgaagtggtctcccaagcctctctcactatggttgttctttctccactccggagatggcgaacaccaagccactcataatcaacactgggcctcctccacaaccttctcggagaggtcaccgggcaactactccaaaccatctaggaggtggcaacctaggatgcttgccgaggatgatcaagtgtcacactagctctaacaattaagcaatgcacttggattagcttaacttactctctaatacctcactagataaactaagtgcacaagggtgtgtgagtccacatcagtagataatgcaatcgagtaccaaaacattacccatactgctggggagtgggtatatatacccccaaccatcaaaactagccgttggagtcgaaatccccaacttttgtgctctgccggtcaaaccgccatgggatggccggtcagaccggacatttctagccgttgcagtgcattaaatgcactgacacaagggggctggtcagaccggccacgactcggtcagaccgccaacatctcggtcagctggcctcggctctagcggctctggatcaccaagacgagacctctcttcaaattcagggcagcggtcagaccgctatgggagctgcggtcagaccggacaacacactccggtcaaaccaccataagggttgcggtcagactgcaggtcacttttcagctcaattggacgttagtaaaacgacgatatctcttgactcgggtctcggaatttgactttcttggactctatggaaagcttattcaaagggttatccaactcatgaacaattaatccaagatacacaacttaatttagggagaaagggctcacactccaaaggatatccatcggacatacccacaagatgtcgctcactccttttggacatgcatgcccacttctctctttgtttgggacttgagaaaactcatcacacttggataaacatgcccaccaaatgcacctacatgcatataaactaatatggcacaagatcaatgcgttcgcttcatagacccctcttgatagaatgacgcctatctagcaagtcaggtctacaccaaacactaacccggggaaagactatgaaaacaatattagtt

SEQ ID NO: 58130 - DNA, 3033 bp, Oryza sativa
gttttttaaagggattaatggtaaggagaagatgaaatgaggtggagatgttagcccaaacactcacttgcacacacacagctctctctctctctctctctctttcactcgatgaaacacacacatacagaggaggcaatgacagaggaagaagatgaacagcacgcaatgaaacaaagagacgcaaggaaatttcttgtcactacacaccagtgaaccaccacacacttcactttctattctccacacattaatcacacactgattacatgcttaaatagcacacacgcgcagcagcacactagccacgttttttccacactaaccggccaccagtcacatgacttagccactaattaaccactaatcacgtctctatgcatgcaggccatatctccttgcatgcaaatgcactaacacacatgcaacacagctaactgatccacaatccatgccactactcaagctacttgacttggccactactcccagccgatatccacctatagcttcctacatgcaagcacttacatgcagatcatggattttcttgatcaagctaactcatgcacgcactaatcacaactcacacaataaacaacaagattaagtctaacaggagattgctgacatgtgggtcccgctggatgacttagcaagtcaactaccacctaagcaagtcaattgccacgtaggaataaaccacttccaaaatcgtccggggagttgatttgcaacggttttcagagttagggaagggttatactcggttttacggttgagggaagctattcatacacggccatgagttgagggacgaaaagtgtacttattcgtaataaaaatcggagggatttaaagctatacgtactcctgtgaatgcccagacatttaagccgtgtggtgaagaacggcctggttaagcatttgggcctagaatagagggcccatattggctcgcttatctatttcgttagttttcattttttagagcccaggagcggctcatcggccatcgccaacacatttgatcttctcttctcctgccccggcgaggcggcgaccgccgggattgaagcggcgagaactcgccatcttttccgacgagtcaaacctagtaagctcaatttccttcccctcccctcccttccccagccaccgcaaccttcttctccagagattgatttcgtttcaaattcccgacgcaaagaaagtgaccaaaaagatgagcgggaggcggcgcgcgggacatgtgttcgacgaaatgcccccgaagaaagccaagccgtcccgcgggggcggcgctgcggaagaccggctcagcgccctccccgacgcggtcctgcaccacgtcatgtcgttcctgcgggcgtgggaggtggcgcgcacctgcgtgctctcccgccgctggcgccacctctgggcctccgcgccctgcgtcgacctccggcgtctggggcggcggaggccaccttccgccgccggagcggctcgccaggttcgcctaccggttgctgttcgagcgggaggtgtcagcgccggtggacattctccgggtgatgtccagccccgacggcgaaggggaggaggattacaccacttcagatgtccagacgtggatccgtgccgccatcaagcggagagctcgggtgatccagcttaccgaccatccaatggatgaggcgttctttaacctgggcttcgtccccatcatctcctgccacctcaaacacctgaagctgtctggttctttactgtggaacacgacgctaatgcagctctcttctcagtgccctgcttggaaattctagagctcaagaaatgttctctgcacggccatgagatttcatccacctctctcaagagcttgaccatggtgaagtgcaggatcatggcagatgtcaccattgctgctccgaacctcgtgtctctgcggctctgcgctgcatcaagccataccaccgagctcccttgttcgaggatatagggtcactcatgttgagtattatgtgtttaggggtatattagtaatttcctatctctattgtactcatatatgccctttgggctaacacaatagtaactgttcattctccaatttcccctaaattgtgacatggtatcagagcaagagcaagggatcaaaccctaacgtcgatccggagtccacgccggcacgccggtggcagctcgccaccggcgagcccatccaatccgtgcacatcctcgtcagcttcgtcgtccaccaccgtcgagccgtcaatcgtggcagccaatcgttcgtcgttcgtccacaagcagcaagcagatccagtcagcacaagcaacaagcagcatcaagcaatcaaatccacaagcaagcagcggatgcatgaacaagcattcagatccagttcttcgtcaccacgtcagtcgtagccaggccgtactcgtcgcggatcttgtcgtcgcgtctcgccgtggctcgtcgttgtcgccgcattcccattgccggtcgcggcgctctcttcatcgccgccagcgcggtctcctcccatgtcagtcgtccagctttccgtccgccgcctgcgcgcgtgaccatctgcatcgtcgccgcacaggtcaaggtcctggtcctcttggtctagcctgctctgttctctctgcttctccacatagatgcttggagactggttactggacttaacagcaacaagccatcgtcttccctaatatcaagtagcagcgacagcaatttgcaagtgtcatgcagatccaccttgttccatattcaaacatcaacaaatagcagtagagaagcccatatcgagttatgcttccctcatcatgcagccggcctctgctcttgccggatttgtgaagccatccatagtctcaactatcttgattgttgaattgttccatcaacagatctattttgtgtttgctatgcttgcttactgctgccatcaacaagtcaattaatatcctttggtcttgcaaacatatcattgtgcttcagtttgagataggcaacagaaaaccaaggcacag

SEQ ID NO: 58131 - DNA, 1167 bp, Oryza sativa
taatgcagatgaattgtttccctggtatgaaagagtgtgcatgaagcgataatctggaaacctcctcctagtgcaaaagctggagtggtaggagcagcgaataattttacttgtccttctcggaaaccgtgcgagtagatggattggtctgtgcttgcttgcttttcctgtgcccattgcgtttcttgcccaggactgaaacggatagtccctccgttcaaaaaaaaaaaaaaaaaaaaaaaaaaaaagacaaaccctagtttccatgccaaatgtttgaccgttcgtcttatttaaaaaaatataaaaaaaattaaaaagacaagtcacgcataaaatattaatcatgttttatcatctaacaacaacgaaaatacgaattataaaaatatttcatataagacggacagtcaaagttggacacggaaacccagggtttgccttttttttgggacggagggagtacaacccatatgagtggggtagtcgacccagaaactgcaggcaagtcaaatcagcaacgaacttggcgtcgcgggggaaccggcaactgggcaagtcaaatcggacccaggcgacgtacgaaagttgtggcaaaaacatctttaatttttacaatagtaaagataaagataaagaaaagatagagatatactagaaaaaatgccgtgcattgcaacgggtaaaaatatttttttattgatacattaactattaactattaggagctaagcaataaattgaaacgttaggatcggtatatattataatttaaaaagttaataaaaatccttcctttagttttaggcccaaattggtcattcattcctcccttttcaaacctaacatagtctgatacgtggtcagctcatgcctatgttcggcatgcggcttcaattgtggactgggcactcgcattggcatagccactactattttcaccttctagctggcaaagccactaccattttcattttccgaaagccattttggggccggtatgatgcggaagccatccttcccccattaaaccggatcgatttttttttaagtccttaaaattaatgggggtttttatttaattgattttttttggtcgggttttcccaaaatgaaaagaattcacaataattgggaataataggtggaagaagtttaccggttggt

SEQ ID NO: 58132 - DNA, 14604 bp, Oryza sativa
aggctcaactatcaggctgaagcactatttaactatctggagtaaccagttgcacaaaatccacagaagatcccgttcccgtgctctgttgccaattctcccccaccaccatgctcctcgccgcgcgcggccgccgtcaccccttcgccgccgcgcgcctccttccgatcccgctttcctccggcccctccttcgcctcctccaccaccaccacgacctccaatggcgcctgttcgtcctccgccgcggaccccgacgccgtggccgccgaggtggccaccctcctctcccgctgctccggcgactggaggctcgccgtctcctcctccgacctcccctcccgcctctcccccgccgccatctcctccctcgtccgacgacgcccgtccccctcctccccgcgcctccaccctaagctcctcctcgacttcttctactggtccagcccccagctcgcgccgtcggcccccgcccccgatgccttcgcccacctggccatgtccctgtgcgccggctcactcttcaacctggccaacggcctcctcatcaagatgatccgcgcctacccgtcacctcccgtcgtcctcgcctccatccatcgcgcgctatcggattctggccaccgttcgccggcggtgctcgacgtcctcgtggatacctacaagaagtctgggagggtgcaggacgccgcggaggtcgtcctgatgatgagagatcggggcatggctcccagcattcggtgctgcaacgcgctgttgaaggatctgctgcgcgcggacgccatggctctgctttggaaggtgcgagagttcatggttggcgctgggatttccccggatgtgtatacgtactcgactctgatcgaagcctactgcaaggtccgggaatttgatactgccaagaaggtgcttgtggaaatgcgtgagagggggtgcggcctgaacaccgtaacctacaatgtgctgattgctgggttatgcaggtctggggctgtcgaagaggcgtttgggttcaagaaggacatggaggattatggactagttcctgacgggtttacctatggcgcactcattaatggactgtgcaagagccgtaggtcaaatgaggcgaaggcattgttggacgagatgtcttgtgctgagctaaagcctaatgtcgtagtttatgccaatctgattgatgggtttatgagggagggcaatgcagatgaggcgtttaagatgataaaggagatggttgctgctggtgtgcagccaaacaaaattacctatgacaatcttgttcggggactatgtaagatggggcagatggacagggcttctctacttttgaagcaaatggtcagagatagccataggcctgataccatcacgtacaatctcattattgaaggacatttccgtcatcatagcaaaaaggatgcttttcggcttcttagtgaaatggagaatgctggtatttcccctaatgtatatacttatagcataatgattcatgggctatgccaaagtggtgaaccagaaaaggcaagtgatctccttgaggaaatgactacaaaaggattgaagcctaatgcatttgtttatgcgcctcttatctcagggtactgtagagaaggtaatgtttcattggcatgtgaaatttttgataagatgacaaaggtgaatgtactccctgatttgtactgctacaattctcttatatttggactatctaaggtgggaagggtggaggaatctacaaagtactttgctcagatgcaggagagaggattgctgccaaatgaattcacatacagtggcctcattcatgggtatctaaagaatggtgatctagaaagtgctgaacagttagtgcagcggatgcttgacactggactaaaaccaaatgatgttatctacattgatctcctagaaagctactttaagtcagatgatattgaaaaggtgtcctctactttcaagtccatgttagaccagggagttatgcttgacaaccgtatctatggaatcttgattcataatctgtccagttctggaaatatggaagcagcatttagggttctttcagggattgagaagaatggatctgttccggatgtgcatgtgtacagctcgttgatatcaggtctttgcaagacagctgacagggaaaaagcttttggtattcttgatgaaatgtctaagaagggagtagatcctaatattgtatgctataatgccctaattgatgggctgtgcaagtctggtgatatttcttatgcccgcaatgtcttcaatagcatattagctaagggattagtgccaaactgtgtgacatacacaagtttgattgatggaagctgcaaagttggtgacatcagcaatgcattctatctttataatgaaatgctagcaaaggtataacaccagatgcttttgtctatagtgtacttaccactggctgctctagtgctggtgaccttgagcaggcaatgtttctgattgaggaaatgtttcttaggggacatgcaagtatttcttctttcaataatttagttgatggtttctgcaaacgtggaaagatgcaggaaactttgaagttgttgcatgtgataatgggcaggggcctagtacctaatgccctgactattgaaaacatcatcagtggacttagtgaggctggaaaactcagtgaagtgcacacaatttttgttgagttgcagcagaaaacttcagaaagcgctgcccgccacttttcctcattgtttatggacatgataaatcaaggaaaaattcctcttgatgtggttgatgacatgattcgagatcattgtaaagaaggaaatctggacaaggctttaatgctgcgagatgttattgttgcgaaaagtgcaccaatgggctgctcgtcctatcttgctatagtggacaatctatgccggaagggaaaattaagtgaagcgttgaatttgctgaaagaaatggacaagagaggtatttgtcccagtgagaatcaatgcttgatactattaactaatcttcatacatctggatatatccaagaacacaatacggtacttgataatatgttgtgtcacaagtggttacagaaggacagcaaattctgtaattcagctggtgataatctggaatctgtcaatgcagaataaacatagagcagaatccttcctataaaagaaagtctgattctattattcatgttgcgaatgcatgtcgtagccttgtttttgtttattgatgaggaattaaacagattaattttttcaagaaaatgctcttgtcctgttagttaattgttacacagggaaccttcagccaactttggttgctctgcttggcatcttctggttcaggaggcatcatcatatattgaacaaggtgagctctcattagcacatagccatttactgcgaaaaattggtattaattgtctctggctgatcttgttgagatttctgacaggttgttttcactgtcttcgcaccatctctcatgtttgctagcctggcgaagacggtcacgttttctgacaggttgttttcactgtcttcacaatgcaagtgcagttactacaaaatctgcccaaattccatttccacattctaataactgccaaaatcaacacaatatgtatagctcagccagactttctggattttttgaactgtaagctctttctgaaatttataaggattcttgcagaagtgagagactctctttctgaagtagtagacaagctttacatatctagctagttttctcattcagaacacttttcgaatatctgggcagaccatatatacaatatccaaattttgtttgctgggtaactccactgcactaacaaaagaattctatcatgtaggtggtttatgccaattaacatagggatcacattcatggctggtggcactctaggctggatagcatgtaaaatcttgaaaccaccacaacatttcagaggaatgatcattgccttctgctcagctggtaactttcctaggtggattgcatgtttttaccctcatatttttgctgaataatcctaatgttaggagtgtcatcaactgacaaaaaaatgcaggaaatcttggcaacttgctcctgattgttgtcccagcagtccgtgacgaagatggcaacccgtttcggaaaagacagcagccgctgccactctcttgggctctcctattcatcattgtccatggctgtaaggaaaaaaaaatctcattcactgaatgatcagctgaacaaaagaactgacacacactgtatctgcagcttggtggcttgtacatatggacgcatacgtacagtcttatgaagaagaagagaggtcaaatgtatcaccagcctaacagcattcagggcctggacgacagcaatgaagaacatcatgctaagaaattcaaagcaaatggtgaagctgcttgcgccgatgaggaggcaactcttctggtgtcagctaaactggctgaacacaacgaggagaaccaaatggtaggctgaacaaaacttagtactattaacttgtctgaaattcaggaagctccattgctgtctggagagagtgagattgctaagaaaggctcgtggacaacaacaaacttgaaggacaccatccaccatgttgtcgaggagctgatggcaccaccaactctatctgcggtgtgtttctgacaaaaccagcacaatatttcatctaatcaaccctgtcttggactaaatttggttattcttgcttcagatacttggatttgtttttgggctagttccatggttgaaatctcttgtcatcggtgatggcgcccctctcagagtcatccaggactccatccaactgatggggtaagttagtatttacagtgttcttcttcatagagtatttctgtctatttttcagtgtttatttttcttgtcttgcagaaatggcacgattccttgcgtctccctcatccttggtggcaatctgataaaaggtaggatgtcaattactcatgaagctgtgtgttttctgaacttgctctggatgtgcatgagttttctgaacctttatctgaatgtttgtgcagggctaaggaagttggagttcaagcatacggtgatcattgcgatcgtctgcatccgctacatgatccttcctctagtggggattgcagtagttcatggtgcatactgggtcggattcttgccacacgacccgctgtaccgctacgtgctgatgatgcagttcgcgctgccacctgcaatgactattggtaatctttccctataacagatgccattttcttcgtactatctgtatttaaatatatgatgctgatgattttatttggtccttaatgtacaatgttgacctctattttctgttacaatacaacattttttgtagctaacaaaattataatattgtaaaagtacttagcatgaagaaaaaaacatacctatatgattttttatgtcttacactaaatattttgagagctgttgtgatcaaagttttataaaagtataataactgaataaaatcaacggtatcatatatttaaatacaacgagagtacttattttgcgaggcaataccatttcgttctaaagcatttatctctgcttccagtgagatctcatctgatcatacctcttgcatgtgtgtgatctaatccaggaaccatggctcaactgtttgatgttgcccaggaggaatgctcagtgatatttctgtggacttacctggtttcttccatttctctcaccacctggtccatgatattcatgtccatcccgtctttaggtcaaagtgcaatgatttcagcatttcagctaactcaaagggaggaggttgaagacaataatacgcctctagaaaagagtcgatccaactgaggcttgttcgtgtcaccgtttgcaccacctgtataaaagaagttgagcagtttaggcacacggttttttttctatcccaatctattggttcatttaattggaatggttttcatcttttaagggatattcaaattcactgtttttacatgtcatctaatagtcatgaaaaatttaaattttttagtaagatagatcaatatatacgggtatatcacttcagatacatataagtttattaaaaagttgatctatacagattgaaaaaaaaaaggctatgaagtgtgtgtattcacaaacatattttagatagatcgaatttaaatctatgtgtttttgaagtgatatatcatgtattaattaatcttatcgaatttacattaccatctattttttcaataactatgtggatggcttgaaaaaacacactaacggataaaatgaattttcctatttaattatttctacatatttgtctgttagtatatgcccgtctattgagaggtaataaaaccaccacatttactttggagttctataattcatcaccatattaattaaagaaaacaagaaataatactattaaattatggttggctagattatagctttaactagacgatacacaacgcgttgctgagggattccgaatcttaatgcaagttgaagtgtgtgcttgatataggagtatattagaatgtgtgttacaaagtatggggcatagatgcgtacagccaaacgaaaggaacgtgtaaatctaagggggcagcacgatgcataagtagtaaagtagatgctaattcatttattgttgtcattaccatcttcctggagaaattgagaatgctttggagccttggaggtgttgtactctgtgcttatttgtagtataacactacaccacgacataggtacagaaacgcttgacctgttgggataagtacttaggctgtgttcgcatgcaccttttcccatcccctcttcttcgttttccgcgcgcacgtttttcaaactactaaacggtgtattttttgcaaaaagtttctatacgaaagttgcttaaaaaaatcaaattaatccatttttgaaaaaaaattagctaatacttaattaatcacgtgttaatggaccgctccgttttccgtgcacaggagttaggttcccatctccctcatccgaactcagccttataagagaaatggtcgtgtgggctaagctgtgtaactggtggtgtgggctaagctatgaagctctgagcctctcactgtgaaagaaaccaatacatatgcatcgagacaggagccaatccaatctatttcagaactaacatgcgtatctgacctctttcttgatgtggagtatcttaaataacatttaactatggatatattaattaatataattttatcatgtaaagatcgtgactgaaatactaattagaaaatatcatccgcttaacatgcccatcggtgtaaagtgtggcacttgttgagttatattctaaggctgaaacggagccgtgtttaacgcatgattaattaagtattagcttttttaaaaaaaaaattggatcaatatgatttttttaagcaacttttgtataaaaactttttgtaaaaaatataccgtttagtagtttgaaaagcgtgcgcacggaaaacgaaaaagaaaggttgggaatgggcacttccgaacgcagcctaagtgatattgtttgccacatccttcaatggcaataaccaaaaataacatgtaattccgggcaaataaacgttagatagcaaactgggaaaataattctactaagtatgaaccatgctgtaaacattgaattcatatggtaacgaattgaaatggtggttttattttggagaaaacattaaatcagtcgaccaaaaggaaagaggacgctggcgtacactgacctgtgctagctcgctggagcgattgaagaagatgatggtgaaagggtggtatatgaatccagcgagaacaaacttcagcagcaggagcaaaatgaactggcctagtagatcgacgattatttgcgagaattatatgaatatataggtagaatggaaagagggaatctgaaacataaatatattcatccattaaaattgacccttggctacctatcatgatggtatctgttctcagaagcaattgccttcgctgccaccatcgagggttgtgcgtgtgggagttcacttggagtctcagactgctcgcatgcctcatcgatttggggaggctgggggatcggatgctctgggccagcaagttaagttgggctggatttgaccagtaaccgagcttttcgacataggtggacaggtaactaaaaaagcttggacatgtagatcgtatctaacggctgaggatttattgatgacgtggctctatgagaagctgctgataaggacacaactagctcggatataaccataactaccttatgtattaatcaaccaaaggtgcatatattctacattagatttactggttatatatttaaacaaacattgctacacaatgaattttgtgtgttttcgtttgcagaggtatttgcttaggcgaaagaaaagagaccgagtgtaaggaatatatggatgattaaagaagttgattggggaccaaaccaagaccttctccaagtccacttctacctcaccacatcacttttggtccatagaaaacaagagacaaagttctatatgttttggattcggattcgggtctcctgacagcatcaacttcaaacggacttagccgcttatctaaaaggaatttcggtgtccatgagtacttaatggaaagcttatggagtctattttcagatggttttggtcccacatcaaaattcctactgagctaccgggattctgcaaaacaagccacgtatatcatccagttcgaatctgatttgggttttgggctttgtaattgtgtcgtgggcttagcccaagggggtgtgcgccctagggcaactctaggacgtccctaatgatacttattcagtagccgtcatcgtttagagtcgggttttgcttagattattctgtcaagaatagattcgccgctagatcggtttgtgaaactccaaattcgactacttaatcattcatatgcaatttggttgcaatctatcttgttcttgcttgtgttctttgattcatatgcagggattagccttctcggcgaggtcaaccgggtttcagtacggttgataactagagaagacgtggtgctgcgattgcggggctcagtagcatgttcattcagaagccggatcgagttgtgtcgcgactccgcccaaatcaactgtttatcaatacctatcggaagatcgggacctaacatctctcattagctgttttataggagtggattgcaactatatagaaaagaaggatatgcacaaggaggttaatgcagtagtgcgaaaatggtaatataatattctttgcctgcttatgatcttcacactggttttagatttcttcacactgtttgttgggcactagttatttctggggaacttttagcatcagatgcagctaatacattgcacataactaaatggtgctaattcctgccgtatactccatccattctaaattgatctacatatttcatagatacaccaagaccaagaaaaactaataactctctcatactatatttactctagcaacaaacttgatgcatgcaccattcccattattttctagccaatatcaaattaagatattgcatgtgggttataaatacttatgtgcatggatatatacatcaatgtccatttactccaatgcacaaataacgaatagacttaatgaatgaacacaaatatgtaaattatttaggaataacctcaaaaaaactatatgtagatcgatttggaatggagggagtacaataatacaatttattattgtaggatctgttagtgtttggctattatttattttgaatgcttttagcctcttgtacttatatcatgaagctctttttgttgttacagcagtgtgggaagtatattttcttcctctgacggaatggataatttgttcccggtggaatgctttctagtgcacctagcatgttctcatggcaaaggcgacactatatctctggaatacgaacatggcaaagggttcctgctctatcagggctcatttggcagcccggcctattcccagggcggccggtccgggcggaaaaatttcatgggcccattttctggaccggccagatccacgtcccaagggaaaaatcccacgtgtcgggaggtcaggaaaatttcctcgcgtcgctcgtgtgccgcagcgacgattcccctctcgcgaacgaaggtcgccggctcgccgccgctccccttgacgtcgccgccgccggtccttccccgagaaaaatgacaatacgccactcttatggtgtggtcctaataaaataccattcaatataaaatgtacatgataaaataccatacaatacgcagacttcaggatattttgtcactatggagagttttacctattttattttattttcttcatgtttctttttctcccttgcacgtgaaataactgaaatgcccttggctgatccaaatagatcagatcgatctatacttcagcagtcatatccaaaagtttcagattcgtagtaagcagacataaaaataacaggcatagacaaaatagaatcaaactcaacttttcagattcatagcagcagaagaagttcttgtccaaccgagttccaaggcctgcggctcggctgatggggaccgaacgagtgagctgcgctggggagagagacagggagagagacagagggacaggggagtgcgggcgcgggcggcggcgctagaggagccgcgcggtgggtgggcagcgctgcggaggtggcgggcgagcggcagggcgtggtggatttttggatcgacaagggattgatctcatctttgtaaagaagacgagggcacttcagtcattccacgtggagaaaagaaaacagggcgaaaataatataaaataggtgaaattcttcaaagtggcaaaatatcttgaatgtaatgtattaagtggtattttatcccgtgtatcctattgagtggcattttgttgaaaccacatcataacagtggcatattgtccttttcctcgtccttcccctccagcgagatgcaacgccaagcctccctcctccaagatctgggttgagctgctcttcacatcctctcctttttctaggttttttatgtgatgcacgagtttgtggttgagtcccatctttactcccggcgctcctatcgtcctctccttcttcgggattctgcctgcacatcacccctagtgacagttgtgtgggtgattggatctccccagtgaggtgactctattactactctttttcctttcatctccctcttcaactagggttcttgtagattttagcaagtcaaatttggacgttaagggacaataagatctgtaggttgcagggtggattctaattgaacttcatgcaacagatttgaaagttcatctctgaaattgcatcttttttctctataatcatggattgacaaaatttggtgtacatatagcagctaacagctcgttttggtgtacatatattcagcttactcatcaatgttcctgtaataaaaataataatatgatttgcagtgttgcacttcccattgcaatgtaaacacctgtgttctgtagctctccttgaatttttatgttgttgtctgaagactaaccagccaatgaaaatatatcttttattcttgcccaaatgacagtccagtagcttgctgttttgttatcagatacatttatatgcatgctacattgttttccgtgctacattgcccaaacgacagatggatttaaatatttagtttaaggcctgcactgcagagtgctgacaacgctattcctctccttgcgagtcgcgcccagttgcaggatgccaattctcaggatccccgctttcgcactcttgtgcaagttgattggtacaactccgttttcatggcaagaccccatccagtggtagagatgaagtatgtggactggatattcatgaggcacaagaacaatgcagtctttaatgaagtaatcaaagtgtgtcaggcaaagaatcttggggagatccttgctcttgagtatgattggaatgaggagattattgggtagttctatgctacagcatattttggcaccaccaagaagggcactcatttcatcaagtgaatgactatggggaaacaatacagagtctccatgggtcagtttgctgctgccttagagcttgatccagaggatctgacgacgcctcatctctttgatttggaagccttattgatgcacaggactagcttcatgtatgagaaaggaactccttttggttgcatgggtaccactcgaggtatgcatcccaactataaagttatctattccatttccaggtggtccttgcttccaaaggttggggatgccacaactgttcctaccaagcatgctcacctcctttgctctatgcgctaccagtgccctgccttcagtgttatgaagctcatttggtttgagattcttgagaccatctatgatcctaagagaggttgcatttatacccccatacattatgaagatgattgaggaaatgataggaatttacttctccaaacaacgtgattagaaggctttccaccctcatgctccttcctcttctgctgcggctccccctcctccatcccggtctactagaggtttagcttcagccgctccttcagttgctcctcagcgctcgagctcttcttctaccatcaagaaggcacttcaagctatcttttgtatgggcaccaagatagcaaagaaagtcaagaagattgagaggcatcagaaggaagattggaaggctgcaggcaaggatgtgtcagatgtttctgaggatgaagcttttgaggacccatttgctgcatatgaggctgctagggatgtggctgccggtgagggtccctctcactccttctgtgagaactccacgtctagtgatgatgatgatgatggggatgaggtgccaaatgttgagtcagaggggactgatcctgaggctgctgtggatgctgctgtataggagagtgatgctgcgactgagaaggttacttctgatgatgcctctgagtggattccctctaatgccagcactgagattgtgcctttcgatggagacgaggattgatctccttcatcccttgtggtttggtccctttttggtgccttgatgccaaagggggagaaaattgcaatcgaaggaggtcaagttatctttttcagccttgctgccattttgacagtttgtccggaagttccggacctttggtcttggaagttccgggcagacttctttgcccccctttcactcctctatctatatggacatgtaaaaattctatgtgtggatgtaatgactgttaggtgctaagtataatccctgcatcacttcatgctatgattgccttatttcttgttttgtgatgtgataattttatctttttcggtgcttctcatgtcatttgcttttaatgtcatatttatttatcgctcttattacatcccatgaatgaaaagggttgaaggaaactctccatgtttgctcccttcctaatatgcatatgagcttcactcatattttccatatgcatattttaagggggagtttcattcacctctatcgattcaaaacttaatcttatatcaaatcctttgtgagctttaaccttattgtcatcaatcaccaaaaagggggagattgaagttgcatttatccccctagtgggttttggtgattaatgatgaataaggttaaaggactaatgagtttattgagttactcaggtgattagtcccaaggtgaacttaggtgatcaagagatgcttggaggacccccccccccaccaaccatcattcaagcggatttgaaactcgaaggacaataggatagtttaatatttgaaatcgagttttaggaaaaaccgtactattaagaggggctccaagtgtggttctgggatataaaaagtgctcttagtgagatccaagtggtagaatatttttgggagctatttttggaaatggctctggcccggacagagaaagctggccagaagttccggtccctggacccggaacttccgaaccttgtgagttgtccgaaagttccgggtgtcaggaagttccggactccttccagttcaaaaatgtgagtaacggctagatgacgttacctagctgttatatatatccagatcacacctagttcttttttttttggccatttcacttcagttctttcataccctaggttcttctagcctctcccaagatctctttgcttcctccatcaaatctagagacattcttgtgagattgagagaattgatgagagtgtaggagtgatttggagaaggtttgaagattaggtttgattgagcactttggatatattgtgggctgtcacttgggcttattactcttggagatcttctcctatacggttaggtgtcgcccgcgagcttccaaagatcttgtagatgtcctgggaagatttgtgaaggttttcctcacctccgcaaggaaacgaggtaagtgagtaaagattcttgtgctgagatttcagaggttctcctaagtaaagcaa

SEQ ID NO: 58133 - DNA, 774 bp, Oryza sativa
tgattgtctggccttcgtgttagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgatgatgtgctcggttccgatggcggtgatgcggttgcagcagtgacggtgtcgacgacgaggcgtggcgcggcggtggacttcccgtcactggctgcgccccctcgatcggttagggtttatggggtggagtggcggcggcgacgaacctcgttccttgtaacgttatcccgtcccgtcctccacccctctttatatggcacagtgtgacgggggcccaccagcgattgggctgggcgcccccgatcagggcgcgggtcaaggcccccttgagccgttgggctcaaggggagggagatccatctaacacttcgtagttctgtaattgtgttgatgattgcaactatgtttatactcttcattttctcatggtgtcaagtccaacagctgagacatcttggccacattactgtgcatgtcgcctgctctagtatgttataaacgttatctggtggccaatactatttcaatgatggtttacatttggaaccatttaatcagggaagcaagtggtgtggacaaacttttttttttccacttatcacaaatttattttatttttttc

SEQ ID NO: 58134 - DNA, 909 bp, Oryza sativa
attgtgagcacacgtatactcatttaagaaggtgattgctgctaagatcattgtaacattctctataataatctttctaatatgtggaacctagcttgcaaagggcatatatgcatgtaacgctcctttgcccccatcccaacccaaaattgaagtatcagtgttttgtaaacacactttccatgcacatcgaagcatcggtgtcttgtaaacacactttccctgcatgcttcatgctcctctttgatttgcagaaaaatcatttgaattttggaggatttcaatcctagagaaaaaattcctataaatgcctttggtacagatgattaaatcatgtcatatcctttaaaattcctatggaatggacaatcctatagcgattttgtaggaaatttagtaaaagcttcaacctcttgaaaattttccttcgagtatttctctctcaaccgattcctatgtttttcatgtagtccaatcaaacagtcattcttatgtttttcttttattttgtagtcatctgttttgcacttgcattagaatcatctgttttgatttgtgggcatggaattcaaaagcgaagtctgatcaaacaaacagatcatcatcacaatgcaaggtgcatatgggcgaggtcatcaatcatcagactgatcgtagccgtcgcatctgtcataacagtagtaatcatcatactcgtcataaccttcaagggcggaaggaagcttgacagtctttgatcgcggcgcactttgctaccagggcgtcctcgacatcgcaagatcgtagcagttgcttacgtcaaatagctcaaggcagcggcgaatctagaataaaaattacccgggatccactacatagtagttatctaattattcactagtaaactattcaaaatagcacataattagt

SEQ ID NO: 58135 - DNA, 16425 bp, Oryza sativa
tccccccaacgtcaatattgggctatcgcgttgtcacagtggcaaggggtggtgccgtcccattggacgatggcgctggctactctggcacaccaaaaaggacttttttaaataagttttctcaaggatatatttatataataagtttttgaaaaggaccaaattgtaaaaaaaaatcccgtctcttccgttccccctcaagatctaggatttctttcaggcctaccagccacagttctccgacttataacgccattcaccgttcaaattatttcgagaatataaagcaagtgtaatgcacatgctatgttagtttttgtcagaaactaacgtgcccaaccacacaagcacttggcctgtgaatgtggacattttgcaaataggaacgggtactaggctactagctccctagcaattacttgctctgcaaagaatggtaacaatggtagtatgcccattttggtagtaaaccagagccaactagaatactataaaaagccggaattgctccttccctcctacaacattgggtttttagcctgagaacgatcagattctgaggctgcaaatggtataactacagtacaacataaggattaaacttctgactaatgcctgtaaactgtgccattggaatgtgccacagagtcgtcctgcagaatatcattgacttctggcaagaaaccactctcaaagaatgctgagtggagggcttgaacgcactgctttgcctcactgtcatggaccaccaaggaaatgttcacctgtttaaggatgataggtttctttcatcagtcaggaatcacacaaaattgcaatccatcatcaaaatcaaacatgaaagaaaatataagcaccttggatgccccttgtgagatcatctgaacattaactccatttgtacgtaaaacgttgaaagcctgacaaaatgagaatggatatcaaccatgtattgggaagaaaaacaaaagctgtgttccatgctgcttgagcaggatatttctgagatgtttcccacaagctagcattaaacagatattaaccgtagctgaaattggaacttcagaacaacattatggatgtagagacagttaaagttaggggacaagcatttaccttttcaagaatcaaagatgacctctgcacatttccaattaacgaaattatcgatctatgctgcagtaggtgaacaactgctatcttttcaagttcttcgatgacatgatcaagttcctggcacatatcactagagatgaactacaagcacatcaagctggaagatgcatcattaattggaacctagtaacttgttcatttgtgtcgaaatatgctagagtcttcgaagattatcctcaaccaataatttgtttttataatttcaagatttcatcaaaggcacaactaccactttttttttactgagcacaacattcaatattccttatcttaattcttgaatgattcatagttctagtatatttacttccttatgcaatataatgcctgcggttgaggtcctgagcagatttaaatatggtagtggcagtttttttttccttggtacaaaataaaaaatgaagaagactgctcaacaagatcccaaaaaaaggcagcttggacaaaaatcaaataatcatgagaaataataaagaatggattcaggtccaaacatttgcctgcttgatcaattcacgactccagagttttgatggatccagggtcaaagatatgctgacttcacttgtagctacacaatcaacagagatgcccaaatcttcaaaaattgaaaagacctgaagaagcaatacaaatattacaactaaaagaataaaatacaagattaaacttaagaatgtgtaagctctagctgtaccttagctagaaaaccatattgtccaagcatccgtgtgctcactatatcaagcattgtaatatttgatttaagtacaatactagtcaaaacagtctgaaaaagtcatccaagactcaataagttgcaaccaacaagtagatgagtccaatattagaaaatagtcaagcatcaaaccttactcatatctctagctttagtaatgagtgtaccaggggctcggcggttataagagtttttaaccctgacaggtatatcaccttctctagctggtcgcatcgattgtggatgcaaaacctagaattagttagtaaagggatttctgtaagcagataacaaatggatatatagaagacaaccaattggtcactaaattattaagctaaaaagtaaaccatctaaaagggaaactgttttactaaaagaaaacccactgaaaaaataacattgacttttacaaatggatagataaataaaagtgataaaaatcatgcggtacctgtgcaccaaaataggcaagttcagctgcctcatcaaatgtcaagtatggcacaggtttcgcatttggatgaatattaggatcacaagttaaaacaccatcaacatctttccaaacctattaggatttaggaatatgggaagaaatataagttcactgcattgagaattaaaacaaacaagtaaaacaggatgcttagtaggaaagtaaatttgagcaagttctgataattacaaacatgagttggtgatggcgatggagagtatgaagctctctctatgctgacattacacttccaatgattaaatggactttttgcatggggctaatggagtgcatttgacgaaaggctaacgtaatggcaacagggaacaaaatgggcattttttgtccttactgaaaatagtaattgtcaatggtagaggttaccagaggcaaaataatctaattgcaagatatggtatcaactgtaaaacaaacctggatttctcttaatcccaaggctttgccaatggtagtagctgtcaggtcactaccacccctgcctaaagtggtgattgcaccagttttccatccctacaagttcacatgtgaacactataaggacagatggagacatggagtatcggtaccattcaattaaaatgtgtaaaatgggttagatggccaacctttccgagaaaaccagtgactattggaatagcaggaccagtaacccagtccccatgtagcctctttgcaatggcaggataagttgcttccagaatatcagcgtttgtgaaatcatcagtggttataaagcctatttcaaatgcatcatactgcaaaatatcaagaatcaattaattatagctgtatcaaaattctgggtttagctaaagtatcattggtataacttcaaaaaatacgttgggtatttcttatctaaagaagcacctgttggatagaaaagaattaatataaattcagaacacttgtacatttgtattgttttcggtacataaatgacttttgctggctgactgctaggctatacgaactaaaataatactgaaaatagcagtaagcactggctatattcagagatgtcaaacaagaaggaatatttaaatcaacaaggtagagcggataaaagaaattcaattgaagagaatatacctgacgtgctttcaccccaagtttattcaaaagtgccgcaaatatccttgttgacatgcattcaccgaaggaaacaagatagtctcttgtcctaagagtaagctctttcatcatagcaattcccttaagaagttgctcaagctcatccgacaagcctgcaatatttcatattgactatggtaatttctatgttgcgtctatcaagggtaattgatgtaccaaagaaaatggaagctaatgtaacattacagcccaataatgatctaacaatgctttccacaatcactctagacataagcaatttatactaaagcaataaacaccatacatttagcatagtataataaagcaatgccagaaactagatagagattaatacattatgagtaaatttcagaaacctaactaccctttgtgaaactaacacagaacggcagttgtttttacacagaatttcattaaaccatactttcaagtatttccatcatattcaacagttttcttgataacaatgataggcttctgagatcgatgaatgggtgcaacctaacaaataggaatgaagtttgagaaatcatgctacatgatgcacgcatgttgtcatttcatctaccctatagttcaacaagttgttttactcattcatcatgtgacacatccaacgattgaaaatcaactgatgagttccatccgacagcgtcacacctccctcccgatccagatcagatcacgcacctccctccccacccagatcgcgctcacccctcccaggtcacgagcgcctcttcgacacctgcctccgacgttgacaccggaaaccgcaccgccctcttcctcctcgacctccgtcgattcgtactcatgctgccatccctccgccgccgatttcgacacctcaccgatctccgacaaagcgacgccgccgctgcgtcctccgcctcaggcgccaccaccgccgatacatagtcacgtcgacctcaaggtccgttcactgcacacaggtaagctcctccccttttttccaattctccaggaccacggtgcctaaccctaatcgcgcccctcgatcaacctctctcaagattcgccatcatcgccataaaatcgccgctgacctcgactcctcccgtcgtccactgactcgtcgctgcaggggggctggcaactcagccaacaagacacaggctcgctatccactccgtggcgacggccgccgtacccaaccttctgcggcctaatacaccggcgctccatctgccgacgcctgattcctgaagcagtggccactccacctccacgaccgaacagagtgacagccatcttcattgcttggtggaatgcctctaatttgagctggtactggtacaggctgcctataagtatatgcagtaagttaatttgagcttcataaacattgtactacagaggcttgcaacagttggggacaggaccaatttataaggatgacacccttacattgccactctgccatccgaaaataatcaggtacccttcacttgattagttgatttttgcatcaacaagaattatagctgctaatgtgttcattttcatttatctgcacactttgtcctcggaagtcaaaactgtaaattcactaaagtatgcattatgttgatctgttgtttaaaaattcagtaaatagaaacttgtttagcatctgccaaaatgttgtttttcagatagcttacacttgctgcagtagttactattatccagtgatttgctgctattttggcagtgttcttttaggtaataagatcactgttcattcttgcttcctacagctgcagatgttcttcaagccgtgcagttgttgatcaagttcttcggacctactggacactggataactgatgccaaatgtccttgttaaattgttatatagttcacgatatactagagtacaattagcactatctgctaggtgcttatttctaattgtatagtcagtggtaggtaataattgttgcattgataaacaggtgcattagaatcttcagttctccgtaagatagtcttgaataagtaaatatgccttttggtctgtggctctatgctgatgaaatcttccttctagatgagcttgtgtgttgttttgcaaaataaactttgagtgcaaacgtacaatttattgagatgtcaactttgtgtattttgtagtttgcactactaagtgttctactgttccacagatgggtgtagctgctgccaacttatctagcagagggattttcagtctcttatttactactgaggatgatcaggtccatttgttcttacactggggtttacagattgtgcattagatgaacacaaatcacattgctaaaagctgtttcttagtggttcggcaaacctaggcagctagatggccggggttggccggggcatgggtgtgtgttttcacggtaggagggctttggtctctcctactttgtttttttttcctttattttcttccccttaatgaaatgaaacgcaattctcttgcattttcgaggaaaaaaaacattgctaaaagctgagtacctctcatgtggaatataattgtttcttttcctttcctttacaattatcatgctgattagaatagttaaagcttgcttttcattgtagtgcagacattttagacataaagaaagaaggtaaacagagataaggtaacagaagcatccatgttcttccaaggtcacagcacactgaagtatattttttctttcccagatcacatagccttaatgtccagtttctacttatggcagcttattgggatgtgcgattttatttatctcagtatttctcatcagttaaccaacaagctcttgtattatttgtcttgctttattctgtttttttttcagaaagtaatgggtctttaacataatagcataatatttatgttgccttaaattttgcagcgatggttgcttagtggcaaaatatggttggttctcttttccttttgcagttgaacttagattttaattatttgttgacattaaacgaatgaaacgggttcaaatattgcaatctttgttgtaaagtgctacttgttcattgtattatatgtactgttgtgtaagcaactaataagtatagatataatagtgatagtggcctatagctaaatcaagcatacaaagaaaagtctatactagaatgtactatctgctatccatttagaagtaccaatctgataaattttgccttgtagacagcaggagcttcaattgctgcttcaaggtatacaaggcaactatgactcctccatcaatcataagtcgaggcattggctgacaggtaaatgaatccaattaatatttatacatttgagtttgtcctatctttgatttgaaacgttgaccatcctaaaacataaccttcagggtatgagcatcttgattgattcttttttggatggccaatgaaacctcagtttcagtgtaaggcttagttttttcttcaacttcctcgttttccgttagcacgcttttcaaactgttaaatggtgtgtttcttaaaaaagtttctatatagttgtttaaaaaaggcaattaaatccattttttcaaaattataatagttaataattaattaatcatgtgctaatgaggtttctcgtttcgcgtgcgtgaaaaaatttacctccttttggaagcatcgaacggggcctaagtataacattagaggataaatagaactggcagatcctagattgctcagataatttgcctgtacttggaaaacacaatactcaatttatgtgtgtacatggacagcaatactttaaactgttcaatggataagacatgggatgcaactgatgctttcatggctggtaggttgatttctctttcaaaaatacatgcttaatgtttatgttctaaatgtacttattagcgttggtatcgtactaagtatttttattatctatctacgttaacatctcaatatataggtaaccatatggtaaatcctcgatgagggcgttgatacaagtgcattgggttgaatgttgaagctggccagtgcctccatatggaactatgggagagatggatttgccgatttataaaaagaataacaacgttactcctcctaacgtttaactgggtgatgtgagcagataaaatagaaggaaaattatgtttggtggcaggtgtatagaaaaagctatatttttatgatttctaaaaaaaaatgctagacatcttatagcagataataaattttattgtaaacgaggtattcatcaaacattagatggtgttggatacgcactgattgtgaatttatatattattaggattcagatggtttcaaaagatgaaaaaactgtgatgttatttttactagtgtggctatgtatttaacaatataataacttataatgtcacttttttagtattaaatctatattattttatttttatgcttgattgtcaaaagcatatatattctttatattactaaatgctaccgtagcattagcacggccaaattattagtagtaatagtgttgcaaaggcaaaatgacccatgcagcatgcagtgcacattctactgaccaatttgaacttaacatcctgtattccacttcaattacaacaaaaagaaacaaaagttccctgtgcacatgtttcatgacctcaaagttctccaataccatagatgagacttaaaccttatatagtcggaaaaaaaatgctaaagcaagtgtgaaatgtctttaccggaaacaattgacctatccaatccaagttgatcaatggtcctagataaagaaaaacagcaagaaattaggtaaagcgtttcaaatcaatccacccaatgaaagtaaagcattttgaatcagaatcacacccaaaatgcaattccttaataaaggtgagctcatcaagctccgacacatttgttgcaccacagcccaccgctttctccccagcctagaagcaaaatcaaggagtcagtgcttgagacttatcaaacacctctctatcacagaaccaacgcgcacgagtattcagggtaacaacagaactggggttctggtgcaaggaggtaggtataccatcagaagcttgttggtggtcttccccatggcggagagtacgatcaccggccgctcctcggggaagctgaggatgagatcggccacctcccgcatccgctcggccgacgccactgacgacccgccgaacttcatcaccacggtgagctccgactccgtgtgaccggcattggccccctcccgcgccggctccaccgcgcgactcttcttctcgacgacgaccgcgctggcagccgcacttcgctggcaccgaatccccgcacccctcctccggccccgcaggcaaggctcggtggcaccgaccagcagctcgaaggcagcctcattcccgacctgcggggctgcggcggcaccgcggagagcaaccgccgcagagggccgcgggttgcaccggagagccgccgccgccgccatgtggagagagagtagggagggaaggaggcgccgggtggccgagggcgaggaagagagaggggaacggacggcggagaagggtctaatggacggcgcggatgagaaccggcgattctgcgtttgaacgtttggcccagaatcctccgaaaagaagaggcactgtggaagtgaggcccacgcagccggggagcaggggcggcccgcggctgatcgcgaccaattgccacccctctgatctctttgagcaagtttaatagtatagcctagtactaactccaatacatctataccaatttatacaatagttacttactatactgttaatatatggtcccacatgtcatacacacgttgcgtcttagagtccgtgctgcagctggctacagatttgtagcccgctgctcttctctctcatcttttatataattaaaatatgtttatagctggtgatgtgaccatggttactacggatacaaccgttgctcacatcatggatgaacaagatgctatcaagatcaagtcctctaagtgctagaatccgattcggccacttgctacactgctgatttcaaacggccgccgaatctgcatacgagctccgttttcggcccgtgagtacttgatggaaagctcttggagtcctctttccaacggatccagcctcatcaccaaattccatcctagtcaaccgcagatgaagaaacaagatgctgcatcacctgtcatgggcctttgggcttgtaactatgtttgggaccccggcccatgtagggcccatgtggggtgcgtcccaactaggtggaggaaggcctagaggtcctcccacctccttaaatagttaggtaccactctagattttcttgggttttgtttagattaaaatttagctttgctactttgctgtgtaatcccgtgatcggtttgatcgccagtttactcgtgacggaaccacaacctatcatttgtattcaattcctatctacaattcagattgcttttatcttgttcttgcttgtttcttcgatttgcttgcaggaataaggttgatctgcaccggcaagatcaacaacccacggagaggtgtatcgatcgctaaggcgcaacacaacaacgtcttgtacggttgtagtcgggtcgtcaacgcttctcccaaatcgtagttatcatcaactcaccgaaagatcgggccaaagaacagccttgagtctcgagtggagctcagggttcatcagttggctattactctgctattgtacctgctctgcgtcccagttgttcccaactccccctcctcatttttcacgcacacgcttttcaaactgctaaatggtgtgttttttacaaaaagtttctatacgaaagttgcttaaagaatcatatttatctatttttgaaaaaaaaatagctaatacttaattaatcacacgctaaatgttgcttcgttttacgtgcttagtgctgcctccgtcctaaaatataaaaatttttaggattggacatgggtattaagaaagtgggtagaattaaatgagagaaggttgtgattggtagaaaagtggatgtaggtaagaaatttgaatggtgaagggttatgattgattaggaagagaatgttgatgaagaaattgttatatttttggacaacccttgagggctagggagtatagccttgtttagttcgcgaaaagaaaattttttggtgtcacatcggacgtttgaccggatgtcggaaggggttttcggacacgaatgaaaaaacttatttcataactcgcttgtaaaccgcgagacggttcttttgagcctaattaatccgtcattagcacatgtgggttactgtagcacttatgggtaatcatggactaattaggctcaaaagattcatctcgcgatttccatataaactgttgtaggatcgagatgtcgactagaggggggtgaatagacgatttaaaattaaatgacacctaatcaaaactaacctaagttgctaggctcggtgagggacaagtctaactaagcaactaagttatattttgcaatcctagggtgaaagtggctcaagtatatcactaggaaagtaaatcacaattcctaagtctagtttagcaatcctagggtgaaatgatctcaagtatatctctaggaatgtaaattgcacaaatgtaaattgcacaaatgtaaatgcgacaaataaaacagacaatgagacaaggaatttttcaccgaggttcggaaactcgccggtttcctactccctgttgaagcgtgcccaactccaccgctcaaccatgaaaccaccgcacgcccccttcgtcaaggggtgggcaaggcgggagccagcccacggagaggactacccaggcctcgatcacttggggtagttcttccttcactccgaaggtggtgaactccaaaccactcacaaccggcgccgggcctcctccacaatcttctcggagaggtcaccgggcaacttctccacaagccatctaggaggcggcaaccttcaagagtaacaagcgatgacccggctcggagatgataaagtgccacactagctctacaatggaaagcaatgcacttgactcttggctaaatcaaccctcaaacacattagatggatgaacacaaagctccagtgggtgtgtgagagatgcaaggggtgtatgcaattgaagtgggtgccaagagactccccttggtgctagtggaggagtatttatactcccaccaaccaaaactagccgttgggggcgaaatcccccaactcagtgtactgccggtctaaccggtggtatgtggccaatcagaccgtgctactctacaacggttagttttatagccgttgcagctctatcagagggccccatcggcctggccggtcagactgatgttgagtggtcggtcagaccgcccatatctcggtctgaccgaatacggctccggcagctctgtatcgggcatcccagaacgcaccatcccggccaccagggggccggtcagacagcacaagtgccgccggtcagaccgacattcatgccggtcagaccaccacaagctggccggtcagaccggcttagcgcacgcggttagaccggccctggtaaggctgaacacagtgaatagaatgtgtgtgttgtgaaatgtgagcacaagtctaaatgcataattacctaatgtggcaattaaaatcatctatttgctaggtcattacccctcttaatagtacggcgaagctaaaaataaactagcaaatttgatcgccctacacctcgatcaatttaaaactaaagcactagttttaccatcttcttttttcgcttcgcgccaacaaattttaatccattgataatcatccatgtgcacatatgacgtggtactaacacacaatatataacttaaagagaaacggttagtccacaattagcgcttgtcattaattaccaaaattaacaacgagggcctagatgcttcaatctccccctttttggtaattgatgacaaacaccataaatatatataatcaaacataaaacacatggacattttgcaatgaaatgaaaatgctccccctaaacatgtgaatatcaatcacaaataacaaatatggaacaaatgcactttcattcacatttcaacatagcacaaacacatatgaaacatacaatgtgaacttcacatttggatcaaccaattgcataagatggtcacaaatatatcaatatcacatcaaccatctatcatagcacaagttcacaacaataacaatccaaattatagaagtttatccatatatcatccaactcacaaatttgtccaaagagggctcacaaataatgatctaggctattacatgaccacgaagggtccaaatgacatagagttcaacaaaacgaaaaagaacacacaagatagagtaatagcccatatccatacataatatagaccaaacaccttaacctactagataggaggtagctaacctcactactcctagtcccatcccacaaaataaaaaagcaagctagaattcttctcccccttttggcatcaaggaccaaaaaggcttcactcttgtggaggagaaggaggacgaggcagtttagccaacacgcgcgctgcgagcaggtagcaagtagctatctctatcatcaaaacccgagtgttcttggcagcaactagaggtataagaagagggaaagaacgaccatagggtcgtgctccaaccctaggacgcgcccctaatgggcccaacttggatacacagcccattgggccaaaagaggtgacgcagcaccatggacagaaaacagtcgggagtaaaatgacaattgcggccgctccagaacagatatggacatgtggctagatccatttgaaagtagacttgataagctttccatgaagtacttgcacgcccaaatcggagttcgcatgaagtcgtggcggccgtcagaaattggcgctgccctgcagtccgaatccaccccgcgcgaatcctctcccctttgaatcctctccattgttcctgagtaaaacacgagtgcacgcgtctccggggtataaagaagaggaatatgaactcaagaaagaactcacctgataatttagttggcgtgcacgagcatgggtaataggaccatcatgctgtacttggggggacgtggatgtattgatggtgtttatgtcctcatcatcctctccttcttgcatttgagtcgtcctcgactcaagctcatcatcttctcccaaatacggcttcaaatctgtaacgttaaatgtgggactaaccccgaaatctgcaggcaaatcaagcttatatgcattctcattaatctttgctaacactttaaatggtccatcagctctaggcatcaatttagactttctcatatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcaaaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcatgccccctcttggtcctaggcaatcctaacacaaaatccattgaaatatcttcccaaggaatagtaggaacagggagaggcatatacaaaccatgtggatgtaagcgtgacttagccttttgacatgtagtgcagcgagcaacgaacctgccaacatctcttcgcatctgtggccaaaagaaatgaccagcaaggatgtcctgtgtcttcttggcaccaaaatgtcccatcaaaccgcctccatgcgctttctgcaacaacaacaagcgaacggagctagctggaatgcatagcttgttagctctgaaaacaaacccatcattgatgacgaatttgttccatgttcttccatccttacaatgcagcaacacatcattaaaatcagcatcatgcgcatattggtctttgattgtttccaggccaaaaatcttgtagtcaagttgtgtcaacaaagtgtatctcctagacaatgcatcagcaatgatgttctccttccctttcttgtgtttgataacataaggaaaagattcaataaattcaacccatttagcatgtctacggttcagtttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgagaagttggaggagaggtgcatgggtcaacttatctttcaacatgtggaatgcgttctcttgtgatgtgccccaagtgaaaggcacttccttctttgtaagcgcattcaatggtgcagcaatggtgctgaaatcctgcacaaagcggcgatagaaccccgcgagtcctagaaagctccgcacctgtgagaccgttttaggagtcggccaactctgaattgccttaaccttggcttgatcaacctcaatcccctgcggagttacaacatagccaagaaaagatactcgatttgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcaccaaacgtaaatataaaaactaccatcatgagccttcctaagcatataatgagaatcaaacatgcatgtcttagaaggcttaccactggggcaatcattcaccaaatgcccaacctcacgacacttggagcaatacttaccattactcttgacaaaacgagtggcacggtgagaaggttttttacccttctttggaatgaatctaagtccctccttgttaacgatgcaccgttgctcactcaaaatcttgtcaagagtgttcttatccttgaagcatccctccaaactcttgttgagtttggccatttgctccttaagctcattgttctcaacaacaagtgaggcatcacaaatagaaacacaagagctagagctagagctaggcatatccataaaatcatcacaagaggtagaaatgctagatgatgcaatatgaggaatatgacaagaagcactatcatcaagcaagtcacaagatatgccaacatcaatgtgagctccatgttgagtagtgaaaaggaggttgtca

SEQ ID NO: 58136 - DNA, 4524 bp, Oryza sativa
tattttaataagataaaagatgagaaggaagagcagcgggctacagatctataggcagctgacaggtaggaccatatattaatagtatagtaagcaactattgtataaattggctattagattgactatagatgaatcggagctagtagtgagcagtactattaaacttgctctcataatccatttaatcccaaagcaaaaagtaacgagtttagaacaatatgcccagaacatttgctttaaaccgtagcacacgacgtctgctgtaactgtaaattcgaactatactggtagcaaggtaaactaagatgacagtggcttcaactggacatgaataactccaattcaaatggacatgaatggtaaatattctgaaggggtatatcaaaagccctgaacaattttcgccagcatatggattattgagtctcttacatcatccttagagcatcgatcttgaatattttgaaggtctgggtttcacagcgaccagtcacgacatccgccacgggcaatttaattctctgttaagtttggagttgcgaaggcctagcacaaacatcgtaaagttataaggtggaaagtgtacagaacaatattcaagccaaagcaacagagaaaatattgctggcaaaagttttagtgtaaaagaagttaacactacctccgttgtcttttagatgaatgaactaaccaacatcaaatataaaaaacaggagtagttcaaaaaaaaaaagaagttaaatagttgaactttttccatttgattgttcatgtttctatcacgtgatagcatgcctcttgatcagcatatcttttgatgaaatgttataacatttgtacaacaaaaagaattaaaaaaaggaagcaaatatatgaacaataatacttacggaagctcccacttcgacggacgaaaatcttctctaaggacaagccattagaattgaacaactgtgccagcatatggactctaagatcatccttggtgcatctgatcttcaccgtactaaggcgtttacaggcaaacgatcctccttttggtttgatacctttttccaattccttttggatgttgtaactcttttagcaggcaaaaaaaagccaaattagttaactactaccaaatgctgaaacttacatattgaattgcaaatcattgagaaacattagttgatcttgtaccatttcaagttgaagaaaaagcttctccaaattaggtgaattctggaggaagagaatcaatatgtcgaagtcagcgaccatactgatacaccactcaccaagggacaaagtcttcaggttgctaaaagttggacaacttcttgattccctgctcagaaccacctacattgtacgtgacagtgaataacgagttgcaggataaaagtatattcaggtatgcagtgccattttttccttttttgctaatgaaattgcatatattcctaggactggtcttaggattataggatacatataaacaaattgtttgctcaacatagggagttgtttgtatgcaactaaatgtttgcagcgtccataagtttcaatgctggagggaactcctttttagtgaaaagtgcgaactttttgaagatatctaaaagaaatcattagcagaatcattccactagtaaggggggaaaaaggaaaagccccccatctaccatgacagcaagaacctaaagcatgccattctagtcaatagtagtaaagcagatcaatcttcctaaatttgaacacactgcatataattgaaagaagtgcacactataaccaaccaaaaaaaaatgcattccaatgctatattttgcaccatgagtgatgagtccctgctgcacattagtgaaagcgaaagtatggattatacaagaatattagtagaagttaagggaggtacctctcctgaatgagctacagctccaaacttctagcatttgaaaggctgtgaagaacattttgtccacccaaagttttatcatcattgaacccattgttagaactggagccatgatatttaccacccatactgcaatcacctccatcatcatggtctttatactgctcaaatttatattcattcacaatctcattgtactcatatgtatcagcatcactattgatatcattttcatagttatagtcatagtcatcactgatgtcactggaaaggtcatcaaaataatcttcagaagagccaccataagaataatcagaagagaaaccatccacctcatgtccttttttagaatcaccaataagtagcgagtcatcaatcatgatacttcctgtgaccagcgacccagagtccttgagcacgggaacccatttcattggtgtgatgcattgtaaaaacacgaggtttggagcaccaacagagagattcatagtgaacttgcattcaaccatgatcaaactcttcagagtgactgatgaaatctcacgggcacttaccacgcatttcttgagctccagttcttccaaagaagggcatcgagaggagaatcccctgaaaacatcgtcatccagctcggcgtacgacagtttcaagattttgagatggttggaagcgaagacctggtgagcaaatacaacgaacatcccataatgatcttcaagctgaatcacccgagcttttctcttgatagcttcactaatccacttctcgacatcgacattcttaaacttgtccccgaaaccatccacgtgagcagagcgcagccggagcgtgtccaccggcgcgagctcgtcgcgagcgagcagcagccggttcacgaacctgcgcgtgtcactcggcgcattgcggtcgcgcgtccagaggacgtcggcgcaggggcagggcgcggaggcccggtggtggcgcatgcgcctgttcatcggcggcggctggcggtcgctcgtcaggaggatgtcgacgcagggcgcggaggcccagaggtggcgccaccgccgcgagagcacgcaggtgcgcgccgcctcccacgccttgaggaacgacatgacgtggtgcagcaccatgtccggcatctcgctgaggcggtcttcgcccgaagcgacggcgtcctcctccgcgatgccgggctccccctcctcctccgccgccgccggcgggtcggtttcgttcagcggcatttcgtcgaacacctggacttcaccgtaagcgacggcatcctcctccgcgctgccgggcttcccttcctcctcctccaccaccgccgggttggtttcttccagcgacatttcgtcgaacacctggcctgcacgggacacgacagccatggaaacgcaactcgagatcagaacaaaaaaagaaaaagaagaagaaaagttcgcgacgaatccttgcaagaagcaaccaaacctggagaaggggaatggaaacttacggagagatcagctgcgatggcgaggaatctcgtgatccttcagagcaacgggaggttgaagacgaaggcgtagtggttgatcctttttttccccctttttgagaggagaaaatagaaatagttgaataccgaaatgggactctctagtctctactctctacccacccaaggaatttcctccagattccgatgttttactcccacgataaaacaaacagatttattatgagactagctaaaaagctaaaaaactgtgagtgttttttcagagaaaactttcaaatctaacttatagtatatagtttcactagaactatactataataataataacttgtatatatgtattaaaataatatatgcaactttatatctaatttatatagagataataatgtagttatagtgtagttacactatagctacaatgtaattatagcgtaactacaatgtaactagcatgtaactagagtgtaactatgtaacttgaacaaatctgccataaacatgcgatgatgggattagcttgtgaaaatagggtttagatccggtagcaaaatatctaagcacaaatcttagcgcagaatcaacggccaaaaaatttgacagttttctgtcgatagttagctagcagaaccgtttacgggtatcacatgaacttttcttttcaagatttatacttcggccatcttctccggtgacagcaacaataatttggtagcgatggtcaccagaataagttactaaacgctcaggcctagagatagtacgcgatgtgtctaggcggttgcggtaaaaccaagtagccttaggaagtactagcgtatctagcagcatgagccactagagatgggcatgaggtagcaaggtctttttcgagaggaagaaatggaggatggcagggaggaagtgtggcggtgataggtggaaggaggggaaggggagacaaaagactagggtttatggactagggtttttaaccgaaggtgtgaaacggtccgaacaacttgatgtagagcatgaaaaaaatgccagacaatttttacgagagaattgacttaactctaaatagaaactctagtaagattgattttccttttttgtatggtgatgtgttgggccaatcggggatcct

SEQ ID NO: 58137 - DNA, 12318 bp, Oryza sativa
ttagaagagtcattggccatgagacaaagtggagcgaagagtgatggagcctccttgatggcaacaacggccatcttcttcttcttggagcttgcatcatcatcaccttcttcttcggacccggatgaggtggagctctcctcatttgagtcccattgcccaatgaaggcctcaatcttcttcccttccttcttgagcttcttcatgagcttgtagcctccactcttcttcttggatgacttgtctccatcattagccttggaagggcacttggaagcaaagtgtcccttctcaccacactcaaagcacctcaagttggagagagtcttgttaggtattatatttcttctcctattggagttggagccccttcctctctcctttcttcttcccaagagatcattgaaccttttagcaagaagggcaatctcttcctccaagtcatcattggcttcattcaccttgctcttccacttgtcttcaacttcggcttggagagcaatgcacttcttagatggtgaggcttcctccatctccttcttcttcaacttgtacatgtcattggtgttgatcttccccaagaggcttgcgggtgtcatccttgacatgtcggagttgatgagcatggcgattagggtctcatacttctccggtagagcactaagcatcttttgggcaacctcaagatcggtgtaggttgccccaagccccttgagatcattcacaatgacattgagcctcccatacatgtcattcacactctcatgaggcaacattgagaatgtctcatattggatcttgaggaaatgaagcttggcatccttgtactcacttgtgccctcatggatctccgccaacttgttccaaatctcatatgcgatcttaaggttgctcactctatcgaactcctcttggctcaaagagttgaacaaagcattcatgacttgagcattgagtaggaggttgctgtgatcaatctccgtcaagggcgtgccggtgagatagcaaagcctacatccacaatactccaaatatggaagcttatagctttgaggtgagtagacattttaattttccaagtggagtagtttgtggtattgaacatgagagccttccctacatggttcacctcgttcgacatcttctctctaggcggtgaagcccaatcaagagagaccaagctctgataccacttgtaggatcgagatgtcgactagaggagggtgaataggcgatttaaaattaaatgacacctaatcaaaactaacctaagttgctaggctcggtgagggacaagtctaactaagcaactaagttatgttttgcaatcctagagtgaaagtggctcaagtatatcactaggaaagtaaatcacaattcctaagtctagtttagcaatcctagggtgaaatgatctcaagtatgtctctaggaatgtaaattgcacaaatgtaaatgcggcaaataaaaaagacaatgagacgaggaatttctcaccgaggttcggaaactcgctggtttcctactccctgttgaggcgagcccaactccatcgctcaaccacgaagccaccgcacgcccccttcgtcaaggggtgggcaaggcgggagccggcccacggagaggacaacccaagcctcgatcacttggggtagttcttccttcactccaaagatggtgaactccaaaccactcacaaccggcgccgggcctcctccacaatcttctcggagaggtcaccgagcaacttctccacaagccgtctaggaggcggcaacctccaagagtaacaagcgatgacccggctcggagatgatcaagtgccacactagctctacaatggaagcaatgcacttgactcttggctaaatcaaccttcaaacacactagatggatgaacacaaagctcaagtgggtgtgtgagatgcaaggggtgtatgcaattgaagtggatgccaagagagtccccttgctgctagtgggggagtatttatactcccaccaaccaaaactagtcgttgggggcgaaatcccccaactcagtgtattgtcggtctgaccggaggtatgtggccggtcagaccgtgctaccctacaatcgctagttttatagccgttgtagctctgtcagagggccccatcggcctagccagtcagaccgacgttgagtggccggtcagaccggcctcggctcgatcagaccgccctcagcttggtctgaccgaatacggctccggcgactctgtatcgggcatccaagagcacaccatcccggccaccagggggctagtcagaccgtacaagtgttgcctgttagaccggccattcatgtcggtcagaccgccactaggtggccggtcagaccggcttagtgcacgtggtcagaccggccctggtcaggccgaactcagtgaatagaatgtgtgtgttgtgaaatgtgagcacaagtctaaatgcataatgacctaatgtggcaattaagatcatctctttgctaggtcattacccctcttaatagtatggtgaagctaaaaataaactagcaaatttgattgccctatacctcgatcaatttaatactaaagcactagttttaccatcttcttttcttcgcttcgcgccatcaaattttaatccatcgataatcatccatgcgcacatatgacgtggtactaacacaaaatatataactcaaagagaaacggttagtccacaattagcgcttgtcattaattaccaaaattaacaacgggcgccttagttttttttattttttctatatttaatgctccatacatgtgtccaaagattcgatgtgatgtttttgggaaaaaattgggaactaaacaaggcctatatagacgtatctcttctcttctatactagcaaatatgtccgtgtgttgcaccgggtgaatatcaactaattatgaatggttaagattgcttaggtacttataacacatatgcataaaaatcttgaatttgtacatacctcgcaaatatctccaaattatactgggaaatataaaaacatatttcatattgtatacacattcagattcatgtcgcacatgcgtgagatattccaaattttctacacattcagaacatattccaactttcacaaattttcacaaacgggggcagttatagctctggcttcaccttcctctgcaaaagagaaaaggtaaaggcatccgcaatggtaaagaaacatgcactttgtaatattgaaataaaattcactcaaaaatctttagcggaatatgttcaaattctagaaataatttaatatttaaagaaataataattatcttttcattggtttaatttatctaaaaataatttaccgagtgatcaaataattgatcataatttcccagcaatttaaaatgtaaatagtgccaaacaaatttctgtaaatctaaaactaaaattaaatcagttgcttaaaaaataaattgatttcggcctaaaaggctcaaaccgacatggcactctgtggcatacaagcgtgtgtcatggcggcctagccaggctagaaggcctagcgaacagtgcgggcagcccaatgcaagagagatgatggtcgtctgagattctagccgctccgctgaaattgtggggaaaacctagcccagattcttctcgatcctctttctccctgacgatgagcaagcgagagagaggaaacggcgatggtggcggtgacggcagtccagcgaggtggcacccgcgcggcggggaatccatcgcgcggctccaaccttcggtcgattgccgagggacaaaacccaaatcccattctcttctccctaatccccttctctctggcacgttcgagcaagcgagcagcagcgatggtggtccggtgaggtggcgcgcgcgcagcggggaatccgccatgcggctccaactcttttccggctgggggcgttgcggagaacggcacctagccgtgcctcttcccgtccttcacgcgacaatggcgcgctaggtcagtggggtcatgacggcgggcatgtggcggagctggtgcaactgcgaggaggaggtggcaagcgcgtgtcgaggcacgcgcgggcgaagaaaacgcccatgggacgatgttgtttcccagcgtagggccaactgtgtggctcccaccggtggattaggcctccccgaattgaaaaaaaaagattaatttgattcaaggatttgggggtttacttaggtttttctcaatttggcatttcggggaatttcccccctatggttcgattatgtcggtttcaagctatctatccctcctagatatttttttttattattgagttcgattcagattccatgactaacacagatgtcacacctggagttttcccctttcccgtagttctaattcatcaataaatcgtctatagaaattactttggttaaccagaagaaaaaccttaattaacaatgtatttaataatcggaattgttagggatatttttttttcaaattctctttgctctaaaatcattaacatgacttaacccagaatatttagagtatcggagttaatgttgataatttaatttgtcaagatttgaattaatgataatctttctctcccgcctttagtcgtgaatcgtgcccgattcactcccctcactgtccgctgtttcgttttgcatggcgagccgtgtccgttttcgttcttttcctaaaacggcactgcatttattttccaatttgggaaagtcctaatcctattctccatatccctattttccctccccctctcatcctcccactcggccgccgcctccccctctcccctgcgcgcttctccactcccttgtccgattctctcaccctccttgccggccatggcttccctctggccccacctcttttattccacccctatataagccatcatatccctgttttttttttttcctattttccaatttattggagctctagccctagccgccgcctcctacaccaccgccgctagccaccaccggccgccggtgagcagccctcctctcctggcagtatggtttgtcgtcgtgcgttgtccctagggtttaatctaacctaatccctcgttgtctagtgttgttgttgtctccgccagatcgtcatcgccatctcctcctcgccaatcgtcttggtttggtgaggctcctaatcatgatcccctggtttaggtgtttattcccaggaagtttgcattatcatagccaccatgctcattgaaacagttttcttcacccgctttttgctagcccaccgtacatttgggctaatcgacaacaatgctagtccatcgtacatttctgctaatcgacaacaatccagtatatttctgagataaatatcgatgaacagtatattaaaaaaaaattcctctatttgactaaactgcttttgtgaactgccaatggtgccttagcacatatctgattttactgttttttccaacacaagagaagcaaattgcagtacatacaaccaagtataaaataagatggtctggacaaggtaggaaatcactgatactaaactaacctaggtatacaatgatactgttagaggggttctcccttcaagaaaggcaatattttgctgtcgaatatttggcctactccaagcatcaaaacttcagaacgcaacgaagaaaagaccagcaaatgttgctagtcctcatcagaatcaccaaacgtaatctttgttgatttaggagcatctgctttgatttctttgaaatgagatccatatatttgcgattcctgcaaatgaattgttagcaataaggtaaggtcatttctcagtcatgtcatgcaaagtccttagtgtttatttcttagaacttgcaacgttagggcaaggtgttacagcatttctaaggattaatgtaaaaaagtaagtcgctaagctttctgtagcataaagcatcagcatatataacagtattttcatagattgaaacgatttctcgaggacatattcctagttaactagcacggtagtacctatagacatgaacaaagcactctacgaatgagaatgtaacaagatctatttcacagttaacacaaacctttttcttgacgtgtgtgccaaattttgtaagtgcaggaggaacgacctgaccagcctcccgcaaaacattgacaagttcaccagcaagtccctgtatatagttttgaagtgacaataagtacaacttaagttgtaaggctaaacctaagggctaacgtgtggcacataatctccaataccttgttctcttgagtgaagaaggtatgtgcaacacctttcttgccagcacgaccggtcctcccaatcctgtggacataatcctctgtagtcaaaggatagctatagttaatgacaacttcgacatctggaatatcaagtccacgggatgcgacatcagtggcaatctgcaaaatatacaaaagaaaaaaaaacaagtgttaacagatgagaataaaagtgctacggatgcaatgataaaaaggaaataaattcataaaaacacaatattttcagacaacggttgcagacaactgtacatttctgttacaaaacctcagtagcatattttaagtgagactatcggttaaatgatttcacatactccaaaatttatcatacctcaactcttggctcggtttgatttccaaccgtcaactcaaaaacttgataaaaccagaccctcagctcccaaaaccagctagaactcatttctcttctagtttatgtacttggcatccacgtgggatcctaggtggcacaggactcatttgtcatggtatacatggtttcaagagttgagggatggtatttacttggtttaggagttaagagatgaaaattaaaccgagcaaagaattcagggatgagaaagactttttccttaaattaataacaatgttgcaagcaagtagttgaacacttccaactctcaaagtatcatcgatcaggaaatagtagcagaataccaccaagcccaacaaaatcccttaagggataaataacgaaaccacaactagatttacaagggcaaagtctaaaaactagatttacactaagctcacaaataagcaagagagagtagccattaaaaaaccacaactgaactatcaatgcttataagcagccatgtagaaattagttagaattagcgcaccatcaaaggacatgacccttctttaaataaagataaagctttcgtcctgtcatgctgtgccttatctccatgaacagaaacagcactccaaccccttcacaacaagcatgtgtagattagcgaaagtagagcataagtttcacaaatatttaagtcgcacactggaaacaaatctgctaccttctttgtaacattgtttctactcgcgtagcttctctcttgtacaacacaaaaaccaacaccctgtttctgttgcacaaaacacaggcacaatctgcttagatccatatgaagacaaatggtgattaattagtttgttgaagcagatattagtataatactaacatgtgcagaggttcaattaaaacctaacattgaatatatttgtttgtttggtgttgaaaatgttgttatgttttatataaacttggtcaaaacttaataagtttgacttaggaaaaagttaaagcgtcttataatatgaaacggagggaatacttccttagtttgccaaactgagatagcctacaaatagaattgaacaatcagctttggtatgtgactgaatacaatccaaagtagaaaattttgcaagacgagacgaatgacatgcaatcttatacataattttctaagctgctcagcttaaaatcttttgttatcctcaagagcatccagcatgcatgctgattgcaatgcttttgcctatgattttcgaaagtgagactttcatggagactaatacagcaacaagtaaaatccgtactgcaatacctacctctgtgctttatggtatttatcgagcaaagcaactaatcttgaatcccttgacctgtcatccaatacttcaacaatttgcatcacatcatggttagcagcaagatcttctgatccaataacaacctacaacaaggtggcataccacatacggaaggtcagcattaccgcattagcaatcagatattaacaagagataagaaaagagaaactatacctttattggatttggatccataaactcttgggctagctggtggacagcaggaggccatgtagcactgaacataaccgtctgacgtactgcacaggaagaattatatggccatggttgcagatatattcagaaaagataactaggtgtagtaacacataaaataaatggcagtgtcaaattgacatgaaaaaaatgtacaaatgtattccacctacgcggtatattcatcacaatttcaatatcatggtaagtaaaatatgccaagagttatgaatgccatgaggctaaagtggtttttttagcaacgtgatatagaagtatgaaaatcttgagaacaatatttcttgctcatttctgccgtcactagtggctattaacttatgagcacaagtgtgctgaataaggtattaaaaactatggagcaagagggcacatgcaacagactttgtggataagtccaaccagataaaaagggatgaaaggaaaagaatacatgcgatgcaaaggtggacatgcacatacacatgccctgaaaggaagagagtaatggagacaaaccagatgcagtttggcttaaaattgctctgacttcaggttcaaaacccatatccagcattcgatcagcttcatctagaacctttatcagttaccagacacgtctgtgttagaaaggacacttacacttcaaatgagcaaagcaattaaacagaatgaaaattgaccagcgcaaaataaaaaatccaggtaacatcacaggtgtaacttattgaaccaatatttaccattgactatgaccatcctcacgagtcaagtccagttcaacaaaggggagtaggggacagaggagagagggcatggaagagacaagaggaaataccactcaaatcttaaaatgccgaatctgttagtgctggtaggttccacaaccctgatcttgtggatgaaaatacatatacattggtgtgtcacttgtattgtcttctataaatgactacattatctgcttatgtgtatatgcactgtggccatttaacccaatatgaactatgtacactagaaaccagcatagttcctcagccatattattcttaggtaacagcaaattcaagttataaaaatgatataattcctttcatgttgtgcattattaattttatgaaacaatcattgaccagtcaacccaactactcaaatttgatggaaccaggtgagcctttaatgccaaacttgtggcgttattatcaagggggtaacaccaaaaaaaaaaaaaatcagcgaacaaagcaatcttgacatgagtgttgctacaacaccaccgaaagatcaatcatgcacctgcgtttctctctaagcttgtcccatgttaagaatcttagggtctgtttggttgttgcctaacattgccacaactcaatttgccataggtgtggcatggcaaacaaagtgtggccaacaatttgttaggtgcaatgaagttctccggcctccaatgtaatacaacaaatagattcaacaactgcacaaacatattgtttgttaactcaaagtaacactcaaacatcaatgacaaacttcacaaataaataaaattatatatatatatatatatatatatatatatatatatatagagagagagagagagagagagaggacatatcgatgaaaatgatctaaatgttggaaactcgtgaaaatcatacctaaaagttttgtaaattcatgaaaaaaaattactagagattggtgtagatatgaaatacattctcaccaaatctcaaatccaaactcaacttcatttaagagaaacaaaaaagacaaatttcgggtgaatagtgtcatgttactattcacctgaaatttgtcttttttgttactcctaaacgaagttgagtttgaacttgagatttgatgagaatgtatttcacctgcaccatgaatcacaaccattcaatcattccaagatgcgtgcttcctaaatggacattactttcacaaatgaagagttactataggagaaaagatcaaggaggtacatgatgcatgtgtagctctggcatgggacatgtagttctgggcagagatagaggaagttgaccacacatcatgtagtatttatccttcatttgaatattgtttcttttctcttgttatccatggaatttagcatatataaccatttatttaaatgtttaggtataaacattaacttctttactaactagtccatataagtttgaacttaatttgaatagtttttttgttaaattttgattctaggtatataacatccatccaaacttataattagttaggtatgtaataatggattgtaaaataaagttgaatttgagttgtttgttgctaggtataggtatgaataaaattcttgtacctgggtatatactcagaagttgaaaaaaattcaaaaatttgagtgaatttgtgtattacataccttggtgcccgggcaccatggtgcccccatatgggtgtatactaattcaaaaccatagacaacaacacaatgaaatgcatagttaacttaccacaaaagaaacatcattaagacgacaaatacccatttcaataaggtctttcatacgaccaggtgtccctatgacaatatcctgaaagcatataggcagaaaaaagggggggggtcaggaatatgagtatttccgtgtaactaacttctggataattgatacaaaacaaaatccaaggcagcgagtctgctgaatcttcggaaagtaaacaaaattattcaacaatacatttaaagagaacttttcaaatcaatatagcaaattgaaatgtcatcacaatatgatgaatgtctctagaaattaacattcattggtcatatatcataatccagaactgagatagagtaaaaaaaatattgtgtaagtctcatcttaccactccagatttaagggcagaaatttgtggtcctttggaagttccaccataaaggcacactgaacttatcccacatggtgcaccagcttcacaaagtacatctgcgatctaacatataatacaaaatgaatcattcatgtgtattaaaaagcagtagtttttgcagaccatcagatgcctatcttacaagttcatatcatcagtatatgacacctgctgggccaaacaaactatataatcccatacaaccatagaaaaaggtaaaaaatctgaacatgcaactctttcacttcaatttgttcgatactaaaggtccttatcaattagttcgatactcaacgatcttatcatcagcaaaatataggttgtgagctgagagactacacttataaattagagtaaatttcagaaaacctacgtgttagggtcagagttacaaaaccagggtattgcaacttgtggcacataacctaggtcattaggttctaaggttcaaaaaaaaccaccgccctcaatttaatttccagatgatacaacatattggcagatattataaagtgtctatgaaattgtgtattacgaatttatcaagtaaattgaaaaaaaatactattccaaaaatctcccccttttatatgtgaatcaatttctcctatccccactggaagttgcatacatcccttatacttccctaaaagattgagttcaggggtttacctgctgagcaagctctctcgttggcgatagcacgaggacccgtggcacccccttcttagcagatttctcccccattttcctcctaacgtgcatcagagccggcacaccaaacgcaatcgtcttccctggcatcaacaaattacgacgaacaacaaaccatcagcagcaattcgagcacgatgcagcagtactaaccaattaacaaaaagaaactaactaattagagaattttttcagcaccagatccggtggcggcgatgccgatgaagtcacgaccgtcgaggaggtaaggccaggcgtacgcttggatgggcgacggacgctcgaaccccttgcagcagtcgagcacctggggaggaagcgcggtggcggcgaaggatgacagcggggcgtacttggcgtccgcggagcccttcccggtcacggccacgaccttcccaccgccgttctccgcctcctctccttggcccagatcgcccttggccctcttcttcttgctgct

SEQ ID NO: 58138 - DNA, 1751 bp, Oryza sativa
ccgtgccgtgccagcccacgtgccgcgctcacggcccaggcacagcccaacacacctcgggccgtgccgggccggcccgaaagaatgacggcccatcgtgctttttctcagagtaagtctaatttttctccctcttactgggctgtgatatatgtatagctcaaaaaagtctattttacctccctcttctttgggctgtgatataaatagctaaaattaagtatatttaaggtccctattctttggacagcgacatttatatgtctatttttagtccctaaactttgtgtgtcgggcctagcctgccagcccatcgtgccgggccagcccgaccgtgccgggccagcccagcgtgccgggggaggcccaggcacggcccggcggtcgggcctgtgcctgggcctgatctgtggcgatgcgtggacatgttgcaccatgaggatgtaaacagattgatcttgagagatttcctgtacgcaatggcaatggtggccgtggaccgttcggatgggcggccggcttgaggagtttgatgggaagatctttgttgatgataagctgctcgagtatataggggtcaggtagttatatatactaatgatacttctattgcatcagtgtttctccgactctgaattgattaggtttgaaatttccagagtgaagttctatcgccctaattcgcctgaatttttttaaaataaaaactagtgaatttagcaaaagttattcattttttgttcaaatttttcgtaccgaaatatcaaaatttcggtgatatattaattaaatcctgctctgaaatggtctaatcatttgaaaaatcttgcgcactaatctgtcattcgttttgcttgcattgctgcaggtcgccctctctgaagcggctgtcccttgcatgttttctgctcctgtatctccaaggaagcattaacccagttaatgagaaagtgtccactgctagaggatctctccctcgttggttgtggaagtgtcgtctttcacatgctttatgagatcaccggcgaaacgtgcccgcggctgaactgcctccagctgagcacatgtacacaagctcatccgcggcttgcgtgtttcgggtacggttatgggccgctggggatggcgacgttgcaccagctgcgacacctgtttagttcaacgcgtagtttggattttggttgaaattggagatgatgtgactgaaaagttgtgtgtgtatgacatgttaatgtgatggaaaaagactgaaatttagatccaaattttggatctaaacacaaccctaattctggactggacggtatcaacattgatgacgacgagctgacagccatcgatgatagctgccctcaccttgagccactggcatgcccacatacaatttaccggtgtcactggacaccaggtaaaattgttaaattctaactaatttatgctattttgattagtatactagtgaataattagataactactatgtagtggatcccgggtaatttttattctagattcgccgctgccttgagctatttgacgtaagcaactgctacgatcttgcgatgtcgaggacgccctggtagcaaagtgcgccgcgatcaaagactgtcaagcttccttccgcccttgaaggttatgacgagtatgatgattactactgttatgacagatgcgacggctacgatcagtctgatgattgatgacctcgcccatatgcaccttgcattgtgatgatgatctgtttgtttgat

SEQ ID NO: 58139 - DNA, 3531 bp, Oryza sativa
cctaccatataggtatagcatgccacctaaaattaaaaaaaaatgctttttggacatgtgcagaaaactgcatgtctatctgttcctttctcacagcactagcagttagtaaaacaggaaattacgggaaccaaatcatttcacttttgcctattttgataagttctagttcttagtcctctcttttcactgccatcgaaccttggtagcgacaagaccgacggtagcgacagtgacaaactatgaatataaacagcggtggaggtgaaattctagaagacaacagtttgcggatgtacaaatgcatttctttcaatgctatgtggcatgtcatgtgtataaagtattctcacatgaatagttacatgggcaaatgacacagttaactcacattagtgacctgcagatatgcattttaaaaataaagtgacctatatgatacacctaaacaagttgaatgaccttcatacattttacttttgtcttttttgttgcatcttataaaatttgcatttaatttgcagtgatatattacatattaatttatcatctcatgttttttgaattttttaaataattttggatggcgcacaagaaataagggacttcctctcgagggattaaaagagtttcccttttttaaatgtgacaaaaaaaaggacccaaaacctccagtcacaaatggttgctacgtttttaggacagcgtttcctcttgtgaactttgctgtagaggcaaaataaggagattgggaatatgtagccactgtacgaatagaaatatagaaccatgtaaataaataataaaatttctaatgcaattaattcaacagaactgaggcactaaacattaaatcaagagcacaatcgaacgcctcacacgcgattgcatatcgaggggcggtccctatcaaaataattcaaatccgtaccggctatacggccaatttcaaccaaattaaagcaaacacgaatattcagtataaagaagaatccaaaaaatcagagtgcgtgggggaatcaaattcaaaaaatctcacgtctcgccaaggaagaggaggaagccgtcgtccacggcgtgctggctccggaatgcctcgcactgccccttgctccggctgacggcagcctgcgccatcccgcggaggccggcgccggcgtggccgtggccgcggccgcgcatgtcgatgcggcgccacaggtcgggctcgtcgcgcgcggcgcggcgccaggagcggcacacctggccggcccccgcgaggatctcggcgtggtcgcactactaagtgatttttctgcacgagacctatgattttttgcaaacggaccataactagtagcgtatgtaaaattcgagtggcattttcacagacggctccttaagacgtccgtttgaaaaaatcgattttcccatacgggtctcttaagcggtccgcatgtcatttttgcatgtgactcacttaagcacccgcatggaaaaatcgatttttccatacgggcgtcttagggagcggtctgcgaaactagttagtctatctgactcatatgaacttcaaattgaatgattctttttcctaaatatttctaaaatcatgctctatcatgttattgtgttcttactcctattattttggccattttttcatttatttttgttttatcaattaaaaatttgaatttcaaatcttcgaataatatgttaaagcagtaaatgatttcaactgaaaaagttatcaacaacaaagttgtataactatcaaaatctataacttctattttggtcatttttttcatccgacaaagcgataggaacattttcacaaaatttacatatctctcttatagtttatacaactatataagagaaatgtacattttgtgaataaggttacaaattattttgtcggatgaagaaatgacccaaataaaagttatagatcttgatgagttataccactttgttattgatgaatttttcagttgaattcatttagtacttgtaaatgttgtttgaaattatcataatttgaaattcaaattcaaattgttcaaacaaagtcatctagaaaaatgacgaaaacaaaagttgtagatcctgataagttatacaactttgttgttgacaacttttccatttgacatcatttactacccaaaaatttatttgaatttcttatattttaaaattcaagttttatatagttcaattaaactcggatggagaaatcaccaaaataaaattggtagatctcaatgagttctacaactttgtttttgacaactttttcacacgagttcatttagatagataaaattcaattcaaaattttattaatttaaaattaattttttccctcctcctcctttcaaattttttcatctcctcttctctctcccctcctatccagatattttaactccctatccttatccttttcctatctctcctctcagcctctcactctttcctcctctcctctctctctctcaccgacgcacggagcgggagcggcggcggctgcacggcgcggcgggcaggagcggcgcggcagcggcaggctcggcaccgacggcggcggccttccccgacctgccatccggcgcggcagcgcgcggcgggctcggcaacggcggcggcggccttccccgacctcccatgcgcggcgctcccttcctcgatagcaacaggcacgacgacgacgacgatggcggcgggtggcgggtctggacggcgggcgcgcagcgggctcggcaccggcggcggcggcctcccttccctgacctcccatccggcgcagcagcggcaggctcggcaacagcagcggcctcctttcctcggcgcggcgcttccccccctctcaacgccgcggcagcgggggtggctcggccgcctcaggcggcactgccctgcgccgattcggtgccgccgccgacggatcaggcgacggcgggcggcgggggtgacagatcctgcgacggcgtgcggcgggggcgacggatccggcggcgggctagggtttagggttttttggattttttttttgtttgccgaatttattttacggcggcgatggcgtccagcgccagctccacccagtccctcgcctcctccatctccatctccaccgctgagccacggccgccgcgacggcctccgcggcggcgagcggaggagggcattatgcggttggtggtgagattgagaggaggaaaagctacacgcacgggattggtgtccggctccgatggagtagtagaagtagcttcttgcagaagccaagctaaaaactggactagccaaactgtatagtcgactgtccagtttgatctagagcagtcaaaactgacgttagagcaaaggttaataaatgggcgcgcccacagtcaacactatagctaagccaatactagtgctccctcacggttttataattctcgaagttttggataatgacacagtttttaaaatatatctttgatcttattttttatatatataataaataaatgaatgtttacttttatcatagaa

SEQ ID NO: 58140 - DNA, 15501 bp, Oryza sativa
cgtgcacaaaacaaatagatctggaccatccattttgagggtacaaatagaagcccacaacactgcgggtcaggttccccttaccttttttgagtggttaccaacatatagcaggccaaacgggcggcccggcccagcacgacacggcacgccgacggcacggcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctagtagccggcccactagtacatgtggcccataaaaattgaaatttgaggggaaaaaaagaaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttgacacggcccatttggccaggtatataccaacaccacacgggaagatggttaccgcgaaaatccgcacaaaatttgttttcaaacatttgaattcaaatttcactctttggccgcggttaccgcggtatatgaatggttaccgcgagatattagctagaagaacaaagtgaagaaaatgcaaaaagaaaatgcaggatgtgtgtagaatttggggataataacaatatatatatatatatacacacacagagagacacttatatggggcaccatggtgcccgggcaccatggtatgaaatacacaaattcatccaaatttttcaaaattttcaaattgtgagtatatacctagttataagtattcgattcatacctatacctagcaacaaaataactcaaatttaactttatttcacagtccaatattacatacctaactaattatatatttggatactatatacctagaatcaaattctaataaaaacatgtttaaattcagtttaaacttgttttgaactagttagtaaagtaattaatgttaatacctaaacatttttgaaaaattcaaactcatttgaattgagtatatactcaatttgaatcatggagcccgggcaccatggagcaccaaacaaatttaatatatatatatatatatatataagatacctgaaaacttgtggttatacaatagaaaaattcagcatgaccttttctatattatggacttgaaatcaattcaacaattcatagcataataattcaacaacaacaatcaacaatctcaaatttgaaagaataaggacattcacatgtaggtgaatgaatagagcccacaataacaatagagtccacaatataatgtccatgattacaattctagtttcaatcaaagaaaataaacagtccacaatataatgtccatgattagtccacaatataatgtccatggtcacaattctagtttcaatcaaagaaaataaacaaggacatactaacatatagcatagttatgcgttccactactaacatagagcatagttatgcgttccactgattatatgccacgttatactcctttgtgaacatgagcatcaagccatgtgagtgtgtcagggttatggataccacatacccaatagtaatcgactaagctcggcggggcccaccatatagcaagtcttatacgggatcgtacctcgtatatagaaatagaattctatatggaaacgagaaggactactcggattgtatccatactggtctccctagttctacttggagaaggggacatctatgggtataaatacaagccccctaagaggagagggggacacgctacaaagccacaagccaatataaaccaatacaccgccagatattgacgttagagattagtctagacaaatccaatccggtgcctgcggaggccggcaagagggatctagcgccatctctgatctcgacgagttcatatttgaggaagactaccctgccgtcgactacgagttgattatccatgtcgccaagtcgacgatagttagataggttatcccaaatattgtactagtgtgattatggtggataaagagcaacatcggcttcggccaataggatgtagtgctattacctatcagataaggggctcgaacctatataagaatccctgtctccatctcttttacctcaatctcgcatataccgaccaacgatccccatactatccaaataccctagtcgtgactatcaaacatcgacagtggtgcgccaggtagggggattttggtgctttaaggtttcgacgagatgggttcaagagatggattctccaacaacaagctacttgacgacttcggctgtggggagatctaacccgaccggagtatacattccattgagatcggaatcatcatcgccaacaattcgatctattgagatcgtccaggcttcaagacctttgtcaccgcggagaatcaacaatattcgctgcatgcggaactgatttgataagagcctatcaaatagtgctccatctttcttcatgaagaattgatgaccaagcccttcgctcggcgacatcagctggtatggctagtgcgcaagcatcagcggactaagtccaggccgaacacgatgccgtctccaaaccgagcatgcgacgcttcacgctgcacggggattcgtccgagtacctgtgcccttgtgttaccgtgtcctagccagagatggtcaatagagagtatttgcctaatcaagtcacatacatatacacacacgtgtgagtgtatgacaggtcggcatgctccacaagaccaacaaataatcaagtcccagtttactgcatacatatgtctcctactgcatacatatgtctcctacagagtgtagtagacaataacaaggtaattagtagattaattaatttaattgacctactaatttcgtagatacatccggcatgtatctacaaaggtatgcaatattttatatacaatttaccgtacctatttttcagatcatacaatattatccatgatttattatgttcacctagagcatgtgttttatacaacacctactgtgcaagtgtgtccgatgttaggctgacgacagtttaatactgggctcgccctattttcttcagtataaatcatgtttgtttacagtttacataatgtctgatatttaatctgctcgttatatcctgataatactagaagattcatgcagtcttttgagtacatgcccgatattctctgctatatatcttgtcttctagaattttttttttcaggaacaattgatcactcgagtaggttgtggtcgagtacacccaattattgagaaggttcttgataaatgctgagttatcatacccaacctaccaacgaagtctgacgatctatctcatgtatagtgacggccacggctagactatttgggaataggttattaacggataattcttcacgaacgttgtcggcctgattactcgacatgattgtgaacagacgtccggatatgctataagttgggtatgtgagtcatgctggccacatgagatgcatatgtaatatccaactctagcgcccctataggtgattaagagatgcctactcctggttatcaaccagacagttgcagcgacatatcgccgcctataaatttaaattcacttgtggaccgttgaactccatctatcgttgtcaaagactccatgtctctacaccgggatcgaccaagtgagtatggcaaatattgataaaggaagtcgcgggtaacaagagaagctttcgcgaatacggtttgtttccgtatgcctatcagttgcctataggtgatcgagatacgcctacacctggtcctcgaccagtagatcgtagcgatctctcaccacctaaaaattcatcttcagatgatcgagatacacctacaccttgtcctcgaccagtagatcgtagcaatctctcaccactgttatagcaatctctggacatctaatgcgacaatcaacattgtcgtgatagcgacaaccaggactgactagatcgccgttgtcaccaggacgacaacgtccaggactaacgacatcaggacgacaaccccggacaaggttaacgacatcacgacatcatacaacaacgatgaaactcgaaatccccatacttctagagggcccgaggatgaggtagtcggtccaggagctgaacctccgactacgataattcctcattgtcttcgtcgtcatcaggaggcagttctcgcaagttgcgaggacgccgtccatctattactctagattccctttaggtggtcgaggtacgactacgactggtcttggaccagcaacgcaacgatcctcacaccacgacttcaagcgatcgaggtacgactatgactagtattctaccagcaacgtagcgatcctcgtaccacgacttctaatggttgaagtacgactacgactggtcttctaccagcaacgtagcgatccttgtaccactacttctaatggtcgaggtacgactacgactggtcttccaccagcagtgtagcgatcctcgtaccacaacttacaaaggtcgagttacgactacgactggtcctcgaccagcagtgtagcgatcctctgtaggatcgagatgtcgactagaggggggtgaataggcgatttaaaattaaatgacacctaatcaaaactaacctaagttgctaggctcggtgagggacaagtctaactaagcaactaagttatgttttgcaatcctagggtgaaagtggctcaagtatatcacaaggaaaataaatcacaattcctaagtctagtttagcaatcctagggtgaatgatctcaagtatgtctctaggtatgtgaattgcacaaatgtaaatgtgacaaataaaagagacaatgagataagagatttttcaccgaggttcggaaactcgccggtttcctactccccgttgaggcgagcccaactccaccgcttaaccacgaagccaccacacgccccctttgtcaaggggtgggcaaggcgggagtcggcccacggagaggactacccaagcctcgatcactcgggatagttcttccttcactccgaaggtggtgaactccaaaccactcacaaccggcgccggccctcctccacaatcttctcggagaggtcaccgggcaactcctccacaagctgtctacgaggcagcaaccttcaagagtaacaagcaatgacgcggctcggagatgatcaagtgccacactagctctacaatgaagcaatgcacttgactcttggctaaatcaaccctcaaacacactagatggatgaacaaaaagctcaagtgggtgtgtgagagatgtaaggggtgtatgcaattgaattgggtgccaagagagtccccttgctgctggtgggagagtatttatactcacacccaccaaaactagccgttagggtgaaatccccgaacttagtgctctgccggtctaaccggaggtatgtggccggtcagaccgtgctactctacaatggctagttttctagccgttgtaggcttgtcattgggcccaattgccctggccggtcagaccgacatggggtggctagtcagaccggcctaggctcggtctaaccgccaccagctcggtctgaccgacttcggctctggcggctctgtatcggccacccagagtgcaaccatctggccaccagggggccagtcagaccgaccataggccgccggtcagatcagccagggacctgcggtcagaccggcatagatcttacggtcagaccggccctggtcgggccgaacacagtgaacttgcaatgatgtgaaatttgagtctaaatgcataattacctaatgtggcaatttaaatcatctctttgctaggtcattacccctcttaatagtacaacaaagctaagaaataaactagcaaatttggtcgccctacaccttgatcaatttaaaataaaagcactagttcaccgtcttcttttcctttcgctttgcgccgtcaattttaatccatcggtagtcatccatgcgcacacataatgtgaacctaacttaaaatatatagctcaatagtgtttgtcattaattaccaaaattaacaatgggggcctagatgcttcatcctcgcaccttaatttcaaacggttgagagactcctactcctggttctcaaaccagtatgtcatagcgatctctcatacctccacttcaagtggtcgagttatgactacaactggccttcgaccagcggcgtagcgattctcccactacttctgcaatttgttgaatacaactatacacctggtctttccccggtgtggtggtcgtctcatcatctacatcaacttctgtaagttttatatgtgcaatatttgtccgttgatcccctcttcttatatcgcctcgtcttgaaggcggtcctattgtccttttacgctttccgacaaagcctccgagaaacctaaggggatttcggctggagacgcccagagcagataaggctttgttagatgctaagagccgaacgaccatgtaaaatctggtcatgtaagagtgctcaatggatgcgtattaactaagccgtgtaatcgggaattggttttcccaacttcacgtctaggggctaggatctgtcaacttcagcatggtttgttataagatttaagttgcttttgtggaaaatggctttcccataaaaacagctgggggctaggaagggtaccaaactccgtttgctgagggcaactctagcgaacgtactcttttattgtgacacacagattcaacttattttcaatttttccatacatattataacatgttaccctttaagcattcgctcgggggctatttctatttaatattatgttctgaataatgatttcaggaaagttccattcagcgttgtcgaggactccatgtctctatggttctacacggggatggactaagcgagtacgacaaatgttccaagtgttgatttcaggaaagtcagacatcagaacaatcaagtcagattttcaaggctttgtcgcagactttgcaccttcttgattgctcgagaacggttgataaagctcgacaaggaatatgtaatgaagcgatggtgtacccgccgagatggaatttcttgacttcaatccaaattctcgattacagcaagacgagagacttagtcacatgctccataccttctcggtcgacatcgggacctagacaaacccaatatagtgcctacagaggccgataaggggaatctagcgctatctctaatctcaccgagaacagtcaaacgagcacgacaatagttgttccaaagtcttcggttgagaacatcaacttgttcatttgcattgaagtagggggctactgtcagggttatggataccacatacccaatagtaatcgactaagctcggcggggcccaccatatagcaagtcttatacgggatcgtacctcgtatatagaaggagttccggataagaaaggacaaatagaattctatatggaaacgacaaggactactcggattgtatccatactggtctccctaattctacttggagaaggggacatctatgggtataaatacaagccccctaggaggagagggggacctgccacaaagccacaagccaatacaaaccaatacactgccagatatcgacattagagattagtctagacaaacccaatccgatgcctgtagaggctgacaagagggatctagcgccatctctgatctcgacgagttcatattcaaggaggaagactaccctgccgtcgactacgagttggttatccatgccaccaagtcgacgacagttagatagggtatcctaaatattgtactggcgtgattatggtgaataaagagcaacatcggcttcggctaacaggatgtagggctattacctgtcatataaggggctcgaatctatataaaaatccctgtctccatctattttacgtcaatctcgcatataccctggtaccaacgatccccatactatccaaataccctagtcgtgactatcaaacgtcgacagagtgtaacaaccccgccttgtattcctccaaactttgacctgtctatgatgatgtaagtgtgactatatactggcaagtgtaaactaaagatgtatgtatactacaagtatatgattgaattattttcttattcttcctccacttagcttaaattatattttagtgagagtatcttagttctttcttctgtgtgtcacctttatcctaccatttggattacttatgccctgcatagaccttgatgtatacaagtaatatatataaattattagcatagttctctcttatcatatcttctcgtgggattaaataaatatgataccttaatacttcagggtgaaatgctacaatggtatatccgtgcacttgcggattatacctgtaaccataaatatatcatgaatatttctacataattggttggaattatatttctagtaatgtcgttaagagataccaacaagcatttctaacgccgttatcggggaagattattttatattcacctctgtatgatcactgtcctttgtaggaaaatcttgtttgttttctcttttatgtgaaaacagggtagtacatgactggttctgatttgccgaccaactccaaagaaaatcctaagtcacttgtgaggcaaatctgaccccgtgtcattcctcctcaagtaactcgtggcaaccagaccagtcatctccgcgccaccagagttgaacgatatggctgggaagaccctacacaagtttgctattccctctgctgacaacgtgcctattggacccccaagtcaacatgggagatggtgactttgatttgaaaaccagcccaatcacaatgacgcaggctagcccgttctatggcaagcctaatgaggatgcaagtgttcatctgcagtaattcctggaaatctgtagcatgtataccatcaaaggagttagccctgatgttatcagactccaactgttcccgttccccctcttcgggagagcaaaacaatggttttacaccaatcgtgcaattgtgaatacccggaagaagcgctcaacggcattcctctcaagattcttcacgatgggcaagatcaacgctcttcgtggaagaatatccagcttccagcagacgagggatgaaaccattcctgaagcttgggaaagactacaagaatatgtcgccatctgtcctcatcatgggatagacgagtggctcatcctgtagagtttctacaacggattaaccccctcgtcccgagatcacctggatgctactgctggaggggcattcttcttaaaagacggtcagagatgccgctgacctgattaagaagatgatctcaaacatgggttggagcaaggaacggctccaaacccatcaacgcggcatgcacaccgtcaagtggacggaaatgctcaccactaagttggatctccttatgaagagagtggacaacaatgagaaggacgccaagcagggtaccgttaaggccctgaactctcacatgacatgtgaggtctgtggcaatgacggtcactttgggatggattgtccggaaacccataaggacgtcatgttcatgagcaacaataacgggtatcgtccacaagaaagccaaggatggagcattgctccatggggtagatcaagtacggaccaaacccacagaacattaaggaggtcaaagtaaaaccccgaaggacggatagcctcatcgatttcatgatggacttcctgagcaagaagaaacgaggaaccgtcagtaccttaggctggcatccaataagccggggacacaggccggtcaacctgtgttcctagttacgaagaagccactgaccataccaaaaataaagatggtgtggcggattaaggagaagacacccgttcccgtacttccagaacaaggtgcctcgtcaagttgaaacattggaggtacagtcgtgctcgtcggatgtcatgtcctgataaattcatcccgaaataaaaatcattgtctaaaaggaataatataattaattaaaattcgaaaagaaattggcaaacattaaaatgcgtacaagaaaaattcgaatgtggtctagaggatttttgttaaattcttcttggtctaaaaggagccctcaaattttacttgaattttcagaaaaccggaaataattattaagcaacaacaacctttatcaaagtttattaaaaagaaaaactaaaaataatcctccttttccctttgggccaagtcttcctctctctctctcggcccgcggtggaagtcctccctttctccctctctttctctccctctccttctctcccttcttctcttgggcctcccctcccactcccggcccactccatcctctcctcctcccacctgggcctgccccggcccaagccgagccgcgctcgcccgcgccctcacgcgtgccgtacgcgcgttgaccgcgcgcctcccgcgtgggtcctgcctgtcaggcgcgtccccgacctctagccgccggcctccttcctctctctcatgtgaaccctagcgccgttcctccctcaaatccgctcgattcaaatggctaattccaaaattgattagggggaattaaaccccattgattcctctctctttccccctaattttccccttgaatagcaccattaatcgcccggaacggccacgccaatcccggccaccttccatgcccgccggccgccattcccgccgccgttccccgctcctcccctggccggctccctcgccgcgcctataaaacggaaccccctcactccgttctctcgttttagccttcttccgcgtctccccgtggccgcaccacctctccccatctcctcctcctctttccccggcgccggccgcctccagccacctgtgccgcctcgcctgtgcaccagcagacgtcgccaccacttccctcggctccgtgacgccgtcctcatctccggcctcacctcctcctcgcccgaagctcgccggagtggtctcctcgtcggcgtccagtacctcccctcctccgggcggctactgttcctcgccggtgagccatcctacgctgccgtctcctccctcggcacggtgacatcgcccttcaccctggccttccctcggtttcaccggaacgctgccgccgcgccggcctctccttcctcctcatcgacgtctcctccggtagccccttccgcagttcccgtgcgccggccaacatcgccgtctcctcctccggcatcacagcggtgtttgttcccggtcgtcgttgtcgttgtcgtcctctcgtcgttcccggttgtagtggcgttcgttcctccgtcaagctgcgtccgttcgtcgcctgcgtttcgtcaagttgctgcagccctgtcgtcgtcttcgtcctcggctctgcgtcgtcaagcattgcgccggccgtgtctcgccttcgtccaaggatcgccgccgaagtcgttccctcgccgttcgcctccatcgtccccgagccatctccgccgcgcccgttcgtcttcgtcgtgccgcgccttttcgcgtggtggtaaggatccctcttctcgctgccccgttctcgtcctttcggtgttgccccgtgcctgtcgtgcggttgtcgaccccggtacccgtgtaccggtgtcggtagtcgttcatgtgtgcgtgtggtgaccgtgttagtgtgcccgctcggtagccgcgtggtttcgacgtgtgcagcccgcgtggtgtctagtggagtccgtttgtcggccactcgcctcggttgacacacggggtccgcttccgtcgacccgtggaccgtctctgtgtgctcggtctaccgtggccctttaggttgacatgtggggtctgcatgtcaacaagcgcagcctttctgtcttttccaggctagcgcttacacatgttttatagttgcaaagcctaattataataatccgcaaatctccatgtaacagcattaaacttcggatgaccatgtcttggtcgtacgaaccccgaatcgacccgttcaagtctcttaatatttgttataatcaaaagaaccctgtgctttctttttatgtattgttattgcttctttataggcttgtagctttgcttgtgtgcttcatgtagcttctgtcattccggaggttctcgaagcgtggttcgcggtcgtcgtcgaaggttcggaaggccgttttctctgagcaaggcaagtcacatcatccttgagcatattgaataccagtttatgaaatttttttggtttaaattattgcattaccactttatttaaattcccgcgttatcactgttttatttagcacttcctattaattctggttatagccttatcattgttattgtttattattaccttgttcaccctaggaaaataaaaccccaactagtgggtactgcattcatggttccactagtgtgaattagggtagatgcttcgctgattaattaggcaacattaggtggttttataactttagactttaggaattctcatgtcacttggacactatggaatggttggcttatggtggaattggacatgcccctctcttcctctttcaaaacccctaaaacctgttttccggtggggtttgggtgtatgccagttgtgggaagtagcaccctggccaatataagaattaagctcgggcctctgttgcaaagtactaccatactaaccacatgtctaatgggcaaggcttaactcggtgctcagtctagtcttgaacaaaaggacacgaatagagatggatgaagtcgttgcaacgatggatatctctgaggcaaatgaaggctacgcgagctgcggctcggtaatcgagatgtctaggcaaatgaaggctacacgggccggtgtccgttagtcgagatgccatggcactggactagtacgcgggtggtctcacccctatgtgtgtggcgcacccggtctagatcctgttgctaggggctcaatcctggcctgcctgtccgggataccggccgtaggcagggttgggtcggtacttttgttcacggttaggatgggtaaagggttatgtcacatgtttacgacgggttccaaggccatggaatgcggagtaaagatgtgtcttgtgggtaaagatgtacacctctgatcagagtaaatctattcaaatagccacgccctcggatatgggcaagcctagcaatgtacccaagttagtggtttaattcttaaaattttcttaacaactaaaatatggaatggtaggcctgggttggcttgggatgagctgggacccaggtcgggttgccaattcggtctgaatcattgtaggcctttggttaaggcaggttcgtgagtgttcacgaccttgattaataatattgtgtagctctaggatcgtatttacaaaatagctttgagcaactaagtgtcttttaaatgctgtttactgtaaaacctaacccctattattatccccttgtacccccttgcattaatcatgcatctcccggtgtggcttgctgagtactgtggttgtactcattcttgctctatcttttcccctccttcagtaagagaagctttggagaagaagtcctaggtggagtcttggcttatgccccagtcgagcgcctgtgaagatggagccgtaggcccgctagtccgctgctgtttatttttgtttgtcaggcctgaagtgcctttgtaataatgtaaatattatcgatataataaagatgtgccttttatatcatgtttgtgtggtgtaccctggcttttcctgggactgggattaatacactagcgttctagaaaaggtatttttccgggcgcgacatcggacctaaaacgacgacgcccttgccttgccaacaggtaaattggtggttatctcatatttaatttccgcattgcattagagcatgtttcccttttcaaaattttttgcattcaaatgatttttgagacaacaaatttaaaataaatttttgagcaataataaaataaaattctcaaccagaattcagtgggtcccactccaactagccgttgaatccacaccacgaaatcctgggccagtaggccccaccaagaggttggctaacccaggaaggtggccgttgggcctgtccttttgtggtgcaacggtttttgtgtcccacatgtcataaatggccgttatggcccctctgtataaagaggatggctggggaagagacattcacaccaatgcaactcattttcaacactccctcccaaattcttttgctctcaagtttgtttagcctatctcaactttcatttgctgcaattagctaaggcattttgcatatacaagttttgctttagttcggtgcaagtttaatcagctggtatttgcttacccccgctcgagtagtcttgtacccttgctctttgttgtagccatgaagaaatgattctcgggcatcttcaagagaggatcgagctcgaggacgaaccgacacgatgaaccaagtacaccttcctccgcggatgcatccatgattgatttcgtgtatgttgcgagtaggcaacggctcggtttatttatatggagatatcaggatgcttgcaagatgtatggattgatttcgtgtatgttacgagtaggcggcggcttggtttatttatatgaagatatcaggacgcttgcacgatgtagggagatatcaggcgtaagggtgcaaggggtgaggatgtatggatatattaggtgcaaggtgcgcatgtcgtgagcgcaagtgtgttcctcctgttgtctccaccacacatgacttaagtggttaggagagcaccattcccttttctataataggcaatatggtactaaacatctccatgcatgcgtgacatcccacgaggtgagttttttgtaatttttcaaagaattaatcttcaaaagagctaaaaccaatctattaattccaataattatgtaatcatcccataattattttcgctatcaataagcggtgtctcagtatctttaaagttgaactaccaaatttcatgcatttagcagagccgtaggtgacggcgcatttcttgcatgcaccctggccggttgttcagccactgtcatgctatcgtgcttcgaggtcggtaatggtcaggcgcccactatggccgcaggtggttgtctgctgcacgccggacgacggctgctggcgatcgtctcatcggtgtgcaca

SEQ ID NO: 58141 - DNA, 710 bp, Oryza sativa
aagagccaattttcagtggcatataagggattagactaattttcagtggcatataagagattatctctccatattatctctccttgaggagcccagactaattaacatgttcagatgagtgaatactatttttttatacacaaagggtatttttgtgcattaaaattacttgcattacaatagaatgtatgtggttttagtggacagtagatgctatgtgcaaattcataaaattatttaccaacagaaatatattctttaatacataggaaatgatacacacactttccgatttttgtttatgtccagtgcaataacagaccgttccatacatgaaaaccatattggtacggactccattgacgccgttgcctacaaaattgtcagcaatgccacgtcggctcatagataagaatcgctgaaaaactaccgtaagattttatttttaaaaatattcaaatataaacataattataagcctagttataaaactgatcataaattcccatttcatagtatagacatttataatcagtttactggttggtggcttggcgctctcccacatgcttggaaaacagtgttggcttggcgctctcccacatgcttggaaaacagtgtttcttattaaacatttgatcttgttacatgagagatgagttaatttctgcttagtcctggtgacaaaaaagttacacgtaagacttttg

SEQ ID NO: 58142 - DNA, 773 bp, Oryza sativa
tgttacataatataaagcaagacaatcgtacccatggtttcacacaattgttatagctctagttaactagttcaggatttctagcaagaagttgtacttactcaaaaagctatgagacattgcaataactagcagatcagcagaagtgttgctatattaagattaatactctatcatgcgcacatcaaagataaataaagtattgtataattaatatataaggaaattatattacaaaaaaaatctagtaagaagaaactatcatacatagtcactagctatcgtatggatcctctcctctattctgacagcaaccttctggagatcaatcaatgctgtagtagtactttgcaatttcgtttgcaggctgaacaatctgcagacagaatgttgaatggtaacatgagagatttattgtttcaatatggtacttccaacctaaatagttcaaaaatgtggttctaatataacaagcaataaaagaaacaggcaactgaggatttaggggttgtttcgtacaagaaatacatatgcaaactgttcactatttgggcaatgcatgtggcaaagtaacatgttcaaaattgtaaatacattctcataaataatgaaatataatttgtccaaccagaagtgagcaagattttagcaattcgttatacatgctaagagtctacaagagagcattcataaccaataatcaggagaaactatatataatgcaaaaacaaaaagagaaaatgatgtgggagggtaccgagctcgaattcgcc

SEQ ID NO: 58143 - DNA, 15855 bp, Oryza sativa
tccagctcgctggcggtgcactcgccacgcacggcggggtccaggagctcgaggttcctgccgtcttcccatagcctccatgtctgaaagaaaaaaaaaagaatatattttctatctattatctatctatctattatatactaaaaatacattaattaaacttcctataaaccctctcaaatcatcacgtaggactcctatgaactctcctaagtcaacatgtggcactgtaataaattaaaataatcatataacttaaactggtgggccaattcgatttatctcaacaaaaaagctatccttcctctcctgccgtacgtatgcatatattactcagtgtgttgtctcgtctcatttcccctagatcccttctccctgtttcttcccttttcgctgtatggtagttaagataacattccgtttttacttaattttactcatatctatttttagtttgtttgaactgttatttcattattagacatgtaaataatttaaggtcaagattaccaatattttactataaaaacttaaaatacgttatttgaactgccacctattctttacatgacaaccaaataatatccgatttttaatttgtttgaattgttttctatttataaatacgtgagtatatccggatttatattactcatattttactatgtaaaatttaaaatatgtaatttcaacatagaccaacaaccaaacaacagtgaaacgctacaaaaattgacatgtatatgccatcatgaatcattctacataataaaaattagaaaatacaaagtcgccatgtgtcaccttttagagccctccacgtgtcacattttaaaaattagaaaaatcttataaaatccaaagaaaaacaaaacatctagccaatggttttcacttagatcgatgacctattgatattattttcaaccatcaaatatacttttagaaaaatcttaatccgcgacatgtcacatattttaataaaaatcttacaaatcctagggaaaaaacttctaataattggctttcaattaaaccacttagagaaactaaaaaaaatgccccctccatatcgccctccatgcatccatcactatatacccactccatcttctcctctctagctcgagctctatgctcttctttcctataaatagaaacaatctataattataagctacacgtctggtttataatcacataaacgatataaaattcatatgcctatattttgttatataacaaatagtacgacatttcgacacaattgacctattacttataagtatatcaaacgtagcctacgatgcatgcccgctcattctggccagctaccttcttagttttatcaaaagtttaactttgtttgggacgtgcatcgaaatgtctgaaactcttaatttcggaaatcgagttccgacagttcaggaattttaaaaactcagttctgaaaatgtaaactgtaaaccctgcacacaactctctcatgctttgttcaactaatcctgaagagggagaaattggaggggattgagggggaataattccacactacaataggtgtgcaataaatccaaatccccctcaatccacttatatatgaaagggattagttgaacaaggcctcacggaaattaattctagctaatatatactacctccgttttatattataagactttctagcattactcacattcatatatatgctaatgaatctagacatatatatgtgtctaaattcattaacatctatatgaatgtgagaaatgctaaaaagtcttatatatatatgaatgtgagcaatgctagaaagtcttataatatgaaacggaggaagtattttctattcaacgtatgcccccaaatgcatgcaggagagatgtgctgcttacatgtgctataaggctcgaagttccttggttgtgcttgccactgatgatctccagtagtagaacgccgaaactatacacgtcttgcatgaatgacaacttaccatccattgcatactctggtgacatgtatccactacaattggaggataagatcggtcaataaataatctgatgaaggtttggaagatatttagagctttttcagatattgagatctgaaaatccagccactacatctatcagatgtacacacaaccaaaaagaaatttcgagctaaaacacatggttatttttatccgtaattaattgtctatatagttgcattgcttacggtgttccaacaaccctgtcagtgatcgtgcagtcctgattgccaccattgtggctgaaaagccttgcaatcccaaaatccgatatcttagccaccaccttaagatctcggtggatgatggtgtgccttgagtccttgtgaaggtattgcagcccactagcaatatctaagattatgtccattctcattttccagctcaacatagcacgcccactctcatctgtttgcaaattccgaggtcagacaattccttttcttttcgataatggaaatctatctagcctctacattaactcacaatttcttaatctacaactatttaagcatatgcatatatattgtgctctttttttcattgccttaagttttgggtgatgttaattattgaattgacaaaatgcaatcgtagcactaatgaaatggtgaatggttttaaaagcaacatacgaaagataaaggcgtctaggctcttgttgctcatatattcgtagacgagcagtctctcggaacagtggatgcagtagccgagaagatggacgaggttgcggtgttgcagcttacagataatgtcaacctcattcatgaactctttcagtctttgaaccgtgttctcctttgagagcttcttcacagcaatttcctgaccgtttggcagttggccctgataaactcaatcagaaattcgtcagtgagttcaaagctgttctttttattagttagttttcataaaacggatttggcaggttcagaatagaaatagctaattttacggctcctttgaaatgcagaagttttacaggattttagggtaatttatctagttccgatgaaatcctaattaaaaaaaaatcctaaagagccttatcaagcacacatacgtgtagaaaatcctaatacaagtgccaatacttttgaactgtagtttgtacgacaatatacttatttgtttttcgcacttttggcattgatgcatgtttcattaaagatttgtagagcattatgaccttgtaaacaatgccaaatccacctcgcccaatttcgttctcctgagagaatccattcgtagctgctctaataatctcgaaaggataagtaggacatccggtgatgaagtcacctgtctcatcaagcaccctgactgcaaaatggagaagccatatgagcaatatggagtataagagagcagtcaggatttggatcctaaaacgttttgtctgttagatactgagaaattaagtataattacaaggatcagttaccttttttgcagcgccgtgcctttctccacataagaaatccaagcgactgtatagccaagacgaaccctgtaatcaccagtgcaatgactaccacaaagttggtgtttttaatcgcgtctgaacatttgagtgcagctttattgagggttaaattgaccaaatatttcatatttcaatcagtagacagaaaatcatcacggcatttgtaggaataatcagcaattaccacttttaggctaaatccacgtaatattgatgtaaatactgctagtgcttccttcgatcaattatatatttgatttcgggagtaccacaaactaatactcccgcgtcaaatgtaattaaccggaaaaaaagacaatagaatggctgagtccaatatatatactatattcctaagcttgacctggcctggttgtcactttaggctattgaaaaggacttgtcagtggctgaacacaagtcatgcatgcatgcatggacaagtctataattcccgatttcaacggaaagttcaaacttatcagtatcaaactcaggcctaaggctgtgtttagatccaggggtgtaaagttttggcgtgtcacatcggatatacggatatatatttgaagtattaagcgtagtctactaacaaaacaaattacagaatccgcatgtaaaccacgagacgaatttattaagcctaattaatttgtcattagcaaatgtttactatagcaccacattatcaaatcatggcgcgattagacttaaaagattcgtctcgcaatttacacgcaatctgtgtaattagttattttttttgtttatatttaatactccatgcatatgttcaaacattcgatggtagggtgtaaaattttgccagggatcgatctaataaacaggccctcagtattttagcttcatggaatttccaaattctctctatcaggacttggaagttgccatcagggcaaattctatatcaggaaaagatcttgcctccaattatttgacctccaaaatatattattagtttttttcccacttgtttgtttttaagatagtattctcaattatttatgtacagtccaactcacggttaaactgacgtagttgacttcagcctcacatgtaccaccgcatatccatgattcgatattactccattaaacaaaaagatcacaaaactaacatgccattttcatctagtactaactgtactaagagttcactttacaacctgaactttcgtgaaagtttgaaacttaaaattatactgtaaaaccagatattaattataaacatttaatgccgtctacttgccaattaagttgccaaccttggcccgaatattatctatttgtaaaaaaagtaaatgcttaaaaacaattaataatgtataaataaggttaatgtagataaaaactacttcaaaatgtagataaaaaccattttttgtgcatggaatagatttagttttgccacactaagtttatttaggttttaaaattcaaatgcacttatgctttccaactgagattttttttcaacaattgtttgaagtactttgaatattttacaatttcaaacgcatgcaatttcacatgtatttcaattctacaaaattaatccctggactatattaaaactaaccccaatatcgataaggttttattcagatataagaacattttttccctgccaagtatagcatattttatggtaggaaatttattcaagttgtaaatgttggttggaaagattatacttttgtaaaataattctttgaattcaatactgtttttatttaaaaatttgttctcaaacttacaatgcattgccacgtcatccactacaagcgcatggtaaagtttagggttagatagtgtgtgattataaagttcaaatatgcttccgaaaattgtaaaaggattttccgttgccagctcgtacattagcattttgtttttattatggtctaatcatgagcttgacttgtgttagaataaatgggctaggcccgatttttctattaaatctcaaaggcccataataaatgttaaagataataataccaccctgggaattaaacgaggagtatctcaacttcaatagggagttattggaggctccctgttgaccggttgaggtggggattggaaagccacacgctcgctggggcgggcgttgcgcctgcttctatccttttgcaacggatcagaatccaaccccgagattgcctccgtaacttgcaatggatcagaatccaaccccgagattgcctctataacttgcaacggatcagaatccaaccctgagattgcctccgtaacgggcaggcgattcaatacccattgatcgcgtcgttactgcggcaacgggcggatctctctcctgcgccataaggaaagggggaacccgatcagatccgctcggttactttccaaacaatgtccgctcggttactttccaaacactggtgttcttcctcctccgcacgccgccgctgggtattgatcgcgtcattactgcggcaacgggcggatctctctcctgcgatataaggaaagggggaacccgatcagatccgctcggttactttccaaacactggtgttcttcctcctccgcgcgccgccgctgggtattgatcgcgtcgttactgcggcaacgggcggatctctctcctgcgccataaggaaagggggaacccaatcagatccgctcggttactttccaaacactggtgttcttcctcctccacgcgccgccgctgcctgtggtgcttctgtctgcttccccggttctgatcgcttgcacgcacgaaagatcggaacgagcagggcctccggaaccacaccttcgcctgagatctgcactgggtaggcgggtgatcaggtttttggggagtgctttcgcactactgctcctcgtcttcagttcgtcgtcgaccgtacgtctgcatcaccatatctgccgcacctgcacctggagctggagcaccaggagctagtgcacagaactacaacaccaacggaggcagttctgcctcacaatccagcagagggactttcacagggtataatcctctactgttattttagtttttgatatttctgttagtcgcagtacaattgcgttctatgtatgatgatgatgcttattctaccttaagcatgctcctgtttatgtttgattttatcactagatcacctcacattgttcatgccatgattattgtcttaatattttggattaaaatatgccgatatatgactatatttccaacaatccaaaaacctgataggtcattttcggtagttggctttgctgctgcactgaaaccacatgcttttgattgttctaattataaaaggtggaaagcacgtgcactactgtggttgacagcaatgcaatatttctatgtttcacggggcaaatgaagtgaaccacctctctctcctgaggaagaggttaagttcgaggcttcggattgcctgttccgtggagcattgatcagtgtactcgctgacaatatagtggacgtgtatatgcacatgctttcagggaaggacatgtgggatgcacttgaggccaagttcggagttctcgacgccggcagcgagctgtatgtcatggagcagttctgtgactacaagatggtcgatgaccattctgtagtagaacaagctcatgagatttagatgctggctaaggaacttgagaacaacaactgtgagttgccggacaagtttgtggcgggtggcattattgccaaattgccaccttcttggttggactttgccacttctctaaagcacaagagacaagagttcagtgtttctgatctcattggctctttgggtgttgaagagaaggcgaggataaaggacaaccggagcaaaaaggttgagggaggttctagtgccaatatggtacaaaagaagaaccctcatgcatcccacaacaacaagaaagtcaagcctgatgtcaaacccaaggctacaaccaattttaagaagaaaggcaagggaaaggcaaagggtgactactttgtgtgtggcaagtctgggcattgggccaaggactgtcctgagcgcaaagacaggaagtctaccaacatggtcattagcgaggagggcggaggaacatcggggtacggtaaattattacctacagttctctctgtttttcattcacctgattggtgggttgatactggtgctaatattcatgtatgtgctgatatttccctgtttttttcttatcaggtcgggagaggttccttcttgttgatgggaaacgggtcacttgcggctgttcatggtgttggtacggtcgatctgaagtttacttcgggaaaggccgtgcagctgaagaatgtgcagcatgtcccttcaataaagaagaatctagttagcggctctctactgtgtagagaaggttttagacttgtgtttgaatccaataaatgtgtcgtatctaaatatggaacttttattagaaaaggttatgacaacggaggcttgttctgcttttctttggatgacatgtgtaataataataatgttgtgaaccatattagcgagaatgatgagtccaatgtgtggcattcgcgactctgtcatgtaaatttcggttgtatgatgcgcttggctaatatgagtttaattcaaaaattcactttggtcaaaggttccaagtgccatacttgtgttcaatcgaaacaacctcacaaacctcacaaggcatctgaggcaagggatttggcacctctagaacttgttcattccgatttgtgcgaaatgaacggcatgttgactaaagggggaaagaaatatttcatgacactgatagatgattgcactagattttgttatgtttatctattgaaaacaaaggatgaagcattgcattactttaagacctataaagctgaggtagaaaaccaacttgaaaggaaaatcaaacggttgaggtctaatagaggtggggagtatttctccaatgagtttacatccttttgcgaagagtttggaattattcatgagaggacgcctccctattcaccccaatcaaatggggtagccaaaagaaataactgtactctaactgagatggtgaatgccatgttagacactgcgggacatttcaaggaatggtggggtgaggcagttttgattgcgtgtcatgtcctgaataaaattccaatgaagcataaggaagtaataccattcgaggaatgggaaaggaagaaattaaatctctcatacctatgaacatggggctgtttggccaaggtaaatgtacctatagccaaaaagcataaacttggaccgaatactgttgattgtgtgttccttggttatgctattcacagcgtgggttatagattcttaatagtaaactctggagtacccgacatgcgtgttggtacaattattgagtccagagatgctacattctttgagaatgaatttcccatgaaaaatacacctagcacttctagtcaagaaactgtcataccccatgagcactttgcaccgatagaacacaatgatcaaacgcttgagggaaatcctgaggaggataagattgtagatactcgtaagagtaagagacaaagggttgcaaaatcctttggagatgactacattgtataccttgtggatgacactccaagaaccatagaagaggcatattcatctcctgacgctgactactggaaggaagcagtacgcagtgagatggactcgattatgtccaatggtacttgggaagtctttgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggattttttcgacacctactcactagttgcccgtttgaccacgattcgagtactacttgctctggcagcctctcatggtcttctcgtccatcagatggacgttaagatagctttcctaaacggagagctagaggaggagatctatatggatcaaccagatgggtatgtactagaaggtcaggagggaatggtgtgtaaactgttgaaatccttgtatggccttaagcaagcacctaagcaaaggcatgagaagtttgacaccacacttacatttgcaggctttgttgtgaacgaagctgacaaatgtgtgtactatcgctatggtgggggagaaggagtgatcttgtgcttatatgtcgatgacatattgatctttgggaccagcctcaatgtgattgaggaggtcaaggactttctgtccaagagttttgaaatgaaggatttgggagaggctgatgttattcttaacattaagctactgagaggagatgagggtgggattacacttgtgcaatcccactatgtggacaaggttttgagtcgctttggatatagtgactgcaagctagcttctactccttatgatcctagcgtgctattaaggaaaaactgaagaatagcaatcgatcaactgagatactcccaaatcattggttcattgatgtacttggctagtgcaacgaggcctgacatctcatttgctttaagcaagctgagccagtttgtctcaaatccgggagatgatcattggcaggctctaaaaagagtaatgcgctatctaaagggcactgagctatgggcactgagctatggaattcactataccgggtacccaaaagtactagaagggtatagtgactcaaactggatatctgatgctaatgagataaaagccacaagtggatatgtgttcacacttggaggtggcgctgtttcctggaagtcttgcaagaagaccatcttaacgaggtcaacaatggaagcagaacttacagcactagatactgcgacagttgaggccgaatggcttcgtgaactcctgatggatttgccggtggttgaaaaaccagtgccagctatcctaataaactgtgacaatcaaacagtgattattaaagtgaacagttcaaaggataacatgaagtcatctaggcatatcaaaagaagactgaaatctgtcagaaagcagaaaaactccggagtgatagcattggactatgtccaaacggctaaaaatctggcagatcagtttactaaggggctaccacgtaatgtgatagacagtgcatcgagggaaatgggcttgatacccacctaaggttgcacaatagtggaaacctgtccattgtgatcggagatccgtgaatttggatggcgaaacaaactattgtgtggttgagagaagagacccttgaaaagggctcattttcatgatgtacttctcttctactctgcatggtaggatggcttattccttaatgtgatccgagtggcttttctaagcaaagatgttgacctgcagaacatctcagaaggaacacacctatatgagttcgactgctagtcacagtctatgagatttgggtgatctctagatactcatgaaagggcctggagtttgacttatatgctccaaacagaggggatgcaaactgcagcccaataccaatcaagctgatattgataattcaagttgccccctacgtaattatgaaggttcggctggatgttacatactaagtgctcaggaatgacttgaggcattactgtgccatccggccgtacgtggtgaaccaagtgttctagaacaacttgatataaaaattgttgtataggctgaccgccaggcgttgcaaacccggccgatgcacttattgaaccttggtgctgaatcagctgaacgacttgctgtcttaacggcgtctgccgaatcggctgcagaggctgctgccttggtggtgtttgctgagctggttgcatgacctgttgctgaatcggttgtacaacctgttgaattgggggtgtctgctgacttggctgctgctgtattggatcaacaataggttgaggtggtagaaacatggcagcaaccggatcttgggtcagccgattcgcaacctgcctactatgctgtggctgctctctcgtcaagaaccgaggattcaccggctagcctggcgtcatcgctgacaacgcaggtaggggagttgatgctggcgccgtcggctgagctgttggtgtaactgagggaaccgcctgaatggatggctgaacatcggtgatcaaggaccgataatttggaaagacacctcctttcaaataaactgggcctgcagcctgatgctcagctactgaaccatcggctattgacttcatcatgtttgataaggtattgactaacaccccagactgattgatcagagcatgatgtacggcgtagtcaacccggtcttggaaattgttgaaacaatcttgtgccacatcactattccgattaagatctcctccctataatccttgagcaccatcaccttgatttccgagagatccgtcggtagcaccattgtcactcggttgagctgagccatctggagcttgcttcccatctccatccttagaagaatcagttccagaatcatcagcaaccacttttaatttgtacttctgaacaaatgttcccttgcgagtctgtgatgtgaccatggctaccacggatgcaaccattgctcacatcatggatgaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctttttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagctaggtaccccttcagggtttctgggggttttgtttagatgaaagtttagccattgctacttccttgcagcgcgcgtgtcggctagaccgtccgtctgcttgtatttgaaaccccaacttatcttgtgtattcattcctatttgcaattcagattgcttttatcttgttcttgcttgtttcttcgatttgcttgcaggaataaggttgatctgcatcggcaagatcaacaacccatggagaggtgtatcgatcgctaaggcgcaacacaacgtctcgtacggctgtagtcggatcatcaacgtttcttccaaatcgtagttatcgcaactcaccgaaagatcgggccaataacagccttgagtgtcgagaggaactcagggttcatcaggtggtatcagagctttcgttgctcggtgagtttttatcttcctataaccagaaaatagccatacaaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcgaatttttgtttggtgtcggtttcgagatctttttggaaaaacggaaccggcataaattcagcattccatttttgtataattttaattttggtgtggacttttacatttgagtccctgtatttttcatatttacatttgagtccctgtgatcttacattgaggtccttgagtctgtttttggtaaaaaataatcaaaaagtgagaaaaaaaggcagaaaggtgcaaaaaaaaagaaaagaaaaaaaaccgcaccaaaaaaaatagaaaagaaaaggaaagaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatttgggcttaacaaaaaaattcaggacatgcttgattgtcaaagatatacatctctttctcatttgttacagcttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggtacatccattatctgaagagggcatcaaaggtaaacttaatggtgctgaaattaataaaggtgagtgtgttgttaatgaattgaattcgtccactttttatgctatagcagagcaaccattagtggaaccaactgctggaattcctttgtcacaagttgatttactcgctgttccttgtgataaagaagagttgtgtgataatgcttcacttatatccatgccacaactagtgaatgaacatgctatttctagtgtttctttatgtgctgattttaagcatgttgttcatattgctaatgaagtacaggaacgtgaattgctatcttctttaaatactttgggctatgttcagtttgatgatttttgtgagctcgataatttgaagaagaaattatttgctaagtctgatttgccttgtccaactagtgctatttttcatatatttggcgaatctgataatagaggaatatatttggtgcatagagtttacatatgttcagatttagaacctcctatacatgtggataaaacatgcaagctagagcgaaatgttattgctaaccaaattgtctcgagtttgccttattttgactggaagaaacaggttgttgtaaatggactacgcaaagagcaccatatggaaaaaccgaggacggttttctgtgaagaaggggaggatgatgtgacgatggctaccacggatgcaaccattgctcacatcatggatgaacaagaagatatcaagatcaagtcctccaagtgctggaatccgattcggccacctactacactgctgacttcaaacggctgccgaatctgcatacgacctccgttttcggcccgtg

SEQ ID NO: 58144 - DNA, 2876 bp, Oryza sativa
tcccccccttctccaccccactccattccctccgcttctccctcttccccttctccacgcgccgccgtcgtcgcgccgccgcgccgccgttgtcgtgccgccgcgccgccaccttcgaagccgccgcgccgtcgccccggagccgccgcgccgtgcgtcgccgccttgcgccgccgtcgccgtcatcgccgccaccgccgccgccggtgagccgtctcccccccttcacctcgcgcccaccgccgtcgccgcccggggaagcaaagagccaagagagagagagatagaaagaagccgggagggagcagaaaaaaaaaaggagaggaaaggaggaaggagccgggaggagagaaatagagaaaaagagagagagggagagaaaagagagaaaaagaaagagaggagagaaaaaggagagaaaaagaaagagagggagagaaaagagagaaaaagagagagagggagagaaaagagggaaaatagaaaagaagaaaaggagaaaatagaagggaaattgggggagaaattaggaggatttaggaaataaaaatggtcggggttaatcatagattatttttggaaattcctcgagcgtaatagtatttcggtcgaaattccgagttaattataaaaatatgtttcttgatcagattagattaaaattggtagtaatttagatataattaataactaaacaattagatgaattcttatagactattatagattattttgggtaatctctataagtaattgattcacggtagaaattcggatttaatcactaggaattttagacgtatattatatttagtcgtttagtcctagactaaaatttaatcgtataatattataagataattttaggattccgtccgatatttagcttgcgatagaaatttccaatctattatatggatataatgctcgggtagattaaattaaaaacttatggcaacaaaatatttatacccgcaaaatagtttaaatcgaaactgggtttgccttagttcgcggataataaagttaatataaagaaatcgactttcgcattcgactttcatttgattcatttggatttttatttgaattctaaccgaattcaaatcaattttcgcacgtaactatagagcccgagggagttgcggatccaagcgaagatcaagacccgcaagacattgagcaaggcaagtcatcactattccttgaacatgttgatcctaattgcgaaattgttttgtttacaaataaaattgcatgcagtgatgaacatcctacttgtgattatgccatgccttgattattgtttacccttaaatctttgtaaccatgtttacgtatgagtccctagtcaacaatgacaattgcttagaaatgctattctagaatcatgcatactcatatttatcaaatgctatatggttgggcaattacctttgggaaggtaattgagatgcggcatgtggagacatgagcgccacattgccatgatgttgatgacatgatttgtgaaaggagaaataaaattaaacaactgttttcgactggggcggatggaggatttgggtggtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctaagtgaggcaggtgcgctacgatgggacggccgttgaggtagggccgagaagcgtgccctacatcggtgtcgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactgccaatgcgaggttatcgaaaagctttgccgtgacgcgtctcatgtgttgagacgaggctcatgtgttgggcagtcgcggagtgcgggtaaagtgtacatccaccgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcggaaatgtggacgtcctcagaaaaccataacgactcaatggcgggaagctatccttgggatcacaatggatggtggacagaaccgtcattgtttaatatgaacactggtattaaaatttgatcagtctatgctaggtcttaggcttgtgaaaagaattacaaaacttgctttgcgcgaaagaaccatagccatcctttgaattcctctgtcatgtgcatcattgttgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactgtgcctgcgggcttatgatgtaataattcatactagactctcgtgtatgagtacttgatatttcagctatgagttcgtgtgtaccagactacttgatccagggaaatggtactgtttacacgattgattcctgttataaaaacgggggtctacaccgagacggctcggcacgcgg

SEQ ID NO: 58145 - DNA, 9587 bp, Oryza sativa
cggttcggtggagcaaggccgggtgcagctcgaggccgacgaggaagaggaagaacgtcgccgctgtgctcgtgtgctcggtgctgccgcttgccgtcgccccgtgcgccgggtggccgctgcatctcatcgtcattggcggtgggtccccggcggtgcaccgccgcttccttggccgcgcgtcgagccgtcccggttcgagccgttgcgccgaccgtgtgttgtgccgctgctcacctgcggcgggaggaagaagaagaaaggagaaagaaaagaaaaggaggaagagagatggagagctgacatgtgggcccaagggcatttttagcatttcacgcgatttctctctccttctcaactgaaaatcattattttaatcggcacagtgtccattggcaaattaccacgttatggagtgtttttccctaaaagtgagtttaggcagtgtcccacggctaaaaccacacaatagcagtgtcctatagcaaaatttgccttattgatatgattcgacgaaattgatcctccaaagcaaactaagtcataatatatttttcttcaaggtccttttctctccctatttctcagggatcattctgtaatttctctatggctgtgtttggaaaatgggttaggagaggtaggattggaaatgcaaatgaatgaagggataggataaaatagggtccctttgaagggtgggaaatcatatcccaaacccattttccaaacataatctatgtgaggaggtcttttctgtaagatacctcatattccaaactgacggcgtcatcgctgtcaaacggagaccgtcaatttcgaaccgggcgggatcgagaagattccagaaccagaagcacatccgcctcaaacacgacaaaccccccctaccctgttcatcttcgagagattcctcccaatcccgagcagaatcccccgccccggcgaatccgcgcggcgctcgaggtaatccaatccctcctcttcctccgccctccccctccctcgccgcgtcggctcgccggacggacggtgggttctccatggtgtcggctttctttgtgggctctgccgatttccgcgttcctgaggccgcgtagaatctgcataggagttgtttgggtagatttagttggcggaatcccccgcggtgtgtggaatggaggtggattagcttggctcggttcggtcccatgcgtggatatgctgggccgcctttggagcatttctttgtggtgtggctacccagctgtataataaacatggcgagtaggattacttcctgtgtagtcaatttagccattccatttagggatttctgattctgttgcaggtgtccgtggcactggtggtaccttgatagagactagagtgaatgcctttttctttgttctgtttcattgtttgctgcatcctgatgcaaattagctcggcctgtaaactgtaaaggttgcttgtttgtgtcgtcgagatgggatttagtgcgccgcggcagtttgatgatgaattagggccttagcaggttctttggttaggagaatgttaatccagggtgaagagcgaagaagaacaagtagctcattaagctgcaattcatggtattcatgaaaagttgaaacgatatgtatttcgtttgtaattcatttccacagcttttctgttaaaaaagacattgaggtgtgtttgttattcaagtagtggaaccacgtatggagttttctggaatgggaaaaaatcctaatggagcaatactgtgtggaggtcgagtctttaccgatacttgtcacaaaataatttagttattagctctcttttatgaaaggtagaagaatggttgtgaataactgggaatggttgaggaggatctgtttgtctattgtgtacttttgtgcactttggggctgactatagttttgtttgtagctttgcacaagatattagatgtgatgcctttgtcacttgctgaaatactgaattattttccctttgctgacagtgaatttgactagctagtagccacgcatgaagccagatggtgaaactcagcttcgtcctacagctgctggacatccagatcctggtttgggcacatcatctgcagaatacgtggcctctctaggaccagctacagtatgatctgttctctttcttgtctttagaaacatgacagtacaggtagtgcaacgactacctaggatccttttctgctcgaagttctgatggtaaaatttgactacaatttgatcaagaaataaaagatacattattatatgactaatttcttaccagttacatcgatacttagttcttttaccaaccttctcttatactgctcaggttcagccctaataaataaattatttctttttcaggctccagtatcttatccatatatcagtacctattatggaggcacttatggtgcttatagtggacaacctctggtaatttacgttaccgatatagtcagatatcagatttactatagcagctgatttttgttatctactttctttaggttaacgctgctttaatggcaatgcctccgcattctgtgcccttggtgaccgatgctgttgtagagcccatatatgtcaatgcaaggcagtatcatggtatattaaggcggcgccaatctcgtgcaaaagctgaatcagaaaataaggccaacaaaatccgcaaggtatttcctaaatattatacttgcttgagccatattttcaagctatttatcagacagggtgaaactgctttgccacctcttcaagattgttgttgaagattgacccatgccatcaaaacaggccttatcaaaatttcaagaaatttatgggaaaatgaaaattaatctgtttgctccaagttcagcatggttgtgacaacttattgggtttttacagtttcccttttgtttgtgaattgttcttttttttctgattgatacatccattgatctcatagatgaatatatgtgttcatatgtgtttggaatttcatttcttgctttcctcctttttcactgttgcagttatggatttgcaacgccttaggccccgttcgatctcccgtgttggagatggattttgttgcacgcaaaacgagaaacctaattagcacatgattaattaagtattaactattataaatttgaaaattggatttttttttcaaacaacttttatataaaaactaaaaaaaagtaccagttaacagtttgaaaaatgtgctaacggaaaacgaggaagttgaagtttgaagttgaagaatagaacagggccttagtctagaatcccacatatcagtcaattaaggggaaaattcctcactttggcatccttaatttgatcttctatagttattttgactgcaaaacttagattgtaccagattttagcaaggtttaaggggggcaatatatctaccctgttatttccatcttcctgagaatatctttcatctctattcaagtttctatcaaaactgactgtgctaactaatttaaacagaacaccattaaatgatattgtgagtttgtgacaatcttaatttagacgatatggctaatccaatagctttgtcgtaagtcacttttttcctttatattgataactacagaccgatagaagcaatttatggttaatttttttactaaggtgctcaagtaatgttctcctcactaaatttaatatagtttcacacttgaacacgtagaggaccaagcaaaaaaaaggatatgctccttgttctaaatgctttatcatgtttaatgggcactagtttctgttcatattgaaactcagttgtgttctttgtttctcatttctttggtaccatttggtttgttccttcttcagccttacctacatgagtcccgccatctgcatgctttgaaaagggcaagggggtccggtggtcgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggtgcagatgcgtccgatgttgtatgatgcaaatttagccaatccctccctaatccaaccaaattgccagaatcgatcgaattgtgtgcttgctttctgttcgtgacagtttaagtctgacatagctgttagttttgatgattggataaatccatgatagtatagtgaacatgttgtgggagcagttcagtgctagggtttgttgctgagtgtagattatgaaccttgtgtcactgttgtgttttgcttctgttaatgaatggtagcttacaatgggaacttttgtgaatttcaggttgaacaatagttccttggaaataccatgagaataacttgtttacagaacggtttgttcattcccaaattcgctgaggacttgcttggataaaaatgtgtcactgttgttcggtgtgattgctaaccgtatatgataaaaatttcatgcgcttaaaagaagcaagaaagcgtctggagcaattcagcaatatctgtgtgcttagctgacctacgtgagcatacttggtgcacgttatgaactttttactcttcgccttggcaaaatctactcctgaaagcaatggcaaatacagaacagaaataggtagtgtgtgtggattgggggcaagtgtatggagattgtggctgaccacattgggaagggtggcagttgccttggaaggagagaggcaacaccggctagatgaagggtatggaactaatgaatgaaccctactcgttagtggtaaagtgtggttgggctgtcgaatgagtacgtacgaaggagaggagaggtgggccttgattcagactaatagagaagaggacttatatgtccttttcttttagcaaataatcataaatgttctatagtctattgtgctacggaaatttaaggaaatactaagttatttaaagcattgagagattttattaaaaatatatccaacacaacttcttgataaaattgtattccatggttctattttcttgtagaattgtctttaactgtattttaaacttcttaagaaaaagcctggcacgaatgctagaaactgcattttagaatgatttattaaatctcaaaagtttcaaataaccatggcacgaaagctgcaaaatgaaccaaattttgcttgactgggagtgtcagatcaaagacgatggatgattgctaaagttgaagaactcaatttcaactcagtgagctagaactactcccctccacccaccaccctccctccttccctaggtccactcgtggatggtgagttgaatgtttgtagagaggctcaatgtaattttttgcctattaaggaaaaactcatcatgtcattttttccacatgggggtagtgaagtggttgcaaatggcaagaaaggaggctaatgatgttgtcttccctaaatagggtgtgaagtcatgctgcataacgcaatacataggagaagaggagggaggagacgaggggtaatatgtctggtttgaatgcattgggagtaagatgtcctggtttgtagttgaaaaatagactcaattaagagctccatagataaaatcagactcctcttattttttttatttatcatatataatcctcgctttagcttcaaattccgtgtgtcatagatgttggattacaaatgccataaaactactttatatagtttcttttttgtcgatgttctagaagctaccgcagatgttgtaagcgagccaatgttgtcatgtgggccatacctttctccacgatagcatttactctttttgcgggtcccatgactcacaccaacaactaaagccaaaaaggttcaattttgcttatatcattcacctcttcttgttcttctccatctctaagcacttctacctaacgaaaccaaagaggagaagacttgtgttagtcggtgccatggacgagttagggatcatcgagcaaggcgtcgactggaggactcgccttggccaagacattcgcgattgcatgataaatgatatgtgagtgcactctctctctctctctctctctcacccaattcttacttttttttgccatgagaaattgattgcagtgttttgaatcgatgataatttatgaatattggataccctgctcgatgctatagtacttgtttagtgatctaattgaatcatgatatgtatcagtagtcagatctaatttgacgttttctagatccaagagttgtgataattctgtggcttgctatctaaccgtcacgataacctaaaaattggcatcagttttggtataaaaagttgttggtgaggttcaaacctttgtgtattgatcatacccatgtttagaaaatgatcccaattaatgaactaaggttgcatgtcgatagttctttaccaagttacttggccagttctttgcatgactctaagctttatggactagtattttagtactgaaacttcagctgtctgtcgattttttgttatattatttaactagtattttacttcagcgcctattctttccctgttcccaccatgaggaggaggaagagggagagacctggagaaaggataggtgattgtttatatgtatgggtatatgtaattgcttttaatgcaggtgataaaactcacaagaaagatgatcccatatgcatgctcccacatcattttctctttttctttttgcattatatatagtttctccttattattggttatgaatgctctcttgtagactcttagcatgtataacgaattgctaaaatcttgctcacttctggttggacaaattatatttcattatttatgagaatgtatttacaattttgaacatgttactttgccacatgcattgcccaaatagtgaacagtttgcatatgtatttcttgtacgaaacaacccctaaatcctcagttgcctgtttcttttattgcttgttatattagaaccacatttttgaactatttaggttggaagtaccatattgaaacaataaatctctcatgttaccattcaacattctgtctgcagattgttcagcctgcaaacgaaattgcaaagtactactacagcattgattgatctccagaaggttgctgtcagaatagaggagaggatccatacgatagctagtgactatgtatgatagtttcttcttactagattttttttgtaatataatttccttatatattaattatacaatactttatttatctttgatgtgcgcatgatagagtattaatcttaatatagcaacacttctgctgatctgctagttattgcaatgtctcatagctttttgagtaagtacaacttcttgctagaaatcctgaactagttaactagagctataacaattgtgtgaaaccatgggtacgattgtcttgcttcatattatgtaacataatacaatataatgtattggttgcaagatgctctacaccaattttatcgatctaattaaaaatgtttattactccttcatttggtatcgtgcacaagacactaggactgaggctgtattcaattaaagtttttcattttacatagttccaaatatttatgtccccttttcaatttattggcttcaagatgtaaatctctagattaattctagaatatattgattttatcgtgtgcactgattttattgtcatgcaattacttgttttggtggtgttcatatactccctccgtttcacaatgtaagccattctagtatttcccacattcatattaatgttaatgaatctagatatatatatatatatatatatatatatatatatatatatatttgtctagattcattaacattaatatgaatgtgggaaatgttataatgacttacattgtgaaacggaggaagtcccatttaataatatatgcacttattcttgacttgctagattgttgacatgttccttttgctatatatctttgtataatctttttgaaactcatatggttatggttcatcaataggatgttcagttttaaacggaagttctcataatttttttgtcttacacttagggtgattatctacggaggatttgtctgacaagaggtgatttggactcatatgatgtatttttgaatgattgtcaacgtcagcaagcttcaatccgttcatccatcttgctccatcaggagaataagcaaggtgatcaaattgtccaggcaaaaagaaatattaaggggacatcatctagcagtatgttcttgagaatttgaacaccagtgtactcagcagatatattgttttgatctgtttttatggtgcctgtatgacaaaagaattgtttgcttagtaaatattcgagaaaagtggttttttttttacccgagtctacacatgaatctaatgttctgcactagtttatacatgacaatacatcatacatgcaaagacaattttcaacgtctacaacctgatcccgtttgattaaacaagcattgtaatgtttttcttctttagacattggaaatttgggtgcaaaacgatgaatattagttattcttatgcaacggatgattcaagtgtgtacattgcctcctaattatgtgccccctttttttttcaaaagataaattggagctagcccaccgtactgacttatatcatctatgtaaaatgaattacagatggcaatctctctgtgaaactagagttaagcaaagcataaaaactacaaatttgttgtaagttgtttaggtggttctccaagatcaagtatcaacactaaggagcatgtgttagagtcaatgccagtaattgttctccactaaaataatgtaacacaatatccacttttatattgcaggtgtgctatctaatcaagtagccctaaatgaccacaaggagcactcacacccctacgagaaggatatgatcagcaaactccctaacgatttggtccaacatattatgtcattcttgtcaatgcgagaggctgtgcgcaccagtgttttgtcccattggtgggtcaaccagtggaccttcttgaagtccattcagcttaatatatattggtttcatatggacagagaaaaattcagtagtttccttgacaaactattgctaagccgtgtccaagctgatgctcccatggacacattcgagctaaaatcttttgcaattgaccgcgccaattattggattaatcatgcaatcaagcacaatgctaaagtgcttaaatttgctgaatatggaaaatgggaacctttctacttggatccaaatcttgtggagttaagttctcggtatctagaaactttggagctgactaatgttgctctagatgcgacgatattcaatcagttggccaatgcatgcccagcattgcaaaatatgctgctgacagactgcttactggaggtagaagaaatttcatcaagctcattgaagaatctggatataattgactgctatattctcaaggacctgagcatttgtactcctagtttggtttcattgtgcatcaagaatgaaagaacagacaattcttcgttcagaaactcttacctaatattcg

SEQ ID NO: 58146 - DNA, 35384 bp, Oryza sativa
cggatcgtcaacgtttctcccaaatcgtagttatcgcaactcaccgaaagatcgggccaataacagccttgagtgtcgagaggaactcaaggttcatcagtctgcataaacgaattcaggaactgatctcgtgcttgctgcatcattgcctcaaaatctttcttttgctcaggagtgaacttttctagatcaataagcacgacgtttgcctcatggacgtcggtcaatcctaacttctggatcttttctttgacagtgcccgggctagccgaggatggtgactgtggtggtttctcagccatgaggaagaattgcttgctgacttcttacttgtcctaccgggcgtgccaaaagcgtgttgatagaaaacacgaggcctaggagatctgcttaactccagtgcaggtccaaagctcgccttcaaatgtatgagcgtgccagttgatttgatcctgcaataaacaagagatagaaacaaaggaaccgcaattaaatctataaatgatagccgattggctagatgccgatgtcatatcatttatctttgagccgatgtcgtatgtgaatcgatcggcggttgtaaataaacaataaagaactagatctattcgatcagctgtagatattaacgatatatagttcttatatcgatatatttggacagtatggggatcgtcggtgctaggatatacgcgagactgaggtaaaagagatggagatagggatttttatacaggttcgggcccctgagttgtcaggtaataaccctacatcctgttggccgaagccggtattgctcttattcaccataatcacaccagtacaatatgtgggtagcctatctgactattgtcgacatgtcggtctgaaggtctgactcgtagtcgacaacatggtagtcttcctcctcgaatccgtgcctggcgagatcagagatagtgctttcgtatctcctgacggtatccagatacaccgtaggggaataactatgcctatccctgaagtcgatatccggcggcgtgtcttggcttacgtagggttgtatgttgtggcttctagtgggcgtgtgttgattgtcatgggtgtcttccatggtccttctaggggggcttgtatttatacccataggtgtccccttgtccaagtagaactagggaaaccaatatggatacaatccgagtagtccttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacagtagcccacgacttcgatggaaatgaacgagttcatattctccaccgcagactttggaagaactgttatcgagctcacgtgaccgttctcggtgagtttatgatgaggacatcaacaccatcgatacatccacgtcccccatgtacagcatgatggtcctattacccgcgctcgtgcacgtcaactaaattatcagatgagttctttcttgagttcatattcctcgtctttataccccggagacgcgtgcactcgtgttttactcaggaacgatggagaggatccaaagggaagaggattcgcgcggggtggattcggactgcagggcagcgccaaattttgacggccgccacgacttcatgcgaactccgatttgggcgtgcaagtacttcatggaacgcttataaagtctactttcaaatggatccagccacatgtccatatctgttctggagcggccgcaattgtcattttactcccgactattttctgtccatggtgctgcgtcacctcttttggcccaatgggctgtgtatccaagttgggcccattaggggagcgtcctagggttggagcacgaccctatggtcgttcttcccctcttcttatacctctagtcgccgccaagaacaggcgggttttgatgatagagatagcttcttgctaccggctcgcagcgcgcgtgttggctaaaccgcccgtttgcctgtaatcggaaccccaccatattgtgtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggctgtgaacgtcgtcttcatctaatcgagttatcccttacctatcatcgaaagatcgggccacaaaccctagtgggttcgcatcagtttagagataacgttagacttcctttatcagcctcgtgcgggcaccgaaagggtttgtctaagtcaatctctgatgtcgaccgagaatgtacggagcgtacgactaagtctcccgtcttgctgtaatcgagaatttggattaaagtcaagaaattttatctcggcgggtacaccatctcttcattccgtattccttgtcgagatccagcaaccgttctcgagcgatcgagaaggcgtagagtctgcgacggagtcttgtcgacatttgtcgtactcgccttagtcgatcttggtgtagaaccatagagacatggagccttcatcaatgtcgaatagaattttcctgaaatcaatactcaaaaaagaatatcaaatagaaagagcccccgagcgaatgctcaaagggtgacatgttataatatgtatagtaaattgaaaatgaattaaatttaccgaccaatgttttgtgtatgagcgtcttctctcttaccgacttcgatcagtcagtttgtagagtcatacattctccctagcccccagccttatcgtcggagaatcgttctcagaggataaggctcttggatccttgaccttccttggttgaataagcactgatcctagcccccagccgtgaagttggaaaagtcaatttccgattacacggcttggttaatacgcacggtgagaaattttacccgaccagatcttacatggtcttttgtctctacaggatccgacaaggccttatcggctctgggcgtccccagccgaagatcccttaggttcctcggaggccttgtcaagacggcgtaaagggatagtaggataggtttcaacgctaggtgtcgtcgtggtaagggatctctgggtaaaacacttggcgatattgtgtacctgctatcaactttgttgaagtagaggcagtagtcgtaactcaaccactagaagcaaatgtacgagagatcactacgatcaactggttgagaaccggtgagtaggtatctctcgatcatttggagtcgtggtacgaggaccgctacgctgccggtcgaagaccagtcgtagctgttcctcaaccatctaaagtcgtggtgcgaggaccgctatgctgccgtagtcgtacctcgaccatctgaagttaaggtgcgagagattgctgcgtactggtgcgagaaccaatgagcgagcggatttatctctcgaacaccaatggaagttgcggtgcaagagattgctacgtactggtgcgagaaccagtgtgcaagcagaattatctctcgaacaccaatggaagttgcggtgcaagagattgctacgtactggtgcgagaaccagtgtgcgagcggaattatctctcgaacaccaatggaagttgcgatgcgagagattgctaggtactagtgcgagaaccagtgagcgagcagaattatctctcgaacaccaatggaagttgtggtgcgagagattgctacgtactattgcgagaaccaatgagcgagcagaattatctctcgaacaccaatggaagtgctagagttggtttattgcaagtgtatctcatgtagccagcatgactcacgtacccaacttatagcatatccggatgtccgttcgcaatcatgtcgggtgatcaagccgacgacgttcgcgaggaattatccgttaacaaccttttctcgagtagtccagctatggccggtgctatgaggtaggtcgtcggtcttcgttggtaggttgggtgcgataactccgcatttgtcgagaatgttctcgataatgttgtgtactcgaccacaacctactcaagtgctcaattgttcctaaaaaatattttctagaaggcaagacatatagcagagaatatcgagtatgtactcaaaaaactacatggatcttctagtattatcaggatacaacaagcagatgtaaatatcaagtattatgtaaactgtaaacaagcatgatttatacagaagaaaacagagcgagcccccagcgttagaccgtagttggcctaacatcggaagcactcgcgcaatatatattgtataaaaaacatgctttaggtaaacgtaataaattatagatctgacaatgctgtatggtctgaataggtacgataaattgcatataaaatattgcgtacctgtatagatacatgccggatgtatctacgaatttagtagatcaattaagaaattaatcttactacaataccttagaatttgtaatgtggcctgatgggcaggtgcactgttgggttattgttggggccacatgtacatattcccgtatatatactgatttgcttttgtcttttgtcatcgggatgagcagccaggttgtcgacttggaattgaattccagtgtccgactacggtacaggccaatgaacagatcaatgcggcgctcaactccaggtcctcagagatttgtcggcagatgatgaacacacgagcaggcctgccctcttgggaatcacgcgctgcaagtagtcgtgcgtagtggatgccgatcctgatttgatccggttagaattctggcaacagatgtcaatttcggagatggtcgattggggatgaaatctcgcgatcgacgatcttgtattgatgtcttccgtcgcggcgatgtcttgatagatcgagttactggtgacgaattccgatcttgtcggaagacatgctccgatcgggttagatcttcacagttgaagtcgttgagtagcttgttgttggagaatccatctattgaacccatctcgtcgaaatcctagagcaccaaaatccccctacctggtgcgccactgtcgacgtttgacgtctcgactacggtatttggacagtatggggatcatcggtgctaggatatacgcgagactgaggtaaaagagatggagacagggatttttatacgggttcgggcccctgagttgtcaggtaataatcctacatcttgttggccgaagccagtattgctcttattcaccataatcacaccagtacaatatgtgggtagcctatctgactgttgtcgacatgtcggtctgaaggtctgactcgtagtcgacaacatggtagtcttcctcctcgaatccgtgcccggcgagatcagagatagtgctttcgtatctcctgacggtatccggagacaccgtaggggaatagccatgcctatccctgaagtcgatatccggcggtgtgtcttggcttacgtaggcttgtatgttgtggcttctggtgggcgtgtgttgattgtcatgggtgtcgtccatggtccttctaggggggcttgtatttatacccataggtgtccccttgtccaagtagaactagggaaaccaatacaatccgagtagtccttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacacaagtaattgggatagatcggtcgtcatgccgagacagtataaatcgctcagattgaaacatatactaataacaagactatatgtgtttatagcatagccgatcagatagatctagtgtgtatcggctaatactccgatacaactctatgttaagatgttaaagcaagtaggatataccaaacagaagcttaatatacttaaatacaataatatcttaacataaagggcagatttaacatgtcaactaagcatgtgaagtaaatatagctaaatcagataagatcggctgaaaccccgatactaccctaatcggcaaccaggaggcaggctagagattgtttttctaagcacgacttaatagaacaaacttaactgatgcaacattaagtatgaaaagaataacaatatctagacaatcaagccgctggaagtttcatagagtggtagatatcttatataatctagatcaatgtcgctatttaacctaatcggctgccttctgttagccggttgtaaattaaatgacgatactgtcaaagattagagtatcataaagatggaagcactaatcccaagagcataatccatcataacaagttttacctcttgtagaagatcgaaaacgatgcaggtcaacctgaaagcaagaactcgttgaaataaaactaaagcaaaaaggtggcgatgtgccgaaattatattgaatgtgtgttcttattttacatagggctcggggtctatttatacccgagaattacaagatatgcccataccggacacaactattatctctaacaaacactaagataacataagtctttacggcggacttttgcccaagcatatctataatgaaattacataaaacatcctaatttaatagatacaattgccttctcaggactctatccatgtgcggcaatcatcttgaagtacgtcaattcaacccgatatcatacatcaagttgcattgtcggaatcggctgcatcggcttacctagtccgactcagacccagccgaccctaatcgcagccgatctggactccagccgattcctgctctgtttccgaactcgatctccgcctccgacctttcctcaatctaatcttctttcccaatgccgatattaacaaatttggttgttaacacatgccccccaagtccgggatatttggtaatgttccggatttgccgtgtgccgactccgagcaagtttcgcactccgccgttttctgaccgttattctagcgctttaaatactaatcgttgcccccgaggaacctcacaccgtgacttccgttttcaccgcttaagcgaaactctaccttttctctctccggcgattcctccgacgcaaagcgatctccaggtgatttcacctccggcgagatctccgcccgcagcgatgtcatcctccgccagcccatctgccgcaccatcagccgagtatgctgaggtaagttcccatcggctagatcccctttcttagcagcatatcaattttcttctgtcttaaattgcttttctcttctcagtcgctttggatttgtagcatctctccaacctagtcgcgattcccagtctatcgtacgaaaactactactttctcggcccagttggcaatcccgatcccaccgagttcatcattggtgaaaccaataggatccctttcagattaaccaacctagatctaggtcattggaagaataccttcaaatcctagccatccctcgagaaaacttctcccgagaaaagttggatcacatggtttaagcgcatatcggctagcaagagagttcattgggatgagatcagaatcggccaggcacttgatctcaccatagccaattcagctaaggatgagcccctaatggcagctgcttcctatttttggtccaacaccatcaatgccttcttgttcaaccaagggccgatgaccccaactctcatagaaattgtcatgatcacgggcctggacgtcacctcatcggctaaccctatgagcttgaacataaagaaccaatatgacttcaagaccaagagcataggcggttggtcaggctatgtagcagcatacatgggccagggttcagtcaccccccgagaacatgtggctttcttgttaatgtggttagaaaaatttctcttctgtggatcaagctgtggccctacaaccaactggcaatttgtagccgaagccctagaaacaaaaagacaatttcccttgggcaaaatcctccttggctatctataccaaatgttgatcaatgcatcggccaagatagctgtcggctcaatggttggagcaggcggaccatggtggttgctgcagacttggctaaacctgatagtcatgaaagttgtcaatcggccatctgtgttagaagccgaattcccaagactagagccgattgtagaagatgatgaagaagagcgcactcatcatagatgtatgtcatatggagaatatgcatccgcatcagccgatgctggagcaaaactatcggctgagctactcaaggattggttctgcagctcctatgagggctttcagaaagatgctcgagtctagtttccttatgaagattcggcaagccttgagctcccatcagactttagattcgaagacatcaatcatgaaagataccaatcgtccagggaaattttctcagctgcaatcagcccatgcatccttcctgtcggcattcatcagggaagaaacatccaagcttcttatgaattctatcatccaatgagctcggctagacaacttggaatgggccaactcccaattggcttattctttgctgacaagatcctataccgaggagaaatttcatcaaccttgatgatggatcggctgctcaaccttcaagggcctcctctgggcagtattgaaaatatagaactggcaatgttcagaagcaaaaactttgacagatggtggggtgaatggaagctgtatctattccaccaaccagcctcaatgtatatgacagacctctttccagatgtagtccctcaagtaagtcttaactcacttgatttcatttgaataactgcttagccgattaatcttaactaatcttccttttgatttgtagacaacagaatcctctcctcctcgtcaaagcaacagtggcaaagatatcatatatgccccaggtttaattcctaatggaggtggactatctccccccgttatcggctaccatgcccccaagacttcaactctccttcacggtctaaccagggaaccagccgacacaggccaaaagaggaaaaccagatcatcggccgtgagtaccctggctttagctcccaagaaaaaggccaaattcaagaaaactaagccaactgataagccgattgatgatctgcccgccttggatccaactattgaacaagctttagatgaagaagacattggtgaagatgttgaccaggctgtagccgaaatgagtgacacagaaagaacaccatcggcttcacccaagcaaacgcctccaactccttctgccccgttcattttacaagagtaagtacttctctttgacttctcctgaaattacttccctctttggctaattactcataggctttatggttgcagaaaaagaaaactactgtgaagaaaaatccagcagcaacgattatcaagtcggctccacaagtaagatgtccttaattcttttactaaatcaatctcaaccgactctatataacacttgtctatttcgcagcctcctcctccttcccctcctgtataacaatcgtcaagtgataagactccatcggctgtggggaatcatcacatcgaggaggaagaacaaccagctgctcctgctatcccaataagtttccctttgtctcaacaattagatcggctataatttacccagctcttattctttccaaaattgtctctgcaggttctagccgatctcttctcttttgacatcagagattatcttgatgaagcagaagaagacacctcaagcaaagccttagccccgttatccgatgatgtgaagaaaattctggaagatatttctcattggctagaggcatcactagacaacttggtgaccaactgtggctcaatccgggcaaggttcacagacatccaagctctactcccagatgaactagccgatgcccttactccagccgtttaccttgagcaacaccgattcaagctggagaaggctaggcaaaggttaactgatcaccgggagtgccaaaatattgaagctacaatccagcacaatcagcagcttgtgcacgtagagaaatctaaacttgatcaactatctgaggacctgatcaactcaaatattgatcggcttgaagctcgtaagattgatctcatggcacaactccaagaatggagcacaaaaagctagccgatctcctgcaagctgttgaagaacagaaggcaaggctgaaatcggctatcaagaatgtcgctgatatgaccaagtccttgaaagttatccctggaactgacgctcaagatgcccaagccatagaagaaatagaacagattaggtagaaggctatatcggctatccagcaatacttgtctcgatgactttccatgtaataagccttagaaaatttttgtaatcggctaaaatactttcgatgtttatcctgacaatccgtatgccgattaatcgaacttccaaatttgctcaaaacttcgctaaactgtatctcgtgcatatatatgtgcgcccctaattttacaatgtcaaaagcattgataaaattataaaaacaactaagggcgatataactatatcggccattgtacatcggcaaaccatgaccgattacaccaggaaaaacaactaagggcaatataaccatatcggccatctcaaggcgatgtaaacacatcggctgacatacatcgaaaatactagccgatcatgcgttaacccaaacacttgggtaatatttcttcaaatactttccattgagcgctcgcccatagacttcaccatcaagcccttgcaacatatatgctcccttagacacaaccttataaatttggaacggtccttcccaattcggtgaccacttgccgaatttgttatcccgagttccaatcggcagaatcaatttccatacaagttcaccttccgaaaaagtcttaggcaccactttcttattatagtgccgagcaacccgttccttatctctagtcaccttagcaagagctcgcaaacgtgattgaaccaagtcctccctttcatcggccataaggttataatactcatcggctgtcagaccatcttgtaactctattcggcgtgagccaactctaacttcccatggcaaaacagcttcatgcccataaacaagcttataaggaggaaattggattgatccatgacaagccatccgataagaccacaatgcttcggctaaacgagtatgccattgccgaggataatcagaaattttcctcttaatcaacttgatcaagcttttgttagatgcctcgacctgcccattagcttgtgcataatacggtgaagaattcaacaatttgatacccatgctatcggcaaattgaacaaactcatcggacacaaatattgaaccttgatcagttgcaatagtttgaggaataccaagtcggtagattatatgctcttgaacaaactgtattgcatccccagaatcaactttcctcaaaggaatcgcctccacccatttggtgaaataatcagtcgccaccaatataaacctatgtcctttacttgatggtgggtttatcataccgatcatatcaatcccccaacctctgaatggccatggcttaataataggattcatagccgatgccggcgctctctggatcgctccaaatttctgacagtcttgacagcctttataatatctgaaacaatcctctaacattgtcggccaaaaatatccagcacgtcgaagtagccatttcattttatgagccgattgatgagtaccacatatcccttcatggacttcgccgattgcaaccttggcctcatcggcactcaagcacttaagtaacactccatgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgttggttgttgatcttgccggtgcagatcaaccctattcctgcaagcaaatcgaagaaacaagcaagaacaagataaaggcaatctgatattgcaaataggaatttaatacaaatgataagttggggttccgaagaacaagcagacggacggtctagccgacacgcgcgctgcaagcaagtagcaatggctaaacttcaatctatcaaaacccgagaaaccctaaaggggtaactatctatatataggggtgggaggacgacctaggggtgcctagggtcgtgctccaccagcttggggcgcaccccacatgggccccacctgggccggggtcccaaatgaagttacaagcccataggcccattacaggtgtcacagcaccttgtttcttcaattggtgctgactgagatggaatttgcaatgaggcttgatgcattggaaagagggctccgagagctttccatcaagtactcacgggccgaaaacggaggtcgtatgcagattcggtggccgtttgaagtcagcagtgtagtaggtggccgaatcggattccagcacttggagtacttgatctcgataccttcttgttcatccatgatgtgagcaatggttgcatccgtggtagccatggtcacatcactccatcgatcgttcgataataaagctcatcatccaacagtgtatacttcaatgctttataccttaacttcctaaaagccgattgagatggatcctgtaaataccgataaacatcatatctccaatcatcggctgttatggtagcaacctcaatctgaacatctttgatcatcggcttatatcccgatgctccttgggctaaatcattagcttcaatgttctgttctcgagatacatgctttaaagttactaaccgaaattccttcatcagttcttggcatttctcattatagactatcaatgtatcattcttgcactcatactctcctgccaattgactgattactagcaaagaatcccccatgatctcaatggtatcggcttaaacttccttaagtaattgcaaccctttgagcactgcctcatactcaacttgattattagtcgcataaggtttaaaattataagcaaactcgaaacatgcccccctaggggaaattataactagaccgataccacaaccatgagtacacaccgatccatcaaagaataaagtccatggcacaatcgcaactgagccgattgaatcatcacgatgatcaacaataaaatcggctacagcctgccctttaatcgccttcggtgactcataccgcagatcaaactcagttaaggaaaatatctattttccaacccttcctttcaaaattggagccgataacatgtacttgacaacatcggctttgcatatgatagtacattcattggacaataaataatgccttaaccttgtgcatgaaaagtataaacacaggcataacttctccacaggggaatatctagtctccacatccatgagccaacggcttaaataaaacacaactctttcttttccttcgaactcctgaatcaaaaccgagccgattgacgtctcactggccgacagatataaccaaaaaggtatccccttctgtggaggaatcaaaatgggaggagagctaagatactccttaatattatccaaaaccttctgttgctctgccccccaaataaactgctgatcggcttttaatctcaacaatggtgtaaaaggttctaaccttccagacagattggaaataaatcttctaacaaaatttatcttgccgattatctcttgcagttttgtcttgttttccggaggctgaatcttcttgatcgcattaacactcctttgagtcacctcgatccccctctcatgaacaagaaatcctaaaaactggccagccgatacgccaaaagcacattttgtcagattcatcttcaatccatattttcttgttctctcaaaaaccttcctcaaatcggctatgtgatcttctatttgtttagacataacaaccacatcatcaatgtacacctcgaccaaccagccgattagatcatgataaatataattcatagctctttgatatgtagcgccagcactcttcaagccgaaagtcatcacaacccactcaaacaagccgatcgcaccaggacacctaaaagctgtcttatggatgtcttcttcggccataaagatttgattatatcctgcatttccatccataaaactcaaaattttgtttcctgacgcagcatcaaccagctgatcagccactggcattggatattcgtccttcaatgtagctttattcagatctctaaaatcaatgcataccctcacctttccgttcttcttgatgacaggaactatgctagaaacccattcaacatatcggcaaggacgaataaaaccagcatcatacaatcgcttaatttcagctttgacaggttcgagcatgtcggctttacatctcctcggaggttgctggtgtggtctaacccctggtttgataggtagccgatgttcaacaatcgatcggttgagtccaggcatctcataatactcccaagcgaagcaatctctagactctttcaagagctctatcagcttagttctaaactctggagacaaattcttactaataaatgtcggccttggccgatcgcctggacctatatctatttcttccaaatcatcagccgacatgaaaccttgaccttgcttgtcatcgagatcatctaccgcgtccttggtgtagacatttgaaccctccacaacgccctcaaagtaatagcttgggttctccatcttcaagtggctgtatatcagaagcagatacttttagaaaatctccatcccagactttaccagacaaacaatcaaggccatcgatctcccaaagagctaaatcggcactggcgacattaactgacctgtcggctagcacaatctctatcttgtcgccttgccactgaatcaagcattgatgcatagtctaaggaatacaacaattggcgtgaattcaatcccttccaagcaacaagctgtaagaacccttcccatcgatgacaaaaaacgtagtaggaatagtcttactgccgactgtcagctccacatttagaacacctttagtttccgatggattgccacccaagtctttgagcaccatatttgtcttgatgagatcctcggcatttctacccaacttcctgaacgtagcataaggcatcaaatttaccacagctccaccatcaaccatcatcttagacatcggcttcccattgacgtagccgttcacatacaatggtttaagatgccgattctctatcccctcaggcttttcaaaggctgcctgttctggtgatagaaccaacttagccgactcctcttccacctcatcaacatcagcttggtcgatccgaaattcggctggcaaagtgaaaaccatgttaactgacgccgttacaatacttttcccttttgccaacctttttgcctcatcggttgcaacatcatcggctacaggaatctgactcttaactcgccactcctgccttggttttgctttcttcaaccgatgattaatttcttgctcgacctcctggaaatgttccctactcctcaacctttgaacccttcttttctgattctttgtaaaaatacccgaagggcaccactgattcttcctgattacattgtcctcttggccatgatcgtgattcaccggacccaatctttgatggacagaaactcttgtttgccttagcggattacccctattatatgattggcttgagctctcgacgatgtcactgcacccagggcagttttcaatagatggcagcctcataccttcattccagcagaatttaaagaactcacaaccccaatgaggatcaaaaccatcatcgtattgctcatgatgcttctcctgctgcttgtcatacctcctctgatatttattaataatcttagccgaactcacctgaaaaccccttgcacgggccctgttggctgtttggccagctgtatgcaccatattaacaggaaaaggattaccatccaccttcatcggcctcttagaatcatcgaacttaattttgcctccctcaatggccacccgaatctgttgtctgaaaaccttgcaatcattagtagaatgagatccagaattgtgccatttgcaatatcttttcttgcctaattcctcagcagatggaatcgtatgaccaggagggagttgaatttgcttctctcggagcaataagtcaaagattttatcagccttggttatatatcaaaatcatacctctcctcttttccagaactttttacccattggcatggtatgacctttttacttctcacccattcggctgcagctatttcagaatcgtcctcatcatcatccaacccatacatgtacggacaaacatgattaaccttcttggagcttttcctgacttccgcagacctatgctcgtgcaaagttaccttctgtatcagatgtgacaagctaccaaagtcttcagatgagaatttctccctgatcggagcaatcataccctgaaaggctagatcggctaacagggcatcagtcaaactcaagctgaagcatttattcctcatctccctgaatctctgaatatactcgtgcacaggttcatcataccgctgcttaatcgctgttaagtcagataatttcatcccgtggacccactgtagaaatagctgtggaactgcttctccaaatcggcccaactattgatcgacccatacggcaaagatgaaaaccaagtaaaagccgatccagacaaagataaccgaaacaacctaaccttcatagcgtccacagccgacgcttcaccacattgagctaagaatcggctaatgtgctcataagttgacacaccatcttgtcctgaaaatttagagaagtccggaactttaaactgattgggaagaggaactctctcaaaccactcaggataaggctgctgatacaagcttccagtctctttaggtttaagcccgaactgttccctcattacgtcagcaatcacatcggcccacggtcgttgctgagctgctccctgtgcctgttgttggatgggctcgaactgaccatactgagaagcaaactgaggttgagttggccccctgaggctgatattgataattcaagttgcccccttggtaattatgacggttcggctggatgttacgtactaagtgctcaggaacgacttgaggcattactgtgccatccggccgtacgtggtgaaccaagtgttctgggacaacttgatttaaaaattgttgtacaggctgaccgctaggcgttgcaaacccggccaatgcgcttattgaaccttggtgctgaatcggctgaatgacttgctgtcttaacggcgtctgccgaatcggctgcagaggctgctgccttggtgctgtttgctgagctggttgcatgacctgttgctgaatcggttgtacaacctgttgaattgggggtgtctgctgacttggctgctgctgtattggatcaacaataggttgaggtggtagaaacatggcagcaaccagatcttgggtcagccgattcacaacctgcctaatatgctgtggctgctctctcgtcaacaaccgaggattcaccggctagcctggcgtcatcgctgacaacgcaggtaggggagttgatgctggcgccgtcggctgagctattggtgtaactaaggaaccgcctgaatggatggctaaacatcagtgatcaaggaccgataatttggaaagacacctccttgcaaataaactgggcttgcagcctgatgctcagctactgaaccattggctattgacttcatcatgtctgataaggtattgactaacaccctagactgattgatcagagcatgatgtacggcgtagtcaacccggtcttggaaattgttgaaaaaatcttgtgccacatcactattctgattaagatctcctccctgtaatccttgagcaccatcaccttgatttcctagagatccgtcggtagcgcctttgtcactcggttgagctgagccgtctggagtttgcttcccatctccatccttagaagaatcggttccaggatcatcagcaaccacttttaatttttacttctgaacaaatgttctcttgcgagtctgcataaacgaattcaggaactgatctcgtgcttgctgcatcattgcctcaaaatctttcttttgctcaggagtgaacttttctggatcaataggcacgacgtttgcctcatggacgttgatcaatcctaacttctggatcttttctttgatagtgcccgggctagccgaggatggtgacagtggtggtttctcaaccatgaggaagaattgcttgctgacttcttacttgtcccactgggcatgccaatagcgtgttgacagaaaacacgaggcctgggagatctgcttaactccagtgcaggtccaaagctcgccttcagatgtatgggcgtgccagttgatttgatcttgcaatcaacaagagatagaaacaaaggaaccgcaattaaatctgtaaatgatagccgatcggctagatgccgatgacatatcatttatctttgagccgatgtcgtatgtgaatcgatcggcggttgtaaataaacaataaagaactagatctattcgatcggctgtagatattaacgatatatagttcttatatcgatatatgcttaaatcaagtaattgggatagatcagtcgtcatgccgagacagtataaatcgctcagattgaaacatatactaataacaagactatatgtgtttatagcatagccgatcagatagatctagtgtgtatcggctaatactccgatacaactctatgttaagatgttaaagcaagtaggatataccaaacagaagcttaatatatttaaatgcaataatatcttaacataaagggcagatttaacatgtcaactaagcatgtgtagtaaatatagctaaatcagataagatcggctgaaaccccgatactaccctaatcggcaaccaggaggcaggctagagattgattttctaagcgcgacttaatagatcaaacttaactgatgcagcattaagtatgaaaagaataacaatatctagacaatcaagccgctggaagtttcatagagtggtagatatcttatataatctagatcaacatcgctatttaacctaatcggctaccttttgttagccagttgtaaattaaatgacgatactgtcgaagattagagtatcataaagatggaagcactaatcccgagaacataatccatcataacaagttttacctcttgctgaagatcgaaaacgatgcaggtcaacccgaaagcaagaactcgttgaaataaaactaaagcaaaaaggtggcgatgcgccgaaattatattgaatgtgtgttcttattttacatagggctcggggtctatttttacccgagaattacaagatatgcccataccggacatgactattatctctaacaaactctaagataccataagtctttacggcagacttttgtccaagcatatctctaatgaaattacataaaacatcctaatttaatagatacaattgccttctccggactctatccatgtgtggcaatcatcttgaagcacctcaattcaacccgatgccatacctcaagttgcattgtcagaatcggctgcatcggcttacctagtccgactcagacccagccgaccctaatcgcagccgatctggactccagccgattcctgctttgtttccgaactcgatctccacctccgacctttcctcaatctagtcttctttcccaatgccgatattaccaaatttagttgttaacagccgagccaagccgagccggccggccgtggcgagggccaggcgtgcgtgcgtgcgttgcgttgcgcatgtctctatccttttgcaacggatcagaatccaaccctgagattgcctccgtaatgggcaggcgattcaatacccattgatcgcgttgttactgcggcaacgggcggatctctctcctgcgccataaggaaagggggaatccgatcagatccgctcggttactttccaaacactggtgttcttccgagggcctccagaaccataccttcgcctgagatctgcactgggtaggcgggtgatcaggtttttggggagtgcttccgcacgactgctcctcgtcttctgttcgtcgtcgaccgtacatttgcatcaccatgtctgccgcacctgcacctggaggtggcgcaccgggagccggagctggcgcaccgggagctggtgcacagaacgacaacaccaacggaggcagttctgcctcacaatccagcggaggaactttcacagggtataatcctctactgttatttcagtttttgatatttctgttagtcgcactataattgcgttctatgtatgatgatgatgatgcttattctaccttaagcatgctcctgtttatgtttaattttatcactggatcacctcacattgttcatgtcatgattatgtcttaatattttggattaaaatatgccgatatttgactatatttccaacaacttgttcgtccttgtagatgcgattgtctatttcctgatttgaatagaaagttccaacttattgtatgaatttcccatagagttagcattggtttgaagttgttgtatagcacctgggttatgcatgattaaaaatattattaagtgaatgatcacgcaactaactgaaacattgtccatgtagtatcaatagttaatatagagcaggtagaagcaggagatgccaagtcaaatatatagaagctagtcttatccatatcttatttctcttcaccaaccacactcagtagctaccatgggtgatttttttgcgaggacacgatgagtgaaatttttagctagaagaattctttgataaaatgactattgactagttataccgagaccttgagccaatcatagaaactgagacgtaatatattttatccctacacaaaaagatgtactagaacacaatctatatactaacatttatgcatcacactgctaataatttcactgtcttctgtaataataataataatctatactaatagcagtggtgattgttctatcacaccacctccaccaacttgataaatgggcccctttaatcagccccacgctcccacaagttcttttccatttcactgttgactttccccaaaattcgaccaataatttattttttttgaaaaccagtacggtggacaagatctgaataatgcacaattcgagtcaggttattaagtaccatgaggaaaacatcgtaaagtactacttggactaactatgtttttaatcaagttaaataagctagaaactcatttttgttttgttgcaatgcacgggcttttggctaagaacaacaatgatgatgacgatgacgacaacgtagattttaagccatggagagtatatgtcgtggtttattcttgcatatggttcaaataggagtataaaaaaatagtaagaaaaaaatgataatggaactgaaatatagagataataattccaatagtttaccaatttgcaagaccaaattaaatgcaaaaaacacatcagattaatatcgttgaattaaaagagatagcaagtgtcacaaacctagctcagattttgcaaggcggacgtagagctcctggccaccgtcgacgaaccccgtgtccatcaagtcgccgaaccactgtatgcacccgctcccgccgccgcggatgtcggcgccggcgtacgccgtgcaggagcagttggacaggcacctccagcggcacccctcatgagtcaccgtggcatccacggcgcagccgtgcgtctccggcagcttcacgccgcgtaggaggtagaacccgtcctcgcctccacctccgctgctgccagtgcactgcagcggcgtcctctggccgcacccgccggacgtgttccgcatgtaccactccgccggcgagcgcggtgtgaagcccctgatgcagccgcagacggtggcgtcgacgacgttgcagacgccgaacgcgccgcacctgccgtagttgtcgcactggtccctcggccccgaccagaagttactccacgacatcgccgaccggtcccagaccatgcgttgcatgacgccggattcgttgaggagcacccatgacatcggcgagccgtcaaggttgcggaactggtaggagacctcgccgccggtggcgaccctgaactcgaactcgaacatgtcctcgaaggtcgtcatccacgggcccgtccggtacgtcttccggcctcggctccacacgtgcagctcaggtgagccgctcgtgtccgtactggaagtcactgggcgacgggtctttggcgccgcgccacgacgagagcgaccactcggcgccggtccggaggtccttcccgacgcgtatcccggggaggaacgtgtttgtctggtgctcgaagctctgccacagcacgttgccgtccttgtccgtgagcaccaggttgccggtgtcgaaaagtgtggagattatggataccccatatctacatggcggtcatattccagctgggtacgggataccgaataaagatagaataccttcatgaggactcggattagattctaaacttgtatgtcatgggaatacccgagatcctagtcggttacgattgtattttatctgtaattacatattccgttagggatatggactgtacttggtaaagcggactccgtcccctatataaggagggtccgtgtgcctctcggggcacggtttttgtttccagtttatacaatcaataacacactcggcggaatcatccccggacaggagtagggtattacttcttgaataagaaggcctgaacctgtataaaaattccttgtctcgaaacccatccgctttcctagcttgatagccacccccttttattattgccgaaatcttgtttcgacagttggcgcgccaggtaggggtagcgtcaagtttttgccgactaagtgcgatgggttctgtctccggcatcgacgacttcgccttccctcccgggcaggcgttccggttcggcagcctcaacttcatctccaacgacttcggcaaaatatctctccttgactcggattcgaaccagtcggggagagatcaggtcccagcgccgttcggtatcccgaactcggtcgaggcctactccaagatcatctctcccgagtcggcttcaaaccactcggacgagatccaatctactcctcctgcgcgaccagatcaagacgacggatcctatccctcaatcctgatgaaacttcctgatgatttggccgctgtcttcacagccgagacatctcaaactcgaagatctaggcgagctccggcttcggccccgatccaatctagatccagggaggttggcattatactccaacctcttgggacagtctcgacggaagagttggatagctacctccgctcccccggcgtcagttctcgaccaaccgagatcctcgactacgacgatttcggctaccactacgaccacggcgacctcgacaacttcgacgacagctatgaggataactatacgcccctcttcttcggtgtattcatggctgacaacgaaacggaggaacagcgccgagcccgagaagcggacctagatcgcgcacggcaagaagctgaacgtcgccgactggaggaagagcgacaggacaggagcgagaacgactacagcatgagcaacaagattgcgaacggattgcaaaggaggctgaagatcgacggcaacacgccttggaatctgggcggcgagcaagagagctcattgggcaacaagacatcaatggaacagcggtctttcgcaccccccagcagaacgcagttgcagcaatcactctccttgacaccctcctcaaggaagacgcactcaaccaaactgatcatgttgtcaacatcttgaaccagacgaagaccatgatcgctgcctcggttccagccaactccgcaagcacccgcaccccgactggtagccgagtccctcaccttcgatctcaggactatcaccagccaagcctaagcattgccggcgccggttctagtcgcaggagcaggggacatgatgaacggtctgttcgttcgcctcccgaacgatatagggagcgtcgagttgaacgaccgcactccccacatctaaggcgccccatcgatcttcgcgacaccatcaaccagcgccgcgtagcaagaggccatcattcaccggatcgctacgacgacgatatggacggagttgctaccttcacaagcgatctgcgtcgagtggattggccagccggctttaagccgactggaatcgagaaatatgacgggaccaccaacccttagtcttggctcaccgtctatggtctcacaatccgcgcagcaggaggagacagcaaagccatggcgaactatctgcccgtggccttggcagattctgcccggtcctggcttcacgggctaccccgcggcacaatcggatcatgggcagaactacgcgaccacttcatcgccaacttccaaggcacttttgaacggcctggtacatacttcgatctctataacatcgttcagaagtctggagaatcccttcgagattacatccgacgcttctccgagcaacgcaacaagatctccgacatcaccgacgatgtcatcatcgccgcctttactaaaggcattcgccacgaggacctagttggcaagttcgggcgcaaacctcccaagacggttaagcagatgtttgaaaaagccaacgagtatggcaaagccgaagatgctattactgcgtccaagcagtcggggaccacttggaagccaaagaaggatatgccggccgcaggagggagtggaagtaacaaccacaaggatcacaagcgtaagcccgaagagcttgtggcaacaacctctccatcttcccgacaacgttcccacgtcaacaccttcgacaagataatgaactcccaatgtccgcatcatcccaactccaaccacgtggccaaagattgcttcgtctacaaatagtttgcggagcaatacgtcaagaacgcgcgtaagccttcagacggagatcaaggcacatcaaagaagaaagatgatgaagacgatgccccgactggttttcaagatcatcgcaaagaactcaaccacatcttcggcggacccctggcttatgaatctaagagaaagcagaagctaactgaacgggagatcaatgcggttcagcccaacacaccccaataccttcggtggtcagagatagcaattaagttcgaccgctcggatcatcccgaccgagtggtccacccggggcggtaccccctgatactagacccagtggttcgcaatgtcaagctccgacggactctcatcgatggtggcagtgcactcaacatccttttcgctaagaccctggacgatatgcagattcctcgcacggaattaaagccgagtaatgcacccttccacggtgttatcccaggtttatcagctacaccagtcggccagatcactcttccggttacttttggcactcgggagaattttcgcacagaaaacgtttgtttcgaagttgctgatttcgaaacagcatatcatgctatactcggacgaccaaccctagccaaattcatggctgtcccccactacacctacatgatgatgaagatgcctggtcctcgaggagtcatatccctacggagcgacatcaagcaagccgtcacatgtgataaagaaagttgcgagatggcccagacccgcgagatcacactcgaccaagaagagatccgactagcggtgaccatggcaagcgaaggagaactgcccgcaaccaagatgcccaaaagcggagaaagcgatgccaagaccaaaaagattcctttagatccctctgatcctaacaagactgctgtaataggtgctgagttagattgtaaataggaaagcgcgctcatcacctttcttcagaataataaagatatttttgcgtggaaaccatccgacatgcctggtattcctagagaggtgattgagcactctttacacgttaaggaagacgccaaacccatcaagcaacgactccgccgttttgcacaggacaggaaggatgcgatcaaggaagaactaaccaagctgttagcagcaggcttcatcaaagaggtcctccatcccgactggctggctaacccagtcttggttcggaagaagaccggacagtggcgcatgtgtgttgattacaccgacctcaacaagtcttgtcccaaagatccttttgggttacctcgcattgaccaggtggttgactcaacagccggctgcgagttactcaatttcttggactgctacttgggatatcatcagatccgactaaaagaatccgactgcttgaagacctcgtttattatgccctttggggcctactgctacatcaccatgccctttggattgaaaagcgcaggagcaacctatcaacgcatgattcaaagatgtttttcaactcagatcggccgcaatgttgaagcttatgttgatgatgtagtcgtcaagatcaagcagaaggatgacctgatcacggacttagaagaaacttttgcaagcattcatgctttcaggatgaaactaaaccctgaaaagtgcatcttcggagtaccgtcagggaagttgctcggatttatggtatctcaaagaggcatacaggccaacccggagaaaatcaatgccatcctcaacatgaaaccgccaagctcccaaaaagacgtccaaaagctgactggttgcatggcagcacccagccggttcgtctcacgaaccggcgagtgggggatgccctttttcaagctgctgaagaagactgacaatttccagtggggacccgaagcacaaaaagcctttgaagacttgaagaaacttctcactactccaccagttttggcctcgccacatccacaagagccgctactgttatatgtgtcggcaacctcccaggttgtgagcacggtcctggttgtcgagcgtgaagaggaaggccatattcaaaaagttcaacctcccaggttgtgagcacggtcctggttgtgagcacggtcctggttgtcgagcgtgacggaccaatttatttcgttagcgaggttttggccgattccaagacaagatatcctcaggttcaaaagttattatatggtgtcttaattaccgtcaggaaattatctcactactttcaaagtcactcggtcacggtggtcacatcgtttccactcggggatatacttcataaccgcgaagcaaacggacggattgcgatgtgggccttagaattgatgtctttggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggagctggggtcgtattaatttccccgaccggagaaagattgagctacgtattgtggatacatttttctgcgtcccacaacgtggcggaatacgaggcgctactccatggattaaggattgcaatctctctaggcattcgccgactctcagttggttgttatcaagtcatgaaagagttgtcttgtctagatgataatatggctgcttatcgacaagaggtacgcaagttggaagataaattcgatggactcgagctcacccacgtcatccgacataataatgaggcagcggacagactggccaattttggttctaaacgggaagtagctccttcagatgtgttcgtcgaacatctttacgaaccaaccgtgcccagaaaagaaacaattgaagccatggatactcaaggcgtaagcatgatcgaagccgactagagagaacctttcataagatttttgaccaaacaagaactccctcaagacaaaaatgaagccgagcggatttccaggcgtagcagactttacattattcatgagactgagctgtacaagaaaagtccatcaggaatactgcagcgctgtgtgtctttggaagaagggagacaattgttgaaggatatacattctggtatttgtggtaatcatgctgctgtacagaccattgtcggcaaagcttaccggcaaggttttttctggcctacagctgtgtctgatgctgacaagattgtgcggacatgcgaaggttgtcaattttttgccagacaaattcaactgccagcccaagagttgcaaaccatcccgttgtcctggtcgtttgcggtctgggggcttgacatggtcggcccgtttaaaagggcagtcggtggttacacgcatctctttgtggctatcaacaaattctccaagtggattgaggctaaaccggtcatcacgatcacagcagataaagctagaaattttttcatcagcattgtgcatcggtttagggtacctaatcggatcatcactgataatggcactcaattcactagcggagcatttaaagacttttgtgaagactttggcattaaagtttgttatgcctccgtggcacaccccatgagtacgtggcacaccccatgagtaacggacaagttgagcgcgccaatggcatggtacttcaagggataaaagcacgagttttcgaccgactacgtccctatgctggcaagtgggtagatcagctgccgtctgtactttggtctttacacactactcccagtcgggctaccggccagtcgccgttctttttggtttatggtgcagaagcaatgttgccaagtgaagtggaatttgaatcactacgatttcggaacttcaacgaggagcgctacgaagagggccgagtagacgacatcaatcgactagaggaagcccgtgaagcagctttaattcagtcgactcggtatttgcaagggttgcgccgttatcataatcggaatgttcgatcgcgagcctttttagtcggcgacctggttctgaggaaaattcaaaccacacaggatcggcataaattatctcccttatgggaaggaccgttcataattgctgaagtcactcggccagggttcttatcgactcaagcgcgaagatggtactcttatcaacaattcttagaatattgaacaccttcgtcgattttatgcttaggcatttcgtttgtatctttcctctttgactgctaacttcaagtttttccttgaagttttcagtcggggggctactatgataataatggagtgtgatttttatcaattcaatttgcctacttgatttatcattgccctgtttggtctttcgacttagtcaatgaggactgaaggtttttaatagcttttgcgggttttaggctcaataaggcttgacaaaggcttttaagaaatcagaagctaagtatggaacaccaagcatagcataaattcatcagtattgtacaaattgagcctccatcatcattaatcatcaaaatcattgttatatcaatcagtatcagttttttcatcatcagaattatcagacccagtcagccgaaggtcgacatcttggaatctctcaaccacgtcagcagcaatcttgtcagcggctttttgcgcatcattgatgagatcaagagcagcttcttcgctcgtcccgtctgcaaagccatcaatggcatcaatgtcaactcttggataaagggatttggttatcgccaacgccagacttgctcccatacttccagcctctttgatgttcttgaagtaagtatccggagcgactctcagcttgtcgaagatttcggcagcatcaagtgtactcggatcggcgttattgaagaacatggcttggatgattggagtagcggcattagcgactttgtccctagccccttcaagcctattgatcttgtcaactaagacatcaaactgtgcctgggacttgatcttgcggtctgcattaacagattcacattaatgaatcagcatatagaagataatggcttttgaggtattgattattggtaccttcaacatcctttaaagctgagtccctctgtctttccagttctgccttgtcattttccagagtttgaatctgcttctccagttgagatatcttggcagcttgcactacattgactctggttaatcaagattacaaagataacaacataagttagttgggcagagtttgtgcgtaccttttgatgagccgctcagttcaaaattggattcctggagctcagcaatccgatccctcatatcatgttcattcttcctggcaagttcttttgtctcgtgcagttgattcctagtggcttcgagggtcccaagatgagggactaacctctctaaggttgccattttagcttcgttcctaagatgaatcctctgcaagacagtttaattagcgctcggactaaatggcaaacgagatggttgagatcaggcgccaaagagcttacatttacaatgcgggttgcctgaccaagcgcctttctcagtaggcataactcttcatcctctttttgcttatttattacgatcccttgaggctgcatgttgtcatcccaccacttgaccagaatgggagggcgcgaatcctcagctgctcgtatccggagaatttcttcttcaacaccaatcattggtcctaatgtatccactgacaaaggttagacaattgatcagattcatttggatcaacacgatttcaggcaaggtgtttacctgtgatgatttccggacggggacgagtcgactcttgcgccttaatgggagaccctggcatcgggacgttgctggcgtcttgtctaggagggctgtctgaccaagctccaacttctggaatctcttggcttggcctagagtccgactggttttcggtcgggggctcctgattaactccgtccacagcttcggccgactcattctcagtcaggggttgatcaccagatcctacattatcggttgctggctggctgtcactcggctgatcctcgttagttggctcgattccttttaagttcgtttccctgctagtcgggttagagtcttttccagaaggatctatatcagatggtttcctgcaagtttggtttgtcagtattttttctgcactgggtgcacgtcaatgcaagggagatcgttatatgatttgtacctggaagacttcctgatctttggcacaggacgactggtggttttcttccttggagtagcctgctttggcagtttcttggttgcctctcggtccccaggctttctagcagtatcgctttcgtcgtcactcgacaccaacttccttttgcgtgaatctggctggccggctggattggaagtatttggccgggcttcagaatggatcttgggacccccgctcccttggccggtttggcagtggggtgattggcattgaatgactgggggggtccgatttcatcaaagaaaattcctaggcatgatatccttcattgttaattgattcaacaaaaagacaagactatattttgtgaaaagttgaaatgtttgattacataccggtggaggaggattgaaagcattgaatggcacgactggcagcaagtgcgaatagctgacgacgatagcattcgagaagatcttgtacatcctttccttcataaccttaaagttaagagagtctggatcttcatgatttggatcatgtttgccgtcaaactcaaaagctgtgcgggacctctctttgattggagctaaccggatttttatgaagtgccgagtgatctgttctgcctgcaaaccttgctcttttagctttatcatcctctccatcagttccactgcttgcgcagcttcatctcccattggcagtgagttccaagtatcccgataaacgggaggaagacaggagtattcggggagagcaggctcaggattttggacatagaaccaatttgcgtgccaacctttgtttgaggtcttaaagggcatggagaagtatttttgacttagtgttccccgaagttggaaaccagcgcctccaacaacacatggtttgctcttgtttggctgaggcttaaggaagaagatgcggcggaacaaggcaaaatgaggcctaatgcccagaaaagcttcgcaggcatgaataaaattggcaatatgcactatggagtttgggttcagatgatgcaggctgattccatagaaattcacaattccccgaaaaaatcttgaggttggaagggagaaaccgccatagaagaaatgagcaaataccacgatttcatgagtatcgggggttgggaatgcttcaccgaatgctggtcgccacccgacgatctccttcgctggaagaacgccgtgcgccaccatctccttcagattatcttccgtcacatcggagggcgcccactgactctcgaagctttctctttcttccgccatgaatgtgagttggatggtttgatttggtccgagatacggctggaaagggatggggaatcggagcggtggatgtggggagaaattttgtgaagtttttgaggatggattggagcggattgatgaaccctagtttggccggcgcagttttgtactgtagcagagaatggggataatggcgagagtctcggcggggaagacgaagagacgttttatttcacttcggtgcttttagggtatcgggagtgctaacaggcctgggcctgcacagtacttcagcccaattttatttccagcatggcccgttgtgatccttagggacttaggcactttttgctttggcaatttgtcctatatttctattaaggcttatgtggaactcatggtaggaaataagaatgacatacttgtataaaaaattttgtaaaaccagggagtagatccaagaaggatactaatcaaaccaccatgatcaagtttatgcacatgtgtgtggaaaagaatacataggtggatgatgggaaaatggaagaatatgactcatttttggtatgatcctcctccttatactttatttggagaacatggctattttctatattatcttattcatcatgctcaagaatatttttttttgtttccttcttttttgaacattatgattttctaaaatcatttctttttttaactcatgtctcatttggcatggatagaggatggagaatcatagtcatgtgaagtctttatttggtggatggatgatagtggatgctgacttccggagtagaagtatagcatatgatggtggataaaaatgtttagctaaacattcagtgtacagggagagcaatatatggtggatgtgcacaagatcttgatgatgagaacatgaaagaaaaaaaaatctaataagggtctaaaccatttgacaaaacatagaatgatacaagcagcatatgtataaggtttatcatgaagatcaacatatggttttggtaggaataaaacattaatgatgagtaggcaaagttatactttttttaatataatttccaagaattaaatagaaaaaagcaagggtcatattgtcaggcaatcattcatttaccaattgcttagatgacatgtcttcctaatgatatatttcacaagcacaaggtatcatacgagaaataaggagaatccaagacatttgcatgcaagtcatatattctaaaaacattgaagcttattttaaaagttgaatttatttttcagattttcatgataagaattattaaactcaaactttagggagatgagaggataaacatgcaaaatttatcaacataatacctaaataaggttaaactagctagagcaaccgcgacaagtgggaaaatttaaaacttttccttgccattctaaaataaaataaaactataaggtgagagcttgcatttgcccatttgcatgactgttttgctgcgattgagtcttttatgtgtttttcgatcttaaacacatttcataataggattcatacgcatcgtattaacttgaaccaaaattattagaatagagaaccttatatataaatattgagaatcgcttcttaaaattttatacaactcacaaaatttcacatttcatcctaacctagtgttggtatttcttaacgacattactagaaatatttaatcctagcaatggcgtagaaatagttctggtataattatggttatagaagtaatctgcaagcgcacggatataccattgtagtatttcacccggaagtattccaaggtatcgtatttatttagtcgcaagtgaagattgtgaaagagagaccatgctaatatatacatatatatatatatatatatatatatatatatatatatatatatatatatattacttgcgttcgtggcagaaaatcacttcgtgattcacgcggcgaacttttctcaattagtgccaatattggaatatattggcacacattagtgcgatgtttttgaccggaatgaaaaagttcaaaaagcaccaaaacatgatttttggacatattggagtgtattgggtgtgttcgtggcaaaaaatcacttcgtgattcatgcggcgaacttttgtcaattaatgccaatattggaatatattgccacacatgggtgcaatgtttttgaccggaatgaaaaagttcaaaaagcaccaaagcatgatttttggatatattggagtgtattgggtgcgttcgtggcaaaaaatcactccgtgattcacgcggcgaactttcgtcatttaatgccaatattggcatatagtggaatagatgggtgcgatgtttttgaccggaatgaaaaagttcaaaaagcaccaaaacatgatttttagacatattggagtgtattgggtgcgttcgtggcaaaaaatcacttcgtgatttgcgcggcgaacttttgtcaattaatgccaatattggcacacatgggtacaatgtttttgaccggaatgaaaaagatcaaaaagcaccaaagcatgatttttagacatattggagtgtattggatgcgttcttggcaaaaaatcacttcgtgattcgcgcggctaacttttgtcaattaatgccaatattggcatatagtggcatacatgggtgcgatgtttttgaccagaatgaaaaagttcaaaaaacaccaaaacgtgatttttggacatattggagtgtattgggtgcgttcatggcaaaaaatgacttcgtgattagcgcgacgaacttttctcaagtaatgccaatattagaac

SEQ ID NO: 58147 - DNA, 12861 bp, Oryza sativa
acgcagatctgctataggcgcacttttttggaagaattagagctcaagaatgttaattcacttgaagggcagattcaatcgacctcgctgaagcgcttgtctatcatcaactgccttatctctgatggatttttggttgatgctccgaaccttatctcgctctgcttcttcagacctctcagcggtaagagcacggagggagccaatcactcgtctgataataggagttggccattctcagcgtcagtgtgggagtttgatgacgatggatctgatcatgatgatgatttctttgcaattgctagtggtggtgaacactttgatgataagagagacaatgaatctgatcaagacaatggttctagtgatgaagactcagatgataagagagaccaagaatctgatcatgatgaagatgttccctcttccccatattctgattctaaggactcctgtgatggcagtgacagtgaatgcgagtcttatgaatccagtgataaggagggtgatgatcttgaagattgcgacagcaatgatatgttggaaaacttgatcaaggtagctaggggcttgacagcttatcatggagaggtaagtttaatcgccttgctgatactatttcgttattttatttgtatgcttttttccctgcagtactgcacgcattgctttttctcaattctttgcaagaagatttccattgtatgggaaacgaactaattgccagtgtaataacagaattgtcttcataaactaaatgtgtagaaggaagttttgtcagttctgctggtgatgagattcccaaattagtatagctatctcagttaatagtgctagtattgctgatgttagagtactgccactcaaacaaatgaaaatactactgttgtagcttgctgagggcaacattaagaagttccttactaattgatcagccaaatgaatggcaacattaggtactacggcaagttcttatgtccgtacctgatctactagtgtgcaagtattcaataacttttctctatggtgttgaactttgattatatcttatagttgacttcttgttgtgccttaattagaactctcaattagcatcttttttttatttgtcgaattctccatttgccttggccagaagaaattatttattttgtcatataagaccaagctagcacattagtttctcttttttagataatggaagtacaactcagcacatagttactacagcattacaataccaatatctcacaaatatttcacaattgacttgagagaaaccttgggttcttctcataccaggagaacaattaggtttccattctagaacatttgttggtagtgcgacatgtgtactaactgattgctaaaagtgccagtaactttctaggcataggttggtattcccctgatgattgcaaacctgtgatttttttcctctaatctggtcttcatgtaccacttctgattttatggcacatattgtagattcgtagtagtgctctggtaggagaaatgttttgggccactgaatcacttgatatgtatggaaatgtgcaggtgcttctgaggaggcaattggaaaatttccccatgttcaataacctgaaaactctgtcccttggtgaatggtgtatggttcctgacttcagtgctttgtcaaccatacttaagaaatcacctaaggtagaaaggctttatcttcaccttgacatggtacgtgtactcatatgcttgttaaatgtttgcttagagtgtttaagcatgttattaatcccttaaaccattgttttacaaaagatccacagaggaagaggggacatcgatccaagtggaggatcatttgcttgcaacaacctgaggaaggttaagatcacatgttgtaaagatgatgaaatggtccatatgctgaaacaattcctccaacgtaacggcatatcacttgagaagattgttcatcacacttctagcactcataatggcgaagaagacggaggcggggactccagtgcgaaacggaaggcgcaaggcgaagttgcgaggctagcagtgaaacagaggagggcgcgaaacagtagaagcccggagtgaggggaacatgtttaaaatgctgaggaatccagtgctgagtttacattgcagttagcagtagaattcttcacaggatgtgtatatgcatcaaatctagtacaggtactttggggacatgaaaaattatgcatccgttggtgttgcatgaaaatagatcgttggtcaatgttcagtgacttggaatcctgtgaattgctatatgcctatatcatgtttgatgtattgagtagtaattggcagcggctacatttggatttgtgattccacgattgtctggccttaatctcgtcatggtgtcgatgtttgcaactatgttcatactcccctaaaaaaagagagaaaatatgcccttactctagccaaattaccatgtcttttcaagcatgtctatgggaacattatagcatagctggtgtttgagtgatcgtgtaattcgcacgtaattaccgaagaaaggagtacgcacagtatatatttctatccaggacagtattcgaaagtaagagccccattggttgtcctaataaaccaaaaccaaagtcaaaatttgaattttcaaatttaaatttgaagttgattttaagatattttcaacgtggtagtttcttttttaggattggcttttaagtcgctaaaacacatatataaagttttatgtataaattattttttatttactaataaaccgttttgacttaataggaaatatggtcaaccgatgaggacctaaccactgttggaattgtattggctgatagatacataccatttctaactgaaaaaaaaatacattttactcctactaactatttcgtcatcgcacgaaaccccctaaattatttttcagcttattttacaccctcaactattaaaaacggttcactgaattcactttagttcataaatggtatttatcttttcttctctctatatataagttgtatttcacactaaaatacaaatatatactctcttactgctattactattatatttgtgtaatgaataatcgaaattagttgccacaaaaaatttacccctgtaaaatccaaaacaaatttttttcagactataaacatgtttaaaggtaaatactgtagtagtagtagtacaaaaaatgaaatcggaaatttccagaatcgacattcttttttttccactggaggaaaattaaacaaacaaatacgtatcccctatatatattgggcatttttggtagttccttccccctcgtctcccgaagcgcgaagccgttctatcggaactcgaaagcagcgagagctcttggcgcggcccatcgatttcgccaagaaatccccaatctctccgtgagttcttctcctcctcccctcgatcgcgtgctccgatgtgtttcttgcgattctcggtggttttccgctcgtcgtagctgagcagaaacgttcgttgtgggttcttttgattcggggagtcgacgtgtccattgcaggcaacctgttcgacggaatgcatcagggagcggcgcggcaggcggggcagtccggcggtggcggtggcggtggcggtggcgcggaccgcctgagcgcgctcccggacgcggcgctcttccggatcgtgtcgcacctgacggcgcggcaggcggtgcgcacgagcgtgctctccaagcggtggcgccacgtgtgggcttccgtgccgcgcgtcgacatccgccacccctgcgcctgcgacgagcgcgccgaccaggagaggttcggcgacttcgtcaccaccatgctcctcaaccgccgcccatttgcgcccatcaaggcgctccggctgtggtggagccacgatggcgacgccgagacgtggatcgctcatgctgtcaggcgtggggccgaagaaatcgatttctccgcgaggcatcaccaagatgatccgaagccggagctagagtacacaagcttcatttctcccaagatcaagatcttgaagctgacgactttcgggatggacatcaaggccatcacgcatatctgttctaggtgcacttctctggaagagttagagctcaaggattttcgacgacttgatggacagattcgatcggcctcgctgaagcagttgtctatcatcaactgctttatctctgttgcctttttggttgatgctccgaaccttatctcgctctgcttcatcagacctctcagctttgagagaaccaaggaatccatttgctcgtctgataatcgtaggtggccatccccagtatggaaggatgacaacgatggatttgatcatggtgatatctttgcaattgctagtggcgaacactttgatgataagagagagaatgaatctgatcaagactatggttttgatgatggctctgatgataacatagccagtgaatctgatcatgatgatgatggtcccccttccccatattctgtttcctacgatggtgacaatgaatgcgagtcttatgaacccggcaataaggaggagtctgatcgtacagtggcctatggtgagattgcagatgagtactccagtaatggtgatcccggtgatgaatatcggggaaattatgtgaaccatgattctgcgaattacggtagagctaataagtttggaaatttgaacttcccagtgaagtcaattgtggatgcgtcagctcatgaaggagaggtaatatttaatcaccttgctgatactatcgtgttctcaattttgtatgctttttctaaacttctttgcaacaaaatttgcagtatggaagaggaactagttaccggtgtaataacagaaatgtcttcataaacttaatgtgtagaagagtgttttgtcagttctgttgatgacattctcaaatcagtatggctagctcagttacaaagagtactagtattgctgaagttatagtattgccactcaaagaaatgaaaatgctaccgttgtagcttgctgatgacaatattaagaagttccttactaattgagcagccaaatgaattggtgtcacccagatgacattgtatatctgttaggtactaccgcaagttatcatgttcctacctgatctactagtgtgcaagtattcaatcaccttctctttatggtgttgaactttgaatattatcttatggtcgacttgttactgtgccttaactagaactctcaattagcattttttttttacttttacctgtcgatttttctgtttgccttggccagaagaagtttcttttatcatataagaccatgctagcacattagttactcgtttctagataatggaagtacaactcagcacttcagcgtagtcactaccaatatctcacaaatatttcacattgacttgagagaaaccttggattcatttcataagtcataacaggagaaatttaggttgccgttctagaacatttgttgctagtgcaacatgtttactaactgactgctaaaagtggcagtaactttcaatgtataggttggtattcccgtgatgattgcaaacctgtgatttctttttacctgctcatctaccacttttgattttatcaatgcacatttcgttgttctctggtaggagaaatgtttttggtcactgaatcattttgatatctatggaaatgtgtacttgtgcagctgcttctgaggaggctattggaaaatttccccatgtttaataacctggatactctgtcccttggtgaatggtgtatggttcctgacttcagtgctttgtcaaccatacttacgaaatcaccaaatgtaaaaaggctttatcttcaccttgacgtggtacgtgtactcgtatgcttgttacatgtttgcttaaagtgtttaagcatgttattaatcccttgaaccatcgttttacaaaagattcacagaagaagaaggtgcatcgatcccagtggaggatcattttcttgcaacaacctggagaaggttaagatcacatgttgtaaagatgatgtaatggtccatatgctggctccattcctccaagataacggtgtatcgcctgagaagatttttgttcgtcgcacttccagcccacataatggcaaggaaggcagaggtagtaactccagtgcgaaacggaaggcgcaaggcgaagttgcgaggctagcagtgaaacagaggagggcgcgaaacagtagaagcccggagtgaggggaacatgtttaaaatgctgaggaatccagtgctgagtttacattgcagttagcagtagaattcttcactggatgtgtatatgcatcaattctagtacaggtaactttggttacatgcagaattaggcatccgttggtgttgcatgaaaatagatgattggtcaatgttcagtgacttggaatcctgtgaattgctatgtcatgtttgatgtattgagtaattggcagtggctacatttgtctttgtgatttcacggtctgatcatctggcctaattagttttgtcatggtgtcatgtttgcaactatgtttatactccccgtaaaagaagaaacatgttcgtactgtagccacattatgctcccctaaaaaagagaaaatatgttcgtactctagccacattagcatgtcgtatgctctagtacagtgcaggatagaaataaaaacatctattttactcccccgaattattttacttgatcacttaacccctaaactattttctttctcgttttaactctaaactgttgaaatggttcactttaccatgctagaatttatacatagtagaatcaccaccaattcactagtactcccactacttctacattctttcttcttgctattactattatatttttgtcatgagtaatcgaaactactacctgtaaaatccaaaccaaatattctgagactatagtctatatcttactaaccgatttcagggtaccatccctggcacttgattggcccacgtggtatcctgaaaatttagcgtacatcgtctgaaattttgccacgtggtagaggatggagcatcattccattaatcagtgcatgagcagaaacatttcctaaaacccagattgccgtgtgaactttccagatcactccacacatagagaaggcaaagatgtaaaagagctgcggctgccccttcaatattcatagaattaaggctactatttaatactccctctataaatttttattgtgagtatttgttttgggtagcaataccaagaagagtgtcgaatttgattaattaaggctgtgttcgaatgttgatgttggaaactaatctctagcacacgcaaaacgaaacaactcattatggcacccacaatggttatctataggctctctataagagatctatgtcagcatattttcctacatggaagatattaaatgaagagagagagcaaagctatctactaatttagagatagtctatagagaaaaacgagacaatgcatgagagagctatagatacccatgtagacatactattgaggcggtttattattaatctagtctattgctgagatgtatatgttttatagatagcaccttactttaccattgcaggtgctcttagcatatgatttattaataaatactcattagcaactcattagtttcaaaatactggtttaagtacctacatgagcgattttcctttcattgaagcatcaaaaccccgaagcaaatctggcatacgtacaaacgcttttgatcaacaagattgcaacggactttactttaatttggtaagcttaattatgttacccggttacccccatacagctctacagaatatccgaacctttggaatcattcaaatgttagatgcttatatatattgctcatttcagggcattgctgcagaaattgtacttttgaaatttggaaagcaagaatccaacttcaggcgagcctagctagacgcatcgaaggcatagtacggagtatgccagaagaataggttgcaaggtatctcctatgacgtattctcgtatgaaaatcatactacattcttttcaaaatgtatgatgtcattgacttttcacgtaacgtttgaccatttatcttatttataaatttaatataaatataaaagagtataagttaatattatagtttctttgataataaaataaatgatatttgtataattattttgaataagacggatagtcaaatgttatgtcaaaaattaacggcattatacattttaaaatagagggagtattattctattcgatttctttgaaccacaaactaaaagttccgccgagttatgctactgtctaacaatttagtacaccatatgccaatctctgtatttgccgcgcagttttctagtacatgtttaaattcaaatactacaaaaaaaatgacatgggaagtttccagaattgacatttctttttcaccggaggaaatttgaacaaagaaatatcccccagatatagtgaggactagtatatatattgggcatttctggtaattcctcccccatcgtctctcgaagcgcgaagccgttctatcgaaactcgaaagcagcgagagctcttggcgcgacccatcgatttcgccaagaaatcccccaatctctccgtgagttctcctcctcctccccttcaatcacctactccgatgtgtttcttgcgatcgaattcctttttcttggttgactttctctttgaacgcgtcacgatgtgttcattgtccatgtgcaggcgaactgttcgacggaatgcaccagggagcggcgggacctggcccatccggcggtggcggcgaccgtctcagcgccctcccggacgcggtgctgttccggatcgtgtcgcacctgaaggcgcgggaggcggtgcgcacgagcgggctctccaggcggtggcgccacgtgtgggcgtccgcgccgcgcgtcgacgtccgctacccgtgcgcctgcgacggccgcgccgtcgaccagaagagcttccgcgacttcgtcaccatcctgctcctcaggcgccgcccgctcgcccccttcaaggcgctccggctgagctggagccacgacgaggacgacgtgagcgcgtggatcgctcacgccgtcaggcgcggggccgaagaaatcgatctctccgcgaggcgtcaccatggctacccggtgccggattacaaacacttcatttctcccaagatcaagatcttgaagctgacgcatctcgggacgacgaggttcacggccgacaacaccctcgacctgctctgctctggctgcacttctttggaagaactggagctcaaggatatcaaatcactctgggggggaattcaatcagactcgctgaagcgcttgtcgatcatcaactgccatgtgacatccgatggcttcctggttgaagctcccaatcttatatcgctctgctgcatcagacctgcccgagctgttccttggttcagccacatggtgtcgctggtggaagccactgtcgtgcttgatgattctcgcttgagtgatgactatcagcagccagtgttggaggatgacaacgatgggtctgattatgatgataatttctttgcacctaaagctgagggccctgatgataagagagacaatgaagctgataatgactctggtgataagagaaatagggacggtagtaaatctgatcttgatgatcatgatggtgaatatgatcatgaggatggttctgagtctggtgataaagaggttgatgatcttgaaggtggcgatgatcgaactgtgacctatggtgagattgcagatgagtcttccagttatggtattcccattcccagtgatgaatatggcggaaactatgggaaccatgattatactattttcggtggtgatcatatgcttgaccacttgtcagatgttagaactttgggtctgttaggccatcaaggagaggtaatgttgtcaccttatcgatactactgccttctcttactagtatgctttttctaaagtgtgcacgctaattatgctcatttctttgcaagcaaatatggcaatgttggcaatgtgttgtatgggaaaggtactactattgagataacagaactcccttcaaaagtttaatgtagaagaaagtttggttatctctgttggtaatgagattctcaaatcagtatggctcagtttaaaaatacagagtactagcattgctgacgttacattacttgccttaagtagcatcctttcgaaatgcttccatcatagtttgttggtgaaaatattaagaagtaccttatactaattgatcagacaaatgaattggcgtcacccaggtgacattgtattgtagataggtactactgcaagttcaaatgttcctacctgatctactagtgcactagtattttcaatgccataataaagtctaagttacttctctccgtattgtactgagttttgaatctaacttccagtttgacgagttatgatatcttaaaagaactccctagaatcagcatttatgtttttttttatttgtcgaattttctgtttgcttttggccagaagaagttatccattttatcaaacaacaagcaagcatattagttacctcagcactagaataccaacatatcacaaatacctcagtttatattaattaggagaagttttaggttggtattctggaacattcgtcgggagccaatacgtgtactaactactaatcggggaactgaaaatgccagtaactgtccatggacatatcttattactctggtaggaccaatgttttgaatcattgaatcttttcaatagaataaacgatgcatttctgtgtaaatgtgcagatgcttctgaggaggcaactggaaaattgccccattttcaataacctgaacactctaacccttggtgaatggtgtatggctcctgacttcagtgctttgtcaaccatacttgagaactcacctcatgtagaaaggctttatcttaaccttgacatggtacgtttactcacacgtgcttgtaaattgttttcttagcatttaagcatgtggttaactacttaaatcatcattttacaggacatccacagaagcagagggggcatcaacccaacgggaggatcatttgcttgcaacaacctgaagaaggttaagatcacatgccgtaaagatgatgtaatggtccatatgctggcaaaattcctccaacgtaacggcatatcgcttcagaagatttttgttcgtcgcacttccagcactcataatggcgaggaaggcacgggcaaggactccagtgcaaaacggaaggcgcaagacgaagctgcgaggcgagcagtgaaacagctgaggagggcacgaaacagtagaagcccagagtgagggaaaggtgtttaaaatgctgaaaaccggtatggatgttgaggaatccagtgctgagtttacattgcagttaacagtaggattgtctactgaatgtgtaactatatgcacagtgttagtacagttacctggatatatgaaaaattttgcattcgttggtgttgcatgaaaaaaagatggttggtcacaatgttcagtgacttggagaatcttgtgaactgctgcatcatgtttgagttgcaatgtttgtatggagtaactcgctctgactgggcaaaatgtcgtcttagcgaaaattgaggagtgagctctgggttcgattctgattttattttgatggaatcgcactgcgtgaaatggcttcaggaataaattgagttttaggttgtgaagagcagcatcatacaatatgttttgttttctttttggttctcgaaactatgagatggacgaaagacatgcaattctgcatttttatttaagtaggttagtatatatctttcaaaaaaaagtagattagtatatacggtgagattgttcataattaaaaagaaattgatctggggaatttctagaatcggcaaaaaaaattcattccaatggagaaacattaatacacaaacaagagcaaatttcagcaaacaccatgtattatatgattgaagttgcataaaacccaggtattatggcttgtcacataaccccaactattgtggttctaaaatttttcaaaaccctacccctctacatatttggtatatatttacttaaaattgtaaaacatagaatgtgtatgaatctttttagttattgattgattgaggttgttggtttaaatcttcactactttaaaagatattgtctcaaatatgttgaaatcaattgaattttaaaacataaaatgtgtagttatatgccaccagtaatatatacatggtttactggaacttttgaccataaaacgtgtggttttacaaaatttactcaataaacaaaaaggtttggattaccccataaactactgcgatggtacaaattaccccctcgaataacaataccagacatcattcaccctcaaaattccttacaggatgaattaccccccactccattggctttggagcggttttcatcttacgtgacgcacaagtggtagtccattcagcataaaaaaattttaaatggtagggtccacatgtcagttttgcttcttcctctatatattggtctcttctttcctgactcatctcggtcgccgtggatctctgcccattcactcgcgaacaaataggtggagggagagaggaggtgaggtggagcgcatcaggagctcaatgagatggtggtggtggcgatggaggcaagaagcggggagtagacaagtacctctctcaaacacctcatggaattcgccaccgaactgagctctaggtggatctgtcaccaccccgatctccacgtggaacagacaccacct

SEQ ID NO: 58148 - DNA, 1149 bp, Oryza sativa
ctcggtacccgagaggaggtgaggtggagccgcatcaggagctcaatgagatggtggtggtggcaatggaggcaaaaaacggggagtagacaagtacctctctcaaacacctcatggagttcgccaccgaactgagctctagttggatctgtcaccaccccgatctccacgtggaaccgacaccacctcgagcttcgcatccaatcatctccacattgcgataggtctattaccctacatggccattcgactttgccacctcgccaaccccacccccaaagccaatcccttgccgctcgttgtcatcgccgtcgccaccaccacagaagaagagagccatgactaccaatctagctccgccatgctctccccccccccatctctctctttttcttccccatctcctggctacgtcgagctcaagtagcttttcacgacaacagcctcgtcatcgttggcgccaccgccattgtagcccaattcgccgatgtgttgattccgtctcggtcactgtcaccacttttaaaatttctttatgctaattagactaccctttagagcaagtcagggggttattcgtttggtacgaaaagttgaggatgaatgatgtctaattttataattaaggggataatttgtaccgtcatagtagttcagaggttaatttaggctgtcttcgctccatcgtgtttccaaccggaatagtgcgcatggaaaacagaacggtccattagcgcgtgattaattaagtattagctatttttttcaaaaatggatcaatatgattttttaagcaactttcgtgtataaactttttgaaaaaaacacaccgtttagcaatttgaaaagcatgcacgcggaaaacgaggaagatgagttgggaaacctgggataaaaagccctacaccttttctttttccataaacaatacactagttcttaggcctatatatactgggcattttcggtaattcctcgccccttgtgtctcgaagccgttctaccacctgctggtgctccaaagttgaaagtcgaaagcagcgagagctcttggcgcccatcgattcgccaagaaatccccaatctctccgtgagttcttctccccctcccctcgatcacctgctccgatgcttttcttgcgattcttg

SEQ ID NO: 58149 - DNA, 1299 bp, Oryza sativa
ggctctaatttacatccatgtcattcaaagcatcttgacaggaccattcttaggaaactattctaatccctcgaggggatgttccctcgtttgctcaaaaaccatttaaacggttatgaaaaattctgcaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctacattgtcatttttttcagattttttcacaactatttgcattgaatttggaagaaaaagatatacgaggggatatcccctcgagggattagaatacactccccattttcttatgtatgtgtgggaccaccaggtttgctccctttgggccatattggaatactgacatgcagcagttaacatattggggcattggcctatgcgcttgtgcttggccggctctcatgcaagcgtccgcttccctctctctccaacactttctcacttccacgtaggcgaaggttagctaagggcaagctcagtatatcctacccaactcggtaggagggtggacccaaacagtacatagcaatagtatatcacaggaagccacaaagcttatgtgcaatagggaggaataaggtggacccctcttgaaaaaggcaaattttgctacaggacacttgttatgtgtgcttttagcccaaggacactgcccaaactcacttttgggggaaaacactctataaatatggtaatttgccagtggacaccgtgccgattaaaataatactttctggttggggaggagatagaaatcgcgtgaaatgtcaaaaatgcccttgggcccacatgtcagttctatctcctatctctctcctcatctctctcttttctctctcttttctctctcagatggcgaggacagcggccggcggggtggagcggggcagcggcagcggtggacgagtgcgcagccggcggagccacccctcgccgctggcgccgtgcccatgcccgctccgccaggcgtggggcagcctcgacgtgctcgtcggccacctccgcgccgccttcgaggagcacggcggccaccccgaggccaacccattcagcgcccgcgccgtccgcctctacctccatgaggtccgcgacagctaggccaaggcgcgcggcatcgccgtccggcgtccgcccacct

SEQ ID NO: 58150 - DNA, 3032 bp, Oryza sativa
ggtggcggcgtgcgatctgaatcgggggggaggaggagaggagttaggttaaaagggtttgcacgaatcttgaagcatatccaatggtctaaaattcgaatgatatggggttggattttctgtcacaagatgtatagacagccccaagaaagaaatgttcctctatttaattccctctattcactactgcattcatctatttccctccattcaccattgcagaacatcttaatggtgtcggttgtaaacttggcgtacgtgctggttccgcagtcggcaccaatttttccaggaccagcactaggtcacttgtgctggttgtagaatcaacactttcgtgctctctccaattcaagaagaaaagagagaagtcggctcgtagcatcagctcatcaagctaatgctttcgagcggcccctttcaagcagcccctaatctcatccatcacagctcaacaataacaatctccagacccattcatcatagatcaacacaagtaagatgaagaactaaacaagcaagatgaactcactcttccgggtcctagcaaagccactagcaccgtcatcgccaatttgtctctccattggaggagcgccatggaggacatcgactagcggaggtgtcgtcgttggcacgcaagctcaaggcgacggggcagcggcgcggggggaggagaggacgacaggtggtggcgtcggatatgaacacgagagagatagagcaagagagggtaaggatcggcggtgactacggagaggttaaaaggatgagttggatggtggctcggctcgactcagtttttttattaagaatcggcatctataatatattataggcgccggttgttttttaaaaaaactggcaatactgtacattataagtgtctgtttttatttaaaactggcacctataatcattcaaatatgccggttccatatttttccctcccgatgaacgtagggtaaataggttataggagccggttttaaataaactggcttctatgatcatgtacctatgaggattttttagtactggcttcaaatcataagttgggttaaagtcaaaatacttaaaatttgactaaattttaagataaatatatcaatattcacaaaaccaaattagttttttaaattaatagtcaaatatacttttatagtaccatgtattgaaaatgttacttataaattatagacttgatttagacctgaaatagtttgactttttctaaagtcaaaactattataatctgaaacaaagctaaagattatcgattgtttaaaaaggattgagtttacaaaacttctttgtttgaaacttatatcaaatgaaaaacaataggttaaggctccattcagagctgatgattgggctaaaattttaccatttttttcatgagctaaacggctaaacattgtgttttttactaaaattttatatccaatagtttctttagaaaaatatattaatattttttcgagtttacaacggctaatatttaattaatcacctgctaattatgtttctcattttacatggggctaatcgatcagtttagcatactagtactcgtagctccgaactcagcctaaagaccttaaacagtaaactcaatgcgccaaagatcatgtactcctatgcaatgcatggtggtatacaaatcagtgattgcttgcatatatacacatcgccactagttgatccattgattattaaatctaggtagctaccaacctgtccgaccattttcacgttactccatccgtctcataaaaaaccctaaccaagtaccggatgtcccatgcatatgcattcagatatctagctagatcaccccatatatgcatattcagtcttaaagtactactccattagagcttttgacttgaaactacttatggcggtacaccttaccaacaagccaccatgatcacagagaatagttagtagtcatggtagacagtggtcagtgaggatgttgtgaaagtcaggtataactataacaatccagaattttcttgatggccagctaattttattggcgtaaaaaagaagctgtcaagtttacatattttcttggcggctaaaactaacagccatgtaagccatattcttgttggctcagaccgacaaggttataactctggcgctctgaaaagctggatatgatcacaatttttttgtcagtctaaccgccaaaacttttactgaaagttagccagtaagaaatttagatttcccttgctctctaaacttggctttgattctgttcttgacggcttctggccaccaacaaaattcccagttctgatagtatatgcgctagaggagtctatgaggggatgatgatgaatgggtgatgagtggtcttccccggtagtggtcaccgtagaaaacatcctcttgctgctttcgcttgaagagcgataatcactgtccgaaccagaatggaaactgcacaacagcacaagtaatcagatagcatagctaggcttcacttgggtagactccttccgggcttccggctgccgctgccttgataattgacaagccaataattaactgtcatgacagaaagtttattactacatcattctgaattacaaactagttcataagatcgatcaaataatatgaatgcctctgttgctgacttgaatcagaatggggtttggaggtttaactatggaaggaatgtggacagtcaagagggctcagagctagctagtttaagagagatgcaagggtgatggaaattgaagattttaattatccgataaactgatctggcttcatgctaagggaggaattttctcaaccagatcactgtgcagactgataaagtttgatggggtggtcgataccaagctaagagaggtctggaaaggcaaaatgcttgccattgaaaatcaaacatttcctctacctggtaaatattttttcacgaacgcctacctggtaaattcaagggagagaatccaatgtgcagttcaattggttgaggaattggaggggtggaatggagg

SEQ ID NO: 58151 - DNA, 1017 bp, Oryza sativa
gaattttgtcattgcattgaaaggaaacggacgaggttcattacatagagttaatagattgtaagggggaagagaaaatttctttccaaatttgaattacatagcgagcttcagacttgagattttcagcctacagagcagcttctcgcacacatcgctgtagacatgaggtgatggaaggaccttggcctctaaagacaacatcatgtctgtgattccacaatgcccagaaacaaaggagatagaaaacctgatagtgtagaatcggcattcgaaggcctggcttgggctgatgaaactggattcaacatcttgaatcaacggttgaacaccaatcttttcccagaaactctttgcaaaagggcaaaggaaactgtttcaatttcgtcattgcagatgtcgcaagtgtcattgggtacaattgtcttcttgtgtaagtttttctttgtggacaaacggtcttttactagtgcatgtggtttatatatagagctgtttctgtcttgcagcgatggaaactgctgcgcaacttgcttgatgaaatcctggccaggctgaggcagctaaagcctgaaggtcgatgtgcttgctgaaagatttatgatcccggaggccctagctgtttgttctggttgcagtgaaactggtgatcccagtgatgttatattagttacttcggtgttataggcgtagtttttctgtttgtctttccacatactttgggcctgttcattttgatgccattttcaactataccttttttgggtaaagttgtcaaaaaaaatatttacgtttagtttgttgctaaatttgatcaatacataagaaatcatgccaaaattttggtaattttgccatcttactaaaattttggcattgtcaaaacttggtaagatttattttggctacaatctgaacaggctctcggtttgtcatgttctcttaggcttttctcacaaagccgggcaataaaaagcacgctctctaaaaaaaataatatgaatgcagaatttacat

SEQ ID NO: 58152 - DNA, 3708 bp, Oryza sativa
ttgcctttttttgggacggagggagtaaacgttgttatatgttaggacggagagagtagcattttaaattttatgcacaattttagaaacgttaggagtatatttttgtcattttggttgctaagctcttcgtgtagaaccgttaaagaccagaagcggaattttttttggttgttttgttcgcgtgtcttggccgtacgcaagtcatcctgaaaattcttaaacccgggcgactggcgcggaggagcccgatcaggcgctccccctgcgactatgcgagcccctcccccacgcgctgcatgcaggccctccgcgtctttgctcctatctgtcattgcaacaaatcacccacatattttggaaaccctctattaaggtaatttggtttattttttgttcaaccaaaaatgtttcacctagtgtactcacaatgtttcactatgtatagatctaatattgcagtgaactgaaatattccattgcaacaaaaaaacccacatattttggaaaccccctattaagagaattcggttcattttttgttccaccgaaaaatgtttcacctagtgtacttataatatttcaccatgtatggatcaaatgttgcagtgaactgaaatattctttcactatttgctgaaacattgtttttatataaggtaaaacaatacccgatttaaacgagtgaaacattttcgatctactcagtaaaacaattccgatatacctggtgaaacatcgtgcaacatttaaaaataattcaataataatttttaaaaaaatcgtcggaatatatccatatgtgattttgttttgaagatttaattgcaacgaatgtaatggtaatcggatcatgatttggataagtaatttaagagaaaaatcagtttaaaagtagttttgcacgtaaatcggacgctgacatcagcatccagtttttctccaaatcgatcgggagcccgacctgtagactcgtccaagtcatcctattaaaaacaagtaaagttgagtatcgtaaatttgttgtactaaaaacactatcattgctattggtcaaaccgactcagtgccaacaactactacctctgtttgagattacaaatattttggctttggcgtaaaactacaattaaatttatatttaaatattagtttatctacaacaacaaattattttcattaaatttataattaaatatatttttatcgtgtatattgtgttgaatatgttattatttttttaataaactttggtcaaacttaaggctgtttgactttgagcaaaatcaaaatgacttataatctaaaacggagggattttcttaaaaaaaattgaatcgtgccattatatatatatatgggatgtgcttcgactagtttttttcataccgtattttcttataaaccaaaatatcgctcgctatttcttctctccacctcgatgacttgtgtgccctagcatcatcccttgcgtctctcctgttcgcctggatctggtggtgatgaggaccaatacgtaaacaagaaaccttcaagtagagcacaatatttcaacaatggcggtggtgaggactgtgaacccaaacacgtcggtggccccctccaacccttttctcacacgaccaactatgcgagacatcagtggaccacgatagttttgagaggcatctgcgacaggtcaacagcaacatccacaagatctagacgagtgagggtgttgtcatccgatactcaatcttgaccttcatcgaccgtcgagaatcgcctcgcctctctggtgacatgaggtgtgtgcgtcaccatcaatgctttcttcccactctcgatgagatccttgtcaaatccggcacatcctcatccgtgacgtttgcgaagcccgcaaggaaaagcttgacgacaccattgacatctcgtagttccttcttgccgtcaacgagctcgtgcaagggcttcaacccaaatgacacagcttccctagccttcatctccctcgctgatgaggtcactgcagcctcatcctctcaatgtccgcgctgcatagccatggcccatcgacgccgcctcctctagccactggtagccttgagaatagaggagccaaggagagaggtgaagagacggggaagagagaagtgaggggggatggaggacgaagatggaactgatcggtgagtcccatgtgcagattgtgtatttttgtccatccaaaaatacaatagagaaaaacgattcaaaacatgtgatacctacaaatgacgttatgcaattttgaaggtattgtaatcaattggttacatataggtgaatattagtgacattttttaatacaataaatttataatggcatgatcaaatttatcgaaaatatttgctaatgtcatttcgacataaaatggaaactccaatttacatttttttggactttctgatccgcttaaagatttgtgcactacggtattcttctctcgctctgacgagcttaattattgatattcgatgacgacagcggtggctctaaccagttaggtatcggggtttggggttggagagggtctgcaatagtccctccattctaaaatgacttaatatttgccttatcttgtttgtttcaaaataacttacctatcatcggcaagccaaacgagttttgttccttcaatacactttaccaatcttcaacttatttttcaccactactatttttctattaataagttttttttttccctccttcatctattttgttttgcacactcaagactaagaatgaagttatcttcagacagagagagtatagacgtaaggatagacttaaattatttgtctgacctacggagattcagcttctagcaccggccaaatcaaagctagccctcgctttaaagaaaaaaaaaaggagagtattggctggtggatgtcgaccacctcaatttgtgttttttttctgggacaccttaatttgtgttttgaaaccaatcttgggtgatttaactcggtcctactatgctaggactgattatacataccatgtgcagagttcaatattagaaacagataatcagatagtattggaccagagaaatctaaacgttgtaaaatgcctccgttaatctagcattaatgaagggatgtacttcgagtgttaatattactccatataataacaacattacaacactataaaattattttatttacaaaaagtagttattgagtgtgcgtgcgttgtactgtgtaattctaaaaaaaatcaccgcaagatttgaagggaatttgactatttgccacttttaaattaggcaattattcaaatactcttctaggtgtgcagttactttttttccctctaaagaggtggcctcttaactatttgccacttaattttaaccataaggcatgccaacgtggcaacctagggtgaaaaatggcatggggcccacccgtcagtttatccctccctttcatctctcccatgcacgtccatggcccccgtcgacaccggcaccaccccgctgctccatcgtgcccgcaccacgtcgatgtcggcatcgcctcgtaaccgaccaccgccggaaccgcctaacagctgacgccgagagccctgtcaccgcctagctggcattgcttcgcagccgagagctaagcaccgcagcaccactgttgttggaggaggaggacgaggagaggcaggagctaatggaggatgac

SEQ ID NO: 58153 - DNA, 22151 bp, Oryza sativa
gaatgaaaaagtttgaaaaacaccaaaacataatttttggacatattgggagcgttcttggcaaaaaatcacttcatgatttgcgtggcgaacttttgttaattaatgtcaatagtggcacacgtagatgcgatgtttttgaccggaatgaaaatgttcaaaaagcaccaaaacaagatttttggacatattggagtgtattgggtgcgttcgtggcaaaaaatcacttcgtgattcgcgcggcgaacttttgtcaattaatgccaatattggaatatattgccacacatgggtgcaatatttttgaccggaatgaaaaagtttaaaaagcaccaaagcatgatttttggacatattggagtgtattgggtgcgttcgtggcaaaaaatcactccgtgattcgtgcagcgaactttcgtcatttaatgccaatattggcatatagtggcatagaagggtgcgatgtttttgaccggaatgaaaaagttcaaaaagcagcaaagcatgatttttggatatattggagtgtattggttgcgttcatggaaaaaaatcacttcgtgattcgtgcggcgaacttttgtcaattaatgccaatattggaacacacggtggcatcatgcatggcacggtgacatgccggtggattttgtcttgtgggtacagttgtgcacctctttctagagtaaaactatttgaatagtcgtgcctacgaatatgtgtgttcaaccagattcaccgtgattagtctcaccccttgtttcgcttaatggaactggttagttcaggtggtggattgtgtctgtttcaacgtggtgtagcgttaagcagtgattggttaatattgattaattactacaactgttttactgctttcaactacctttttaaatgcctgctatatgcaaatgaacccttagcctcctttttaaattcccgaatggaattccaagcagaatgtgcattaaaatccctgtcccggaccggccagggtacacaaacgataaagttgacatacagatccacgtcttacaaacattataaaagtcttacataaatgcagcagaaaataaaaggataactggagctaagccttgacttggattgcagcggggaacatcactccacaggcatccttgatggcacggacgaagcctactcctctggaaaaccaccatcggaagcatactcgaactctggggttgggagatagagcaagactgagtactacccactgtactcagcaagtcacaccggagcagagggtatgatgcagtatataaccaaagatggctaaaggagttcatttgcataaagctagcatctataaacagtagttgaaagcggtaaaacagttgtagtaattaaccaatattaaaccaatcactgctcaacgctacaccatgttgagacaggaccaaaccaccacttgcgctaatcagttccattaagctaagctagggtgagactaatcacggtgaatctggttgaccgccaataaccacgggcacagtctgattagaggtgtacaactgtacccacaagacacagtcccacgacacgttcctgtgcgccggcatgccaccacgatatactggaaagatgccgtgacaggacccttcgcataacccctctaaccaagcacaccacacctcaggttttacccccagtcctcaaaaggcagcgggcagtcccctctcgtgcctaggtgaatccggaagcgacaaaggccgtcgcagggcccatcccactccatcacgcccacccttgcctagatgcgttggctagaggaaagctacactacaagcctagctgttgcccacgctggcttgtggtaagtacgaggaattcttccagggtttcgcacgaaccggtccttaattgccatgggcacgaccatcaaaaccatgcacccacagcccaccatttaatgtattttaatcaaccaacaccatagcggtgggactaatctaatatcatactagagtccagagtctatgcattaatgtgactcccccattgtgtactagttgatctaagcatggctaagcaattcctaatcccacatctagtcatgttacaacccaagctagcaaaggaataagataaacaaatagtatggctgagacagtaggtaaacatcccatagtaacattataaaacaatgcaatatttaaagaaaacaatagagcatttgcaatatgggatcaatatattcaagtgacaagcatgacttgccttgctctgtggctggagggacctcggcgactatctcaaagtacaccggagcgtcgggagagccgaaatctaagcaaccaaagcaaacaggctataagactactgaaacagagaacaaaaccatttttaatggattctttgcatttttcttgatttactgagacttgaatgggcttaaatggagcacggatgaattttccatgaattttagaagattcactgtgtttttactataacagaaaaaatccttaattgatttatcgcgcaattaattaacctcgggttacgttagcaggggtggcggcgccgacaagcaggccacacatgccaatgaatcaaggcgtgccggtccacggtggaccaagtccacgggaccgggaggggaagcgccgcgcaggcggccacgtgggcagcgacagatggccctgatctaccgcacggtagatcggtctactgcgggcgcttgtggccgatggcgcacgggcacgtcctaggctagcccggccatggcgcacggcagctcggcagccaccggcgacgaccggcggcgagcagcggcgcgcagcgagggagggagaggggaaaaaggaggggagggcgtcttcacagcgaggtccggccggcgcgagaggaggcgacggcgatcgaccggaggtgatgacaagtggcggacgtgcttcgggagaacctaaacaaacactcgagaagagttagagagagagggaaaggtcacgacgcgtggaatcgccggccaaaggcggcagcaatggagaagctcaccagtgcacgacgaaagatggcttccggtggcggatttcgacgggggaggggtggacggcgtggccctcgggctcgcgaacccgacggtggcgacggcgaggcttggcggcggctctaacggcggtgagcggtgaccggaggtggctaaagcggcggcggcggttggtgcacggtgctagggcggaggagagctcgggagcgatcaacgagaatgtgaaaaaggaggaggaggatgcgggggtggtttatatagcccgcaagaaaaattccacatgccattttcgattattaattgcatttattaaattggggtttctgtcttgcctttacacaaataatttcttgagaccatttattaactcaatttaggcttgggagaagaacttcagggtgtgacaatacctcctcttccggtttgacttgctgaatacagtgggtagtactcagtcttgctctctcttccccacaccagagctgaagatcttcccagttggagctgtcccgttgaagttggtttcgtcgctgccatcaaggatgcctatggagtggagtcgcctcgctgcaggagtcaagctttcaagtctagctcatttatcctttccgctgcatttgtaatcttttatatttttgtaagacgtagatttgtatgtcaacaattgtcgtttgtgtaccctggctagtcctggacaggggttttaatgcacattgtgcttagaaattctagttcatgaatttctaggcgtgacaattctcctccattttgtgttcattctctgcaagaggttagtaatcctagtgatagtggaatatttttatttgaacacaaatatgcattgcaagcataactagtctcctttattttggtaatatcgatgggtgaaactgatcgctaacgaccgtcaacaaaaacccccaagcttgaacctttggtcatccctagtgaaggacgaaaggaaacaaagacttggttgttgatcaggagtcgctattatgctgtatatctcaaatgtacaggtgcagggtttgtgtactgtctcttaaatcaaataatctttggcacgatggcttaccgttacccctgattaccacgagacactgcctttccttatcttgagcggttgagaggcagaacagcaatttgagcaccaatcacccaatatttattcaacattcattccggaagtttttcaaatgattttgcgaaagaaatccaagttcctcaaatgattcactcgatctctcagggtgtatcaatttgaactcctcaccaatttgcctttttgattccaactctaaggttgatatgtggagctcagtagggatcaaacatggcatacttgcattaacatttattactaagtaaaaaactatgactaaaatagatgactaaacatactcaagatcaagatcgtgcaaagtgtgtgtgtgtgatatatatggtacaaatgaaatgtggaaactaaagaaaaagcttctcctatgtgcttacttccttctccaaaatccttctttcataaataagaagagggcatggctacacattattttcttttatattttctttctcaacatcatgctcatgattgagagagcataacattattattttcacaaccatgcctttccctccctctcttttttttcataaaggattttctttttaggagaagaaagcacacaaaagcatggagaatttattttgatggtggtatggaaatggaatggataattgctagctcccggtgtaggagtttagcgtgtgtgttgacggtcgttatcgaccagtttcgaccgtcagtattacccaatgtatgaagactagctatgcttgcaatgcataaattccaaataaaatatccacttccactatatactatgctactaacatgtatataggagaatcccctgctgtgttctcttcaaaaaaaaacatgtatacacgagaagcacacataaatggaggagaatcgacataaaattgataaaaaatcaatcagatgctgtcgaggatcagacttatggatagatgggctgagaacacagaaaagacatgatcaattaagcccaaaattccatgttttggattgaggagcaaatgaggagtcggcccgccaaaaattgggccgtttgggccagatcatggttcggtcgaaccccttgtttcggccgaacccctatcacagccgttcaggctggggtttggcgtggacgctccagatgaactcctgatggcggttgcggggcatttcggacaactcctatgctctacaaccgtcatacctacctatttaaggagccctcatcctcacttcacaacacacactcaagcaaggattgaagctccattttattaatataatatttcttctttatacaaggtcggtactttattccattcatagaatataggtaccattcttagtttattgataatcagtataatcttagtagttaaaccttctgggattttcattgatgctggtagaatgtctgataactgggtcataagtctgctctggctaggccgagagctatggcccggggactcagatgctctgcaccgattgcaaggctgtagagtaataagtagttacttaagcatagggttcaggttatcacttatcattatttgggggtatattcgccgggagagtagcaggctgctgatggtgacagctcagtatgggcgtcttcctcgcagtttatattcctacatacaatttcctggggttggatacacctctatatcctacttcggttggagggttatgacatgttgtcgtaagaaactcgacaacccttgctaactttgcgttgcatcgggagggcatagctgagttccggtttagctatgctgcattattaaaggggttatactacatagagtatactagttagaatagactaggatgttgtatactagaagtacaggagtgagatatttctattctatttccacttaatcatatttaggttaaggaggagttagcggaatccttagctgtgtgtcactttacccttaagcttaacttacccctgcatagaccttgatgtatacaagtaatatatatatactattagcatagtactctcttatcatatcttcccttgggataaaataattacgataccttggaatactcccgggtgaaatgctacaatggtatatccgtgcgcttgcggatcacgtctgtaaccgtaatatatcaaggttatttctagtgctattgctgggaactatatttccagttgtgtcgctaagaaataccaacagtgtgcataaatgtgggtgcatgatcttgatcatacagcatgagaagaatctacacgtgtctcaaggatttgacaaagttcaatggaattgcaaataaccaaactatatatggcttgatcaatatgaatatttttggctttggtaggaatttataatatcaaatgaggaacttcatgattttgtcattttgaaaaataaaacatccggaatttcaagtcaaactcagactaggattatagcaacttttattttctatctcatatctcacaacaacttagatcagattagcaaatgcaactcatttatctcaggttcccggatggctactcatattcaatttattagagagtacttgaccatgaacctataaatgagagatataaaacggagcagctattcatcatttcatcaaagagaactaagttgtcttacctagcataataaaatctatcctatctttttggtattttttattttgcaaatttttatgttgtttttagtttgtaagatgcaattggaaaaacaaacatgcatttgaaaaggaaaatatgcaatgatacaagttaccttagtagggggagagatttctccccccaagcttggctttcgctcagggtccttgataaggattgaatccctggaagcggaagtacgtttgaaggtcatcgtgctgttgctgcatcaggttgttgatgttggtgaactgagcatcagcattttgttgccattcttgcgtctgtgctatgtgttcctcgaggttgtattggatctcttccgtttgcatatcaagggtatccattctcctagtgatttcacctaagtcccaacgagaggaacttgagcgccattcaccgagagatggaggcataccgcttgatctgggggactgatagttcaagcctccccattgtatgtcatgaggcactgtcaacgaccaaatttggtaattcaagtatcggagatgaagataaaatcgaagcggaatccaagagatagatcgaccggaaacagaataagaatcggatgaagtccgaatcggctgcgatcagaatcagcagagttcgagtcggacaaggtagccgattgggccgattccgacaatgtgacccggtacacatcgttgggttgagttaatgtgcttcatatggattgccacgcacggattgggtcctgtaaaggcaattgtatctattaattaggatattttatataatttccttagagataagtttgggcaaaagtttgccgcaaagacttatggtatcttaaagtttgttagagataggagttgtgtccgacaaggacatattttgtatctcgggtataaatatgacccgaaccgatataatcaaacaacaatcgttcaatacaatctcggcgcatcgccacccttttggctttcgtttatttcgacgagttcttgctttcgggttgagctgcatcgatttcgatcttcaactagaggtaaagcttgttatggcggcttgcgttatcggggttaatgcttccatctttatgatactttaaccctgtctatgtaatccgtcgagttatcatatacatgttgcaatctatgctagtttcgctatatagcttgttatcggctggttcttattattagggaacaatcggtagagttatattttgttattaatctagattgtatcgtgtatttaccatctcttgtagattttcgtcatcttgtttagatatcatacttgtctttatgcttaatgctgcatcggttgagttcaatctattaagtgttatttataattataatatctggctcgttttatgattatgaatagagatagtatcggggtttcagccgatcttacctgatttagccttatgtcttacatgcttaattgatatgctaagtctgttctttatattaagatcttattgcaataaagtatattaggcttttgtttgatatattctatctgttttaacatcttagcatacagtagtatcggagtactagccgatacatgctagatctatctgatcggctatgctacaagcgtttataacctttaggggaaggggtccgtattacaaaatacagtccatatccctaacagaatatgcgattatagataaaatacaatcgtaaccgactaggatctcgggtatttccttgacatacaagttagaaactaacctgagtcctcataaagatattctgtcaatatttggtagcacatacccaactaaactataactgccgtgtagatatggggtatccataatctccacaggagccccaaagacctttgcagtcgacgaaattgctttctcagaacacaaagcaataatccgagtgtttcaattccttctgctccagcctgccgagtgcctaaatcaaagactgtgaagggcgaaaataaaatatggtgcatcgagtagatgcacctaattaggtgtagcctcccgactatatggttagttgaaaaactagacatgtagtcaagaaccgagtggttttacagccaaatagcaaattgtaaagttcgtatggtattcaataaaatacccagccgactgcctttcaacttgaatatatcaagaaaaaatatgaaaagggcccgagcgataaacactcaaaaggtccacaaaaagacacatttgataaaaatccgagtaagaaactcttaaaatgatccaccaaatatgataaagatcatggtaattaagaagtttaatatcctaggctataacccttaccataatcaaaataagcatataacatgccaaaagaatgactcttaataaaccagtcatctcaaatcaacccaaacagcttttgtagcctaataaagctgacaaaaatagtataacacctttctgtcgggcacctttttcatctgcatcgtggtaattccaaagaattatcaaactgcattaaaaaggattttaacagcgtcgggtcacatcattgtgagctcaaattgccaaagcaaaaagcgcctaagtccctagggatcacaacgggccacactgataacgatattgggctgaagtactgtacaggcccaggcccattagtactaccgataccctaacaaaacaccgaagtccaagcgtcacttcatcttccccgccgaaactctcgccatttccctacttcttgctacagtacaaaaccgcaccgacgaagctagggtttatcaatccaccccaatccactctcaaaaatccacaaaacttctccacgcgcccaccgcaccgatttcccattcctctccagctatttctcagaccgaatcagcctattcgactcacgtccatggcggaagagagagaaagtttcgagagtcagtgggcgccctccgatgtgacggaggagaatctgaaggaaatggtggcgcacggcattcttccggcgaaggaaatcatcgggtggcgaccagcgttcggggaagcattcccgacccccgacacacgcgaggtcgtggtattttctcacttcttttatggcagattttccctcccaacttcaagattcttccgagggattctgaacttttatggaattagcctgcatcatctgaatccaaactccatagtgcatattgcgaacttcattcatgcctgcgaagcctttctgggaattaggcctcattttgctttattccgccgcatctttttcctcaagccccagccgaacaagagcaaaccatgcgttgttgggggcgccggcttccaactcagaggaacactgagccagaaatatttctctatgcctttcaagacctcaaacaaagggtggcacgcaaattggttttacgttcaaaaccctgagccagctcttcccgagtactcttgtctccctccggtctaccaggacacatggaactcattgcctatgggagatgaggctgctgaaggagtggagctaatggagcgcatgataaagctgaaggaacaaggcttgcaaggagagcaaatcactcggcacttcataaaaagtcggttactccaatcaaagagagatcccgcacagcttttgagtttgacggcaaacatgatccgaatcgtgaagacccagattcccttgatttcaagctcatgaaggagagaatgtataaaattttctcgaatgcaattgtggtcagctattcgcacttgctgccagtggtgccgtacaacgccttcaaccctcctccaccggtaagtatcgatcatctcaacctttctataaagcgtgcttttaccttctgccaaattgacggaaaacttgaaatataggaattcgctttgatgaaatctgacccccccgattgctcagcaccgcagccagtcagacttccgcaagaggaaactagccttgagtgatgatgaaggcgacaacgctaagaaagctaatggctaggaaacagctggaaaacaaccaaggcaggctaatccaaagaagaaaacatctagtcgtcccatgccgaaaatccgaaagtcttccaggtacaaatcatttgacggtcttccttgtactggcgctcattcattaaaatcatactgataacatgattcaaacctgtaggaagccatctgacatagatccttctggaaaagactcaggccgactggcatggaaacaggttcttcaaaagagactgggccaactgcagggaatcacccgagtgatgaacagccggcgaccgacaatatagatcccagcagtgagcccccggctgggagccaatcagccgaagctggggttggtgcaagtcaggagctcccgactagaaaccagtcggatacggagcaaaacaaggacatccctgaagtagaagctcaagctgacagccctcctaaaaaagatgtcaacgtcgatccagggtccagctctcctgctaaagtacaagggcctacccatccccgaccggaaataatcacaggtaaatacgtcctccgaactcaatttggtccgacagatttttcttcaattgcttcatctttatttataaactcctaaggcccgatgatcggcgatgaagaagaaatcctgaggatccagtcagctgaggattcacacccacccactttaatcaagtggtgggacgatgataagcaacctcagggaatcataataaacaggcaaaaagaagatgaggaagtgtgcttgctgaaaaaggcactcaaccaagccactcgcattgtaaacgtaagcttccctatgctcagctccaactatcctgttttccattttacttaaacgccaataaattcgcattgcatagaatccatctcaggaacgaggcgaagaccgcaactcttgcaaagttagttcctcatcttggaagctcgaggccaccagaaaccagttgcacgaaattaaggaactcgccaggaaaactgagcatggtctgagagatcgagttgctgagctccaagagtccaacttcgaactaatcggttcatcaaaaggtaaacatgatccccgtctgacttgcttatgctaccatccttgtcatatcgattaatcaaaaaacaatacagtgcaagctgccaggatttctgaattagagaagcaggtccagaatctggagaagggcaaagccgaattggcaaagcagagagactcggctctaaaagacgttgaaggtactgatgactgatacctcctatcttcgtgaccacttgttgatgtgaatttatctgtgcagacggcaaagtcaagtcccaagcccaaattgacgtcctggttaacaaaatcaagaggcttgagggagcttgagatgaggttgccaacgctgttgcaccactcgtccaagccatgttttataataacaatggtccgagttcgttcgatgctgctgaaatctttgacaagctgagaattgctccagatatttattttaagaacatcaaagaggctggaagtatgggagcaagcctggcgttggcgatgaccaagtccttgtactcgaagattgatattgacgccgttgacggctttgcagacgggacaagtgaagaagctgctctcgacctcatcaatgacgcgcagaaagccgccgacaagatagctggtgacatagttgaaagattccaggacaacgacctccggccggctggatctaataattctgatgatgaaaaaactgacactgattgatgttatattgtaatagtgattctgattatgacgatgatgatggaggtacaatttgtacaatactgatgaatttatgctgtgcatgatatttcaaacttagctcctgatttcttaaaagttttcgtcaaaccttgttgagcctaaaacccgcaaaagttgttaaaaaactttcagtcctcattggctaagccagaaaatcaaacagagcaatgataaatcaagtaagcaaattgaattaataaaaatcatactccattattatagtagcccccaactgataactcaaagaaaggcttgatgttagcagttaaagaggaaaatacaaaagtaatgcctaagcataaaaacgacgaagatgttcaatattccaagagttgtcgatacgagtaccatcctcacgtttgagtcgataagaacctggtcgagtgacttcagatatgataaatggtcattcccacaagggagataacttgtgccgatcccgtgtagtctgaatatttctcagaaccaggtcgccgactaaaaaagctcgtgagcggacattgcgattgtgataacggtgcaatccttgcaaataccgagccgactgaattaaaactgcttcacgggcttcttccagtcggttgatatcatctactcggtcctcttcatagcgctcctcatggaagttccgaaatcgtagcgattcaaattccaattcactcggcaacattgcttctgctccataaactaggaaaaaaggcgactgtcccgtagcttgactaggggtggtgcgcaaggaccaaagtactgacggcagctgttctacccacttgccggtgtaaggacgcagccggtcgaagactcgcgcttttattccttgaagtaccatgccattggcgcgctcgacttgtccattactcatggggtgtgccacggaggcataacaaattttaatgccgaagtcttcacaaaagtctttaaatactccacatgtgaattgagtgccgttgtcagtaatgatacaatttggtaccccaaaccgatgtacaatattgatgaagaaatctctagctttgtctgcggtgattgtaatgacctgtttagcttcaatccacttggaaaatttatccacagctacaaagagatgagtataaccaccgaccgcctttttgaatgggctgaccatatcaagcccccaaaccgcgaacggccaagacagcgggatggtttgcaagtcctgagctggtaaatgagtttgtcgggcaaagaattgacaaccctcacatgttcgcacaattttgtcggcgtcggagacagctgtgggccaaaaaaaaccttgccgataagccttgccaacaatggttcgtgcagcagcgtgattaccacagatgcctgaatgaatatcttttagcagttgcctttcctcttccaaagatacacagcgttgcaagattcctgatgggcttttcttgtacaactcggtctcatgaatgacatagagtctgctgcgcctggagatctgctcggcttcatttttatcttgagggagttcttgtttggtcaaaaatcttatgaaaggttctctccagtcggcttcgatcatgcttacgccttgagtatccatggcttcaattgtttcttttctgggcacgattggttcgtgaagatgttcgacgaacacatcagaaggagctgcctcccgttttgagccaaaattggccagtctgtcggctgcctcattattgtgccgaagaacgtgggtgagctcaagtccatcgaatttgtcttctaacttgcgtacttcctgtcgataagcagtcatgttatcatcaaggcaggaccactctttcatgacttcgttaacaaccaactgagaatctccacggacgatcagacgccgaatgcccaaagagatcgcgatcctcaatccatggagcagcgcctcatattctgctacgttatgggacgcagaaaaatgtatccacaatacgtagctcaatctttctccagtcggggagattaaaacaaccccagctccagtgcctgaaagcctcttcgacccatcaaaatgcatggtccaatattccatcttttcctctggcatgtcttcttggcactcggtccactcggcgacaaagtcggctaaagcttggaacttgatcgaaattcgcggcttgaaggatatatccaaggacatcaattctaaggcccactttgcgatccgtccatttgcttcgcggttatgaagtatatccccgagtggaaacgatgtgaccaccgtgaccgagtgaccttaaaagtagtgagataatttcctgacggtaattaagactccatataataacttttgaacctgaggatatcttgtcttggagtcggccaaaacctcgctaacgaagtagattggtcgttggactttttgaacatggccgtcttcttcacgctcaacaaccaggaccgtgctcacaacttgagaagtcgccgacacgtataacaacagtggctcttgcggatgtggtgaagccagaactggaggagtagtgagaagtttcttaaagtcttcaaaggctttttgtgcttcgggtccccactggaaattgtcagttttcttcagcagcttgaaaaagggcatcccccgctcgccgagtcgtgaaacgaaccggctgagcgccgccatgcaaccagtcagcttttggacatctttctgggagctcggcggtttcatattgaggatggcgttgattttctccgggttggcctgtatgcctctatgagacaccataaatccaagtagcttccctgacggtactccgaagatgcacttttcagggtttagtttcatcctgaaagcgcggatgcttgcaaaggtttcttctaaatccgcaattagaacatccttctgcttggtcttgacgactacatcatcaacataagcttcaacatcgcggccgatctgagctgaaaaacatctctgaatcatgcgttgataggttgctcctgcgttcttcaatccaaagggcatggtgatgtagcagtaggccccaaaaaactgaggtcttcaagcagttggattcgtttagtcggatctgatgatatcccgagtagcaatccaaaaaactaagtagctcacagctggccgttaaatcaactacctggtcaatgcgaggtaaaccaaaaggatcttgagggcaagacttgttgaggtcggtgtaatcgacacacatgcgccattgcccggtcttcttccaaactagaattgggttagccagccagtcgggatggaggacttctttgatgaagcccgctgctaacagcttggttaattcctctttgatcgcgtccttcctatcctgtgcaaaacggcagagtcgttgtttgatgggtttggcatcttccttgacatgtaaagagtgctcaatcacctctctggcaataccaggcatatcagatggtttccacgcaaagatatctttattattctggagaaaggtgatgagcgcgctttcctatttacaatctaactgagcgcctattacagcagttttggtaggatcggagggatctagtggaatcttcttagtcttggcgtcactttcttgagtcttcgacatcttggtcgcaggcacttctccttcgtttgccacggtcgcagccagtcggatctcttctcgggcgaatgtgatctcgcgggtctgagccatctcgcaactttctttatcacatgtgacggcttgcttgatgttgctccgtagggatatgactcctcgaggaccaggcatcttcatcatcatgtaggtgtagtgtgggacagccatgaatttggctagggctggtcgtccgagtatagcatgatacgctgtctcgaagtcagcaactttgaaacaaacgttttctgtgcggaaattgtcccaagtaccgaaagtaaccggaagagtgatctggccgagtggtgtagcagataatcctgggatgacgccgtgaaagggtgcattacttggctttaattccgtacgagggatctgcatatcgtccagggtcttggcgaaaaggatgttgagtgcgctgccaccatcgatgagagttcttcagagcttgacgttgcgaaccactaggtctagtaccaaggggtactgccccgggtggaccactcggtcgggatgatccgagcgatcgaacttaattgctatctctgaccaccgaaggtattggggcgtgttgggctgaactgcgttgatctcccgttcggttagcttctgctttctcttagattcataggccaggggtccgctgaagatgtgattaagttccttgcgatggtcctgaaaaccagtcgggggatcgtcttcattatctttcttctttgatgtgccttgatctccgtccgaaggcttacgtgcgttcttggcgtattgctctgcaaattgtttgtagacgaagcagtctttggccgcatggttggagttgggatgatgcggacattgggagttcattatcttgtcgaaggtgttgacgcgggaacgttgtcgggaagatggagtagttgtcgccacaagttcttcgggcttacgcttgcgatccttgtgattgttacttccactccctcccgcagccggcgtgtctttcttcggcttccaagtggtgcccgactgtttggacgcagtaatagtatcttcggctttggcatactcattggctttttcaaacatctgcttaaccgtcttgggaggtttgcgtccgaacttgccgactaggtcctcgtggcgaatgcctttagtaaaggcggcgatgatgacgtcatcggtgatgtcggagatcttgttgcgttgcttggagaagcgtcggatgtaatctcgaagggactctcaggacttctaaatgatgttgtagagatcaaagtgtgtaccagggcgttcaaaagtgccttcgaagttggcgatgaagtggtcgcgtagttctgcccatgatccaattgtgccgcggggtagcccgtaaagccaggaccgggcagaatctgctaaggccacaggcagataatttgccatagctttgctgtctcctcctgctgcgcggattgcgagaccatagacagtgagccaagactcagggttggtggtgccgtcatacttctcgattccagtcggcttaaagctggctggccagtccactcgacgcagatcatttgtgaaggcagcaactccgtccatatcgtcgtcgtagcggtctagtgaataatggggagcatggcctcttgctgcgcggcgctggttgatggtgtcgcgaagatcgacggggcgccttcgatgtggggagtgtagtcgttcaactcgacgctccctatgtcgttcgggaggcgagcgaacagatcgctcgtcatgtcccctactcctgtgactggatccggcgccggcgatgctgaggcttggctggtgatagtcttgagatcgaagaggagggactcggcttccagtcggggtgcgggtacttgcagagttggctggaaccgaggcagcgatcatggtcttcgtctggttcaagatgttgacgacatgatcggcctaattgagcacgtcttccttgaggagggtgtcaaggagggtgattgctgcaaccgcgttctgttggggggtgcggaaaaccgctgttccatcaacgtcttgttgcccgatgagttctctcgctcgtcgcccagattccaaggcgcgctgccgtcgatcttcagcctcctttgcaatccgttcactatcttgttgctcacgttgtagtcgttctcactcttgtcgttgtcgttcttcttccagtcagcgacgttcaatttcttgtcgtgtgcgctcttcctccacttctcgggctcggcgctgttcctccgtttagttgtcagccatgaatacgccgaaaaagaggggcgtgtagttatcctcatagctatcgtcgaagtcgtcgatgttgccgtggtcgtagtggtagccgaagtcgtggtagtcgaggatctaggttggtcgtgaactgacgctaggggagctgaggtaaccatccaattcttccgtcgagactgtcccaagaggttggagtataacgccaacctccctggagctagattggatcggggccgaagccggatctcgcctagatcttcgggtgggagatgccttggtggtgaagacagcggccagatcatcaggaagtctcatcagaattgagggataggactcatcatcttgatctggtcgcgttggagtagattggatctcgtccgagtggtttgagaccaactcgggagagatgatcttggagtagacctcggcagagttcgggatactgaacggcgcggggacctggtctcttcccgactggttcgaatccgagtcaaggagagagatcttgccgaagtcgttggtgatgaagtcgaggctgccgaaccggaacgcctgcccggggggaaggcgaagtcgtcgatgccggagacggaacccatcgcactagtcggcaaaaacttgacgcttcccctacctggcgcgccaactgtcgaaacaagatttcggcaatactaaaagggggtggctatcaagctaggaaagtggatgggtttgaagacaaggaattttatacaggtttaggccttcttattcaagaagtaataccctactcctgtccggggatgattccgccgagtgtattattgattgtatattctgggaaaaagaagtcgtcccgaaaggaacctggacccctccttatataggggaaggggtccgtattacaaaatacagtccatatccctaacagaatatgcgattatagataaaatacaatcgtaaccgactaggatctcgggtatttccttgacatacaagttagaaactaacccgagtcctcataaagatattctatcaatatttggtaccacatacccaactaaactaaaactgccgtgtagatatgggttatccataatctccacaatatttctttcaataaatttatctttctgggtgacttagaagagctttttcacaccccacttcctgagcaaggtatagaccaatggcaaattctgtcaaatcacattcagtcaacatttcccaatgggaatcctgatcaatggaattatgtgtggaacccaaatgtctacaaatccaaaaagatgtatgatctcttcttttcgcatatccatccagacatacctctcacccttatttggaaaagcaaaggcacaatgaagataaaggtatttttatggcttctcctgatggacagattaaacaccaaagacatacttcagagaaagcatttcaacactcagggagggaccacttgtaacatctgcaacctgaccatcacaaaagactacatccatttattcttctcatgttcttttgcccaacaatgttggaactatattgggataaattgggatctgtcactagactttatgaatatgatcatgacggcaagaaggcttttccctcaacctttctttatggaagtattaagaattggatgctggcatatttggaacagaatgtgcctatcagattttcaacaatgtgcctatcaatttcagtaaatggaaagtggactttaaagaagattttactcggcatatgcacagagtaaaagtatcagataaacccagttggcaatcatggattaacatcatcagctaattgtcttgttttctcatttctcttctctttattttctttctcttttctttctcccttgtgtatattcttcctttgtacattatgttcctttttttatattaatatagcatagtaggagcctctcctgctgtttaaaccgtcaaaaaagataaaaccaatctgaattgtagatatgtcacgtcctaaaaatcgcttaaattaataatgcatattttaaatcaattttagaaattatttcaaaagcctacaagttaaactataataatctagggaaaatttcaacataaaattgagctagataaaatttcattaaatactttgcttgtttatctattttctagatttttctgggaattatttgagcaagggaagtatttttaataaatgaaatatcatttcacaaattattttaattaaaaaagttttaaaaaccctcccctaagccgttgggccgaattaggccgaacatcctctctccccgcgcgcggccgagcggcccacgccggcccatcctgagccgctgccccgccccccctctcacaagtcaccgacatgtggggcccacatgtcggattcacccccaacctccagccggccggccgagcaagccgagcccgagccgctgcctctctccgccaaattcgcccaaaccattcgcgttcgagtccgattggttgaggggtttttatccccttgttgtcctctatcttatcccccaaaaatcggagctaattgcttcgtgatttatccgaatcaaactcgttttcgagtttatctctccaaaactaaacctagattttcccagctcgatttctctcggttggagtccgatctctccaatccaaggctataaatagcaacccctagtcgtcctcttccgtttgcctcttgtcccacgcgaaacagtcgatcgtagcgccgccaccgcgccgccctagccgccgccgccgccggccgtcgttcagccgcctcgcaccgtcgccggtcgccggaacgccgtcgccgtcgccgacccgagccgcgccgccgttagagctcaccgccggccgctgttcattgtcgtccgtcgtgtttgctagtaccggtgtgttcgcgtcgtcgttctctacgcgtaagtgatgtagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaatttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaacttgatggtgaggccacacatagctgaaggtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctagagctctagtcattggtccttgctgtgcaataggcgtggttgtatcgttggaagggatgtcctcatcatcctccccttcttgcatttgagtcgtcctcgactctaactcatcttcttctcccaaatatggctttaaatctgcaatgttaaacgtggggctaaccccaaaatcggcaggtagct

SEQ ID NO: 58154 - DNA, 1594 bp, Oryza sativa
  unsure (1)..(1594): unsure at all n locations
cagtgggcagttccggcggtggtcagccatgaggtggcgctggcatagacaaggtgcatatgtgatgaatcagggcggtgccagcgttgatgggagccacagacacacatgggagagatgaaggggaggagagactgacgggtgggtcccacgccgtttttcaccgtaggttgccacattgccatgccatgtaggcaaaagtgacgaatagttaagagaccacatcttaaagaagggaaagaaataattgcaaacctaaaaatgacatttggataattgccaaacctaaaaatggtaaatagttaaattccccaagatttgatggtggttggtgaagaaaaggaagtttaatttcattttactttgtaattttctaagaaacgcagtacaaatgtagacgcttataacgtgcacacactcatctctagaaatgcgcgcgcgcagacacactctatccctatagcatcttcggaagactagactagcatattttcagattaacaaatcgccacgccacgaacgtctcactgttaatgggtacatcgcttactattcatcaccatgagcgtctcgttatcgataggtacgtcacctaccgctgaaagaactatgacttgaacccatgtggattaattccaccacaataaatctaactggttgagctacgctcatttcacttgtaatttcatttttttagtgttagaaaaatgaaagtttcattttaatcataaattaatgaattgtacaaaatgtatattaagtttcagaattagaaatgggtattaaaaaaatagtggaattaaatagaagaatgctatgattggttaagaacacaacttacggttataattagttaacaagataatataggtgaataatgcttatacttagaaatttttaggatcatggaggtagttaatggtagggcatagcagatgcacgtgaaatctggtaggcctagtgcacggaactacgtgcaccgggagctaaggcaaagattaattaagtaaggttgctatacttaatcgcattgaaaggtgttgttatccaatttgatggttcccagctgcacgttgaagctaattatgacgctatcatgggttggaggattattaatttacgaatggccaatcttgaatagtagaacttttgggagcaacgtcgtacactcatcaactgtaattaaattatataatccgtagtagcagttgagtggaaaatgaggtacagcgggaaattttatatatcttttaaaccatttgaaataaaatttccaaaatatatttttaaaagaataacttttactcttgcaaatattggagaggctctaattaaaaaatggcatgacaatataattaaccttactaccttaataacgctgtcattgcatccttatcactgccatgtcacattcttttagcccccgtgcggtaacattatttgttatgctaagtatactgataaggtttatttttacaactatataattttttttaagaaaaacactctagagctgctatattcttatgtattccacttgactttatgtttttgacatggcaatcaaagtccaacaaagggcgggncgcaggaa

SEQ ID NO: 58155 - DNA, 1261 bp, Oryza sativa
cttttttttgggacggagggagtacaacccatatgagtggggtagtcgacccagaaactgcaggcaagtcaaatcagcaacgaacttggcgtcgcgggggaaccggcaactgggcaagtcaaatcggacccaggcgacgtacgaaagttgtggcaaaaacatctttaatttttacaatagtaaagataaagataaagaaaagatagagatatactagaaaaaatgccgtgcattgcaacgggtaaaaatatttttttattgatacattaactattaactattaggagctaagcaataaattgaaacgttaggatcggtatatattataatttaaaaagttaataaaaatccttcctttagttttaggcccaaattggtcattcattccttccttttaaacctaacctagtctgatacctcgtcagctcatgcctatgttcggcatgcggcttcaattgtggactgggcactcgcactcgcatagccactactattttcaacctctagcttgcatagccactaccattttcaatctccgaaagacaatctcgtgtccgtatgatgccggagccaatcctcccccattaaatccgatcgaatcttttttgatgtcctaaaattgatgggggcttttgatctactcgatcttctctgtccggttttcccaaaactgaagagaattcacataactcgggataataggctggagaagcttaccggttggtcatcttcaatgcagattaaattcgacaaattaaagctaaatcaaaagggaaaatcataggaaaaatgatgaggaaggagtgaggaatctttttttgcaatcaattagaggaggaaatacatgggagaagcagatcgacgtcgcgacaacgctagggtttggcacgggcggggcggaggcgcgctgcacacatgggatcgcgtgggaagagatatatggaaaaatattaggtatagatagatttagttatacataataactataactatttattacctaataacttactctatggcctatcacatttggaagattatggctagtcattacacaagttacttttctagtaaaagaaattatacattacttgggccggggccatgcaagcctcgatgatttcagcccgctcgttgtccgttatatgttaatctatccgatacttgtaatacttttatttcttctcggtaattaaccgaataagcaaactggaacagaatcggatcgggagacaagaaaaattgacgacgcacgaatatt

SEQ ID NO: 58156 - DNA, 860 bp, Oryza sativa
tttggctagtctcatttggatatgaaaataaaattgatgagaggtatgtattaaacttcatatattctaacttggtctctcttgtggatccaaaatatagtgtgagctccgtcattgatcttgattgattatgtgcatatgcgttcctttatatccatatgtatgcatatcttaagggggagtttattttatattttgtttattataagatctctagcttgatttaaaattatcgttcatctcatctttctatattgttatatccagttattatctatcactaaagagagaaaagattgaaagatctgggattaaacaatttgtgtaattgttactttggtgatagatgataaaccaatgtttatgggattaacctctcttttttataagttgtcaactaggttatttcccaatgatgagatgtggtagatatgcattctttggtgatggaccttaatcatgataaggatgaaatgcatggagataaagcgatatgtatcacttcttactcctaccttttgataggttcatatatatatgattttcatgttattgttatataagtgtgagactaatgtttacttgagtcttatcttatttagtctcctttacattgagaacatggagatcatgaaggtatgtgtttttgtttatcattatcattgctacatgccttctccatgtgtataggataaacctcattgcttcttctttacttatgcatacacttgcccctcttataaatttatttgtatgcatatatttggggggtgcaaatcctattcatttattgggtatgttctatatccatgttattctcctcttatttatatcggatctttgcacttgagcttgcgtac

SEQ ID NO: 58157 - DNA, 4136 bp, Oryza sativa
gatatgcaattttctcgctaacaagagatatatccaggtggttttttcgcacttatgtttgtttatccacagcgagaaagcaggatatttctcccgtcgtgaaggaagagcggaacattatcgatctaaaatcgttctctgcgtttggatggttcataaccgaattgagctcagattagtagcctcaccggcggctgtgttgcagataacgatgaaagctctagcatatggagaattccagttctaaggtttgctgcttattttccatcttttggattcttttcttgatcgtttctgttcctaattcgttttctttatattttgcatttgcagtcctgcagcaggtgcgaatgtatcaggtggtggtggctctcgtttatgttttcaccagaaacgatcaggctggacgataagaagtcatgttctgctcccagttctgccgttcgccatgttctgctacatctctaaacccaaatacaaacagaagcagaaactaccaaatctgccacatgttctggtcctcagaaatcagagagcagatcatgctctgctccaaagcagtgcatgtccatctctaaacccaaaaaaagaagtgatgttctgctcccagttctgtgccatgatctgctacatctctaaacccaaatacaaacacaagcagaaactacgatccatgttctgctacatccgcagaagaagcagaagaacttgtactgctccaattcacggattcgtccgacaaaaaactacaccacagactcgaggcatattctgctctcagttcacacgacagtcagcaactacgaaacaaaaagatggggcatagcggacaaagatgacaacagagaatttggataacacaataagctaaaatagctaaaaaaaacgaaggaaaacttcttatttttatttcactccaacgagcagaagttacagaaaactcaactcaaatattagtcgcgtttctctcatagaaaatatcatacaagactatagatagttcgtacgtctaatcaacgatcatgcagaaagcaagccattattccatatgatctgctcattaaacaactggctaaatgttctccttggttacatgttcgatcggaacaacttctgcggcgccgggggtgctccgcagcttctgaaattcatgttgcaagctgcgtgactatttctagaaatggatgtcaaatttctggagagagcgattcatcacttcactcctgtcaccagtagccatgcaatgcacagttgcacaaaaccattcctgaccaaagaacgcaacacatagtcagaaccaaacacacaaacaagaggaaaattataaagagcacatcaaccaattcgaatcttcgatatgtaccaatcagttgatgagttctgcacacactcgtgtccattcaaacagacctccgtgctcccgcaccgcccgcttgtgctgagcaaaagaattcgtcggcaaggatcagcctttcgccaccgccggcttctgctgcatgtcaccactcgccgagacgccgacgcggttccaccttcttccaccgtcggcttgtggtgctcgcctgaactcgccggcgaggacgcaccaacggctaccgccgccttctgcatgcgacatcatgtgtcgacgaggttccgccttctgtcgccgcggaaggcgatgcaacagaactcgccgacgagtttctgccctctacccccaaaagattctgctccatcaaatttctgcagaactgatctgcttctgctcacaaattcctcctcttctgacctacctcgccgccgttttaaatagatatcccggtaacaacctcaatactaacaacttccctaatcaaacggccttgcatgcgtgcagattagcaagccttgcatgcagaactttcaaatggccttgcatgcagaacatagcgccacgaagaccgcgcagtgaacatatttttgcaaaataagaaaaatcaatatttgattttctgccacagtgggttagtggataccttctctcctaacatgagtggggcgagacccacaacccgataggaggtggacaggtgttggatggctactataggaggtggacaggtgttggatggccataagctcgaaggtgcaataggcttggctcgagcctatgtcgagctcaagcttggacagacgagctcgctcgaagctcgttgacagccctactctagggttgcgagagagggagagaagggtcgcgcgtgtaagcggaagagagggtcaagggaggagctacggccgcgcgggtgtggagtgggaaagggagagaaggttggagcaatccaaggcgttggatctacgagaaacgatcttgacctatcaatgaggaacgaggagtgtagcactctgttcgtaatttaaataacaggatagatgtgatttgagggagactatattcctttttctgttgcaatgtacatgcacttaactagtgttcaaaaaattgggtgcatactgaaatgacccgatatggtccatactccatagcctaatgatggcccgatttgtgtgcattggctggaacttaattaggaatcgggcatataattgtttcctcaaaggccgatatagtcatctccaagttgtacatggaccggaccgataaaaaaaccgtgccggcccatgagcaaggaaacgtatagcaatgtgtaaatctccacggtgatataaacaaaattgtttcgtctgtgagtatttctttttcttttaatcgtttcctccatgaattgcttccatctatttgcgtgataaactcaaagtcccatcgtttcacttatgcttatacttataagctaaaatttaaatttaaaaacttaattttaaaattaaattagtggtgttcttctcataatttattttacatcatttggtttttaatcgctaagaatgcgtacacaaatgtttttcaataattttattttacacaagcgaatgtttttgccctaaaatataagtatagattaagtgaaacgatggggacaaaaatttgacggaaaaaatacaaattatgacgagtttacgacagataactccattagtttttttgtcgggtccatacacactcaaacatgcacctactatcaacctagctagtaaaacaaccttcagttggcttcattcgtttggattttacacgatgcccaaatgaccccatttttggccgatagctagttaagaaactcaggtatcgtaccacttgttccctcacatgccgatatatatggcattttcgaattgtaaataccagagcaaggcggcctatccgcctatgaggtaagagctcactattcgcacttcctccgatcaaatatttacatttacactagctaaaacccatgcattgcaacagatattacaaaagataaaagcaaaagaaaaattacaagtttctagcatatttagttgattatgcatataatgacatatccaaagcaaaagcattcacgtgtggggactttatgacctgacctcgcatgtcagcttgtgttgaaggcggactcgaccaccactagcttcatttaaagtagtatagatgtaaagtaaatttcacaaaattgtgagtattatagtcctagttatacaaaatcattgggtttaatttagcacgtgacacacaataactgtaggtattatagcatagccctaggtatcatggccatatagttttatataaccacatatttgaccaattatccttgatccacaattccataaagatgttattgtcataagtgcattaacggtctataaattattgagtaatgtgctacgttactgtacttacgcgataatgttactactgaatcatagtaattagttataattttcacagtaacgtaagtgatttgttcttacaaagtttgaacagagatatagaacaagcaaacaataacatttaatcacatagaatcaaatgatgaattgattaaaagagcttgcaatgaatcataaggttattggttcaactcttgatttttgccattttattttttagttttctctccaaagtgaattttctcagagggagagagggaataaaacaaagagaggcactgggaagaaaagagaacaaggcaacgggggcgccaacacgaagagaaacataaggggagata

SEQ ID NO: 58158 - DNA, 1738 bp, Oryza sativa
cgattcgtgcccctcattcctgggacgaatcagatttgctcattgcttacactctgcactaatatattaggggaaacatttgcgtgcgccggaacactagctagtttatttcaagattcattctttcattcgcattcgcatctggattctagacggactggatgtgttcctgttacttcaaaagatatattttacatttttcagactacaactgctccaaccctttgccaaacttctcctatcgctctagcagtagcagatctccgctactccgatccgtccttcccctcgaattgaagcactaatccctcttgcacacgccctagtactagtattactgcctgcctagctctgctcacctctgcttctctttccaactcgcgaatgctagcctccatcttcatgcctgtctctttactaacattatgcctccttttacttgtttcaggttatcgcaatcaacaagcagttccctggccccgtcatgaacctcaccaccaactacaatgtggtcgtcaatgtgctcaacagcttggatgagccattactcatcacttggtcagactcaatttcctcccccattccattatattgttcaacgctcccatgctgacattcactcgcaatataatgtgctgtcaatgtgttgactgacccatgtcttatttcaatcagggatgggatccagcaaagaaagaattgctggcaggatggtgttcttggcacaacctgccccatacctccaggttggaactggacctacaatttccaagtcaaggaccagattgggagcttcttttacttcccaccccttagcctgcagcgtgctgctggtggtttcggaggtattactgtcaacaaccgcgccgtcatttctgtcccattcgacacaccagatggagatatcaccttgttcattggggactggtacaagaagagccacacggtagagagagaaaaaaaaaacctaagcctattttccaggactcatcacatcaatggtcatggtgctgattgtgtttgtcttgtataggacctgaggaagatgctcgatgatggaaaagagctcgggatgcctgatggagttctgatgaatggcaaggggccgtataggtacaatgattccctcgtccctgctggcattgaacatgagactatcaaagttgaaccaggtgattagtcctcccacactttcagcatgataagctaaactagtccttgtacatgttgccaaaaaaactgctcctataagtctatctctctgctgctgctaccagtatttttgaatgtaacattgaattgtacaatgtgttctcactgctatgttggatgaatgaaagtgatagttcatcatcacttccatgacagggccaactaaaatttctttgaacaatgattgcctttgtttattctcatgatttggtaactgactgctcaaactccgcaacaggaaaaacataccgtttccgtgtccacaatgtgggtatatcgacgagcttgaacttcaggattcagaaccacaatttggcccttgttgaaactgagggatcatacacaatgaagcagaatttcacaaatcttgacatccatgtgggacagtcctactcatttttgatcaccatggatcagaatgcaagcagtgactactacattgtggccagtgctaggtttgttaatgaatcactgtggaccaaagttaccggtgttgcaatcttgcagtattcaaattcaaagggaa

SEQ ID NO: 58159 - DNA, 662 bp, Oryza sativa
aaaacattgctaaaatttcgatgaatgcgcacaaaaaaacagccatatacaccaatggttaggacagcattgaaagatgtaacggtaccatgaggggattcggaataatcaatctactatagtatccatgtaaataaacaacatgctcctaatgacgaaaacatgtctaaatgtagtcaaatataatacaccaaaaatgaaggcgctaattaagcgtctaaatgtagtccaatagaatacaccaaaaatgaaggcgctaattaagcattagaccaggagcagaaatgcagatttgaacacggggtcttccggctagctccacaaggtggtgggctagacgacctgggttcgaagcctcaccccttctaattatttgatattaggtccttccctaatattcgtggttttttttcagatttgaacacataacacgcgtttgcataacgaatataaagcatgtaattaaaggcccgaaaatcaggggatccccccgcgacgcgaacacaatagcccaccaaataattcaaaccaaagcatcgcaatctgacgaaacgcaagcaatcacggaggacgaatcatgtaaatgccctaacaaaacaaaaaattaggggattgaggggatcgaagtctcacgcgcggccgaagaagaggaggaagcggtc

SEQ ID NO: 58160 - DNA, 1397 bp, Oryza sativa
tggtttccgtgtccaacgtttgaccgttcgtcctatttgaaaaaaatatgaaaaaaaattaaaaagacaagtcacatataaaatattaatcatgttttatcatctaacaataatgaaaatacgaattataaaaaaatttcatataagacggacagtcaaaattggacacggaaacctagggtttgcctttttttgggacggagggagtagaccttaagatttgtcccaaaatataacaatttctctaccaacattctcttcccaaccaatcacaaccctctactattcgcttttttcatctacctccaccactcatccaattacaaccctccatcgttcacttctacctactttcttaataaccgtgtccaactctaaaactttttatatttagggaccgatggagtactaatactcctcccgaaatttaggggccatttggatgagtccctgtcacatcggatgtttggacactaattagaagtattaaatgtagactaatgataaaacccatctcagaactctagactaattcgtgagacaaattcattgagcctaattaatccatgattaacctatgtgatgctataataaatatgtgctaattataaattaattaggcttaaaaaatgtgtctcgcaaattagctcacacttatgcaattaattttaatattaatttatatttaataattttaattagtattaaacatctaatataacatggacttaaaatttagtcactatatcaaaacaccacgcttaaaattcaagtggttctaccccgctactacacctccacgtggttcggcacctgctggccgggccaccgtatctcgtggcctatagacccggcctacattgactatccaaccccaaaccgctttactttctcatcacttctcgtcccccttaattaatccctgattacgagccctcatttcctccccccgcatccgtccaccgatgccctcattcacccactcacccccatcccccatcccactgacagtgggccccacactcttctgtccccaccgctcagcgaaacaccgtaggcgcacacgtgaagggtacacaggaatgcgtcttctctgaattcctctcacaattcctcatctgcaaaggaggagacctcggagagccggaggtggtagctaatggtggtggaaagccaacccgctttgcgccatctcccactcgcctcccgctcccgatgccctcgcgccagccgccgccaccgccgccgcctccgccgcctcggcctgacgtcgcccgccgccgctcagtagctgtcgccgcggcggcgggggcggcgggggctggggccgtggcggtgctggtggtggtcgcgctgctgtggtggctgaggaggaggagggggaaggggaaggggga

SEQ ID NO: 58161 - DNA, 3482 bp, Oryza sativa
taaccctacatacacatacaagccccgaatcgcgcggcggtggctcctctccttccccctgccagaaatcgcagcagcaacgaaatcagaacgaggcgcaggaagaagaaaaactcaccgaagcagaggggatgggggggcaaatctgaggtgaaccaggagcggatggatgagcagtcgaaaccctaggcgcgcggtgtggaggatcggcgggggcgggggcctgaatcagaggcgaggcgaggcgagggagcggtgggttcgcggcggcgggattccgggcgatctgctgctcctccgactccgatgagcgaaaaaattgagaagagcggaggaaggaaggaagggtgggaggaagctaagcacgccccacgccgatgcaacgaaggatggaagaagcagacagctgagagaaaaaaaaaagtcggtaataagaagaagaagaaaaagaaaattgtactgtactagtgggctcggcggatttctctctcttctgggctattgggcctgggcttgtatgtagagacggacggcccatggaagttaggcggaaaggggtgtggggcccagtgtcagcgtcagcgggggaactcgtggacaggagaagaacccgcgatgtgatgtctttcttctcactccacgcaccattttcttcttcttcttcttcgtcttcgtcaccgccagccaaccacctgacaaagcaagcaatcgagctgagcaccccaacccaaccctaggcagaggctgaggctgagcgagatcgcgggcatgagctccgcgccgcagcagttgctcgattcgtcgtctccggggccggggccggggccggaggtggaggacgacgggggaaggagggtgaggaagccctacaccatcaccaagtcgcgggagagctggaccgaccccgagcacgacaagttcctcgaggcgctgcagctgtaagcatccatgcgccttcttctaactcttaactgctgccctgcctccatcttctgctacttctccatccaatttcatatgccgttttgcctgctgtatcctactactgttctagttcgattgttattactggacatctaaatctaattctaattcctcaatttcacttcgggacaacaaaatactagtattagtatatacttcttctttgaatcctaacgctcacctggatttaattgctcactcatgtgaatgctaaaaatgcctctacttcatctttactgcccatctaacttgctttatcttcactggaccacttcgaattcagtatgatctctttactccgaactacagtaccaagtagcaactctctttcaaattagttagatgcagctctccatcatcaactatcaactgctaacaacaaagggatcatttccccccctatgatctttgaattcttatcttgtggcaaacattacgagtggggttttaccacaactgaaaaatggttccttcctacttattctttgcattctttacttgcttttactataacaggtttgatcgtgattggaaaaagattgaagcatatgttggctctaagactgtaatacaggtatagtttatagctatctcaacttccttctttttttttgttttcttctttagttggttgcctttgttactgaatatttcagagttttacaatttttaaatctaccgggtaccaacttcaacttaaatccaatttcaagctagcagttttcttttttcagtaccatcccgccatgcttcttctgtgatgctacaaatatgtgattgtcatctattggaagcttcttcgattatccacaaagcaaaatgtggcacttttctgttttcattagttgcgtgctgttgcttcagatgcttaaaaattaaacacatattaatgtaatgacatggctttgtttgatttagcaatcggtttgttggtagttaaatttcctagtcatacaatctttcattttgctgcaagatgtttgtttggcaatcttgttttggtgtaggatctgcattcgattgtccgtttaacaagatataactcactcactctcaacttattactccaataagtaaatgaacatgtttgtttttgcttaatagtaaatcggtaatgcatctgacataccgtgcatgatctaaaatacagttatcttaacagatcagaagccatgcacagaagtactttttgaaggttcaaaagaatggaacaggcgagcatttgccccctcctaggccaaaacggaaggcagcacatccatacccacataaagcctcaaaaagaggcaagtttttcatcctcacctgactagcattttcttctttacctcttatttttgggtcaaaggcggagatcttattataaaccttggagttcttgcagcccctcaagttgtcctaccacaacaagcttctcatctaatggagcaaggctgtcttatacctatggacatatctcctgttgctagaaactttaatgcaaatgatgtattttcttcctgggatagtgctcttgcccaaagtttcagtccaaggcatacacatggtatataattctgccatcattgtatttcccattttcaaatgttaattttctacagaatactaggttataacaaatccaacatattcaggtgcagcaaataattgttctagtagcgtagagagccaatctggaacttgtccaacttctgaggcaattgagcaagagatcatgcttccaacgctgcgtggtaagctgcctgtttcactgcatgcatttcccctccagagtttctacacagaattctaaatggtccaacataaggggtttatatattgtgtaagtgtgttggggtagacttggccttccttgaggatgcaaattctgagtattttagaaaatatttatagatgggggtggaaacctgtttgagattcaactttgagcttctctggtcatctgtttccgctccgaaatggaaggtttggatctatcttttgtcgtgagggataacataagattttaggccacctttgcaagatgcataagactacctttgtataaagggagattactgcctccagcctctgctcctaccaagagcattggaatacctatatatctgcaactaacgagcttgagactttgagtcaccttgtgctgatttcccctgaaaatgagcctttttttagaatttcaattactctgagtctcattagatccttaagttcttgatgtcaattgttctgtttggagattctcccttttctgcccttctacatctgtttaccttcattttgtccttcaaattctcaagtcttgacataatactcctggcatttgactggtgaatgctgttatgaccttactaccaaagtgaaaaaatggatccttgccgttttagcttcctatacttcctttgttggtggtgttaatattaaatcaatttatttgtactctacatgccccttttcttcattcatattctgacttctttctttaccttgcgtcaaaa

SEQ ID NO: 58162 - DNA, 3040 bp, Oryza sativa
tagtcaacaattttcttttaagaaaatatgggacccacctttcagattctatctactgatctgtatctttttcccctctcacctctctctctatctctctatccctggctgaggagtcgcgacggctacgagcctactcttgcgcatgctagcggaggcccagtaggagcggcgatgactacggggctcctcgcgcaagtgccggcagagactgagaaggagaagtgtgagtcctcgcgcatgcgccggaggaggctgagaaggagtggcacaggctacggggcatcttgcgcacgcgctggcagaggccaaggaggagcggaggtggctacaagcatcctcacacacgacagtgtcggtgtgcgtggtggtggagatgacgtggccaaagcagctctagtcatgaagctcggcgagacgtgctacggcatcactactggggaggatgcgacggagagggtcgcattggtgcaagttcgctgctcccatgtcgacaagcagtcgtccgtccccgtgccgcccgccacccttttccttgctgcctgcttccttggagataggggaaccagaggtgtggcgggagacctggggcgcaaggtagtccaccagggaatcccactagggctgtaagtgggtcagccgcgaacccacttatagatcaaaataagcgggttcacggcttattttagcctataagtgggtttcgcgggttagccacttacacccctaaatcccaccacctattgcccttcccatccgctgcctgtagaccttctcgtgtcctccctcctgccttccgttgcgtcttctcttcgaatcaattcgttctttcccccgctgacctttctagtccttcacctgccaccgccgacggccagctcttgtcccggcagttgccttggtaattgcaatgtcaaatactccctccttccaaaaatatgagacctatttcttgttgcatcaatactaagaagcaattaactcacttgtcatatggcaaaaccaatgaacatgcaaccaataagtagtacttatggctacttggtttccgatccacaatttaatttagtatatagcgactacaaataggacttagatttttggaaaacccaaataatgaaatagatctcagactttaaagagaacatttattaattactttgaagagaatattccatgtactacatagtactagttcataaaattcatcaactaacatgagtgcagaacgaacttacatgaatctaaagggagaaaatattcccagaaaaaaatagttgaactccaacataaattccactcgcattgatcaaatcatgcagttcttcatttcagaaacgtcctcatgcacctgggaagcgcgttatcatacttgtcaagatcttcctcgtagcgggaaggaccggaataatcatcatcatcatcatcaaattcctcagacgtccattcatccgagtacatggaatattccggatcagaatacaccgaataataccgcacaaaaccgggggagatggggagcctcctgggagtgtacacatcgaagtcatagtcatcagttgagtcatcaggtggcctcagcatcttgatcctgctacattttgctcgcagggagtcggcgcccatgtcgatgttgaagcaatggcgaatgtcaagagactccaggttggggcagttatccaagatggttgagagaccttcatttgtgaggttattggcgaagagctgcagggagcgtagcccgtgcatctttgaaattccaccagcatcatcgttgtttttccagcggatacctcctgaatcatagaaggatcgtttgctaagcctgaagcgcttgagctgtgggcatgccgcgccgatagccgcatacgcctcatgagtaacattgtagcagaatgagagctcaagctcctcaagaagagggaattcctttgttgcctcctcaattccttcatttgagacacccaagcatgagatgagccgaaggctcttcaaacaggaggccctacaaagatagcacagggattttataactaccagcaatccaatcgcatcagaaaatatgctgataaaaactgtctgaataaataaactacccagctacaagttcacagttagataaataattggaagaggcgacaatgctcaatgtagaagagaacggattatgatgaaccaacttctcatatatcagttatttggacaatgactactgaagtactgatacggtaaatattcactttattgtcatttcatttctgtcctgtggaagatagcaggaataagaaatggccatacttgcaaaagaatgccagtgcaatattggcaacaaaagttcatcaataatatttttagatatgtgtatgaacacaaaacccagtccagtccagtccatgtcatgattaagaattattcaaacttcaaagcatagtctgatgaacagtttgtctgttagtttgagtgtatgaagtctgcacattcttctctggaataatttctgaactcctaatccttgtcagctaaaagtatcattcttttccttgtcagcaaagcataactgcataatctgacacagaaatttgttgtgactgctaatcctccgaatagattcaggtaccacttttcattctgtatgtcaataccctactagctaggtaggatttttcactatgtttatccaagatagagatatattcaatttctttcaacgaaccatccttatgatcttatcagttatcacccttttttttccaaggacatgatctgatcacattgttttcctgctaacaccttacaagtatatcctcctattccaaatattgattgttgcggtgtttgtcgttaactactcagaatgactggcggaagaacacattacatacgaattcatcatcgaaatttgatgcaactttgcaacgatataagctgacaaattatttgatctacaacttcaagcggtattaatttctacatagcatcaatgttcttctcttcagattaaattaaatatggcaaacttattgagagtgcctaagcaaat

SEQ ID NO: 58163 - DNA, 3518 bp, Oryza sativa
gcaacaatcaatatttggaacaaattctggaccaaatctacctgtaatgttgaatggaggcaacagagataaatcaaacagaagatccaaattcaacatgaagacaactaatcaagacagctaaaagagaaattctccaaataaaggcgacatggatcaaaacaatcaaatatacatattaaaatcagtgtgcttactgctcggtgaggtacacgaggaagccatcgtcgccggcgtactcgccgcagaaggcctcgcactggcccgcgctgcggcggacggcggcgcaggccaagccgccgcggttgatcctggcggagagcgcctcggtcccgcgcacggtgatgcgccgccacagcgcgggctcgtcccgcgcggcgcggcgccaggtggcacacacctggtcggcggccatgaggatgtcggcgtggccgagcttgtggaagatggccaggatcgcgtccagcggcaggccatcggcccagtccctcgcctcctcctccttcttcttgcggcggcggccgcggcggcggcggcggcgagaggaggaggaaggcatggcgtggcgctcgcggggtggggttgcgagggttagggtttggtggaggaaggcgcgcgcgaggtggaggggttcactgggttggagttgaacctgtgattttgtgaggatccataaactccgtcgagtttggtggaaactttgaaaagtccacaaagtcctacactacaccctttagcctccgccccagaataagtttatttatgggttattatatctaacatttgaccgtctgttttacttaaatttttttattattaatatttttattgtgaaatggtaaaacatgaataatattttgtgtgtgacttaagtttttaaaatagaatggacgatcaagcgtcggacatataaacccacaaataaacttattttgagacggagggtgcatatgggattttgtttgggtttgatgtttttatgggttcagatttattgattcatttttttcttggtaaaacactggttttttagcggttgttttagataatatgttttttttacaggattgtgtttataaatagtgggaaagtaggatggtgggggagtagtagagataaatctgaaaataaaatcacaaggatttctaaccttataatttactctgtggttcgtagagaagtagaagcttggtctttgtcaacagcgttgtgaaatagagtatggtcatcgaacggaaatagtatcattcaataattaataggaaaacagattattaactagaattttacggaactttgacgtttgcaaatatatatatgtatatattttgtaatattatttacgtctttggagatttaaatgtacaactatataaatgaaatatgttgatgcttttttaaggccgtgttctaaaatgggatcggcttggctacctccttaatttccattagtgcgcttttttaaatattgtttcgtttaaaaaattttcgttacagaagttgctttaaaaaattcaaataaacttatttttttatttttcacaaacactgctcgacagtagaccaatggccagtggccgtggactcgtggcagccagccccgtaggagagaggaggatggtgggcttgtatattatggtcgtggattcaacctttataatttctttctttcaagtaattcgacttcgatctctcttactatttccttttttacatgttgaggatcgtaaatggcaagcaaggataaaaaaacgcggcacacttagctttccacaacaacggtgatcatctataaatcagctctgtcatcatcagttcatcactctatgatgctttcatccgtactagccactcaaaatcgtacgtttgcgcgaccatatgagaagccatctttgttaaagatgaagattttttctcttgcaattaaaatgatctttgccctaaatattactatgaagttgcccatatataggtcacatatataaccaacattttttaatagatgacgtcgttaatatatagacacatggttgaccaatttttcttattaaaaaattacatatttgtaatttatttggtgtgagttgttttatcactaaaagtactttaaacatgatttatatcttatttatttgaaaaaaaattgaaaaagatgaatagtcaaacatatatctaaaagttaatatggcatcatataatacaaaaatggagatagtatttgcttcacttggtccatgtgttaaatttcataagtacccaacatatgaaattgtggaccattaagttcccaactgtgttgcttgcttacttttcatacttgccaagtgggtgacgagagacactagaaggctccagagggataatgcacgtacgtatttgatgattgatcagacggtcatcatttatccaatcatgtatccgatggtatttgtttttcagcttaagtggcctaatttgctcctgagaaagattagttttttcacgactttagttgatgtttctcaacttctgaagatgacagcaagctagaactcatctgaagatgttccatcaccaacatacatgtcattggctgtttatgtacatccggtaaccggaaattgtagaggctggatttatcccattttgtaaagaaaaaaattcactctacatatgtccatccttcggctttcaggtacctgcgatcacccttgtcgagcatcctgcaatcctgctcctcatcgaattcattcacatgaacgtcatggaggtagcgatgaggctccaggaaatactccgacttcaagaactcatccaggccgtcgtcgcggtcctgttcgaagcagatgctggaccacggagaaagatcgccagtgaactcgtcatcgccatagtcagtgtcggcttcttcgtccttgccattctgcgccctatcggcttcttcttcctcgccatgcgaccgtatctgaatacttagagccctattggtttccctaataaatcaaagccaatgctaaaatttgaatttttaaacttaactttcatatctatttttaagttattttcaatgtatttttttcagtatttgatttagaacgcacatataaaagtacttttattctataataaattgttttgacttattaagaaattagagtaaatttcacaaaactacatatacttatgtcaaattatcacaaaactatagatttaagaatgtctatcacaaaactacagatttagcgttaaacttttcacggaactacagatttaatgcaccatatcacaaaactacagatttagtgattaagttatcaaagaattacatattctagagcttagatcatagcactattatttatttaatttaaagttataaaaattatagttttgtgataaaatagttttttaatgtgtagttttgtaataaaatagttgttaaatcaatagttttgggatataatatcttaaatctgtagtgccatgataaatttaactctaaatctatagttttgtaaaatacattcttaaatatgtag

SEQ ID NO: 58164 - DNA, 25905 bp, Oryza sativa
  unsure (1)..(25905): unsure at all n locations
cactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcaaaataataaagatatctttgcgtggaaaccttcggatatgcccggtattcctagagaggtgattgagcactccttacatgtcaaagaagacgccaagcctatcaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgttgattacactgacctcaacaagtcttgccctaaagatccttttgggttgcctcgcattgaccaggtagttgactcaaccgccggctgcgagcttctcagttttctggattgctactcggggtatcatcagatccgactgaaggaatccgactgcttgaagacttcattcatcacgccttttggagcatactgctacgtcaccatgccgtttggattaaaaaacgcgggagcaacctatcaacgcatgattcagagatgcttttcaacacagatcggccgcaacgttgaagcctatgtggatgacgtagtcgtcaagaccaagcaaaaggatgatctgatctcggatctagaagaaaccttcgcgagcatccgcgccttcaggatgaaattaaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaaggcttggcgagcgggggatgcctttcttcaagctactgaagaaaacagatgatttccagtggggacccgaagcacagaaggcctttgaagatttcaagaaactcctcaccgagccaccagtcttagcttcaccacatccgcaggagccgttgttgctgtatgtatcagccacctcccaggttgtgagcacggtcttggtcgttgagcgcgaggaggaaggccatgtccagaaagtccagcgaccgatttactttgtcagcgaggtcctagccgattccaaaacgaggtaccctcaggttcaaaagctgttatatggtatactaattactaccaggaagctatctcattactttcaaggtcactcggtaacggtggtcacatcatttccacttggcgatatcctgcacaaccgcgaagcaaacggacggattgctaaatgggctttggagttgatgtctttggacctatcattcaagccccgaatttcaatcaagtcccaagcgttagctgattttgtcgccgaatggaccgagtgccaggaggacaccaccgtgaagaagatggagcactggaccatgcattttgacgggtcaaaaagactttcgggcactggagcaggggtggttttgatttccccaactggagaaagattaagctatgtactttggatacatttttcggcgtcccacaatgtcgccgagtatgaggccctccttcatggactgcggattgcaatttccctagggataaagcgtctaatagttcgaggtgattcacagctggttgtcaaccaagttatgaaagagtggtcctgccttgacgacaatatgaaggcatatcgacaagaggtacgcaaattggaagacaagttcgatggactcgagctcagtcacgttcttcgacacgataatgaagccgccgatagacttgccaactttggatccaagcgcgaggtggcgccttctgatgtcttcgtcgaacacctttatacgccgacagtacctcacaaagatactactcaagctgcgggcattcatgacgtagctatggttgaaaccgactggcgagagcccctcatacgatttttgacttctcaagaactccctcaagacaaagatgaagccgagcggatttcaaggcggagcaaactttatgttatgcatgaagctgagttatacaagaaaagcccttcaggaattctgcaacgctgcgtatctttagaggaagggagacaattgctgaaagacatacactctgggatatgcggaaaccatgctgctgcacgcaccattgtcggcaaagcttaccggcagggtttcttttggcctactgcagtgtccgacgctgacaaaattgtgcgcacgtgcgaaggttgccaatttttcgccagacaaattcatctaccagctcaagagttgcaaactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgagacttcttcatcaacattgtgcatagatttggagtgcccaatcggatcatcactgataatggcacacaattcactggtggagtttttaaagacttttgtgaggactttggaattaagatttgctacgcctcagtggcacaccccatgagcaatggacaggtggagcgagccaatggcatgatacttcaagggattaaagcgcgtgtctttgaccggctaaaaccctatgccggcaaatgggtgcaacagctgccatcggtactttggtctttgcgaactacacccagtcgggccacaggccagtcaccctttttccttgtctatggggcagaagcaatgttgccgagtgaagttgaatttgaatctttgcgctttcgaaatttccgtgaagaacgctacgaagaggaccgagtggatgacttgcaccgactggaagaagtccgcgaggcagctttgattcggtcggctcgatatttacaagggttgcggcgctatcataatcgcaatgttcgatctcgtgcctttttagtcggtgacctggttttgaggaaaattcaaactacacgagatcggcacaagttatctcctctatgggaagggccatttattatctctgaagtcacccggccaggttcttatcgactcaagcgcgaagacggtactcttgtcgacaactcttggaacattgaatatcttcgtcgtttctacgcttaagtttattattgtacttccctatcttgactgtcaacatcaagttttcttcttgaagttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtatagtacaaattatgcctccatttgctacatttacactcagtcagaatcagtcctttcatcatcagagttattattgcttggctgaaggtcgttgttgcggaattgctctacaacatcacttgcaatcttgtcagccgcactttgagcattactgataagatcaagagcagcttcttcacttgtcccgtctgcaaagccatcaatggtatcaatttcaatcctcgggtacaaggatttggtcatcgccaatgccatactagctcccatacttccagctttcttgatattcttgaaatatacatccggtgcaactctcagcttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgagatttgattttacggtctacaaaacacatttataatgagaatctgctgcattaaagagaggacagttcaaattgtcagctggcagtaccttcaacctccttcaaggctgagtccctttccgcagccaattctaccttgtctcttttcaaggcttcaatttgcttttccatctgagccattctggtggcttgcgctgtttgaaatccaaatgtttgaggatacagttatgacagcataaatcaatggaacagatctggaagattaccttttgatgaaccactcagctcgaagtttgaatcctggagctgagcaattcgttcccttaattccttctccgttttcttggcatgctccttggcctcgtgtagctgttccctaacggcttcaagagttcccaaatgtggaaccagcttttctaaggttgcagtcttggcctcattgcgaagatggattctctgcacggtggttcatggattagttttgctaacgagaaaacaaagtcatcaaaggcagtcacctagaagacttacattcacaatgcgagtggcttctccaagtactttcttcagctggcacacttcctcatcttctttttggcgatttataacaatgccggaaacttgagagttctcgtcccaccatttgagtaagataggaggacgagagtcattagctgcctttatgcggagaatttcttcttcgtcgccgcctagtggacctgatgtattcccaagacattagacgaacaagctggagttattcagaacggcatcacttgagaagatgagttacctgaggatatgcctggttgagcgtgaggtgatccttgctctttatctggagacccaatcactgagtcattaccaacttctggtccttgagaagttgtctgcgcttcagcttcagggatctcttgatttagatctacatccgactgatttccagtcgggggctctcgggttgttgcagtttcagttgctgccgactggtttccagtcggcggttgatcactcggattggccttatcgtccgaagcttgggcgccagtcggctgactttcggcagtcggttggctttcggcagtcggctggctttcggcagtcggctcagcatctttggataaatttggctctgtggcagccggatcaggttcttttccagttggatctatatcggacggtttcctgcaaagtgtcctttcgatattcagcgtaatttctattagagaagcatgtcgaaataaaatggtaccgagaggtttatacctagaagatgttctaatctttggcatttgacggccagccagttttttcctgggcatggtatgctttgggggtttattgggcgttcctttgtccccagatttgttgctgtcatcgtcttcgtcgtcattaagcaccagctttctcttgcgagaacctgtctgcccagccggtttagaggtttgaggttgcgggtctgacctgattgtcggccctccgcttccctgaacggtgtgctggcgaggagatcggcgttgagcagttgggggatcagatttcattaatacgtactcctgaatgagatgcctccacggttagctcactcaacatgaagataaaattatgttttggtcatgagttgaaggtttcagatacgtacctgtggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcgaactcgaatgctgtgcgggatctctctttgattggagctaatcgacacttaatgaaatgccgagtgatttgctctccctgtaagccttgttctttgagcttcagcatgcgttccatcagttctaaggcttgggcagcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttttggctcagagtgcccctcagttgaaatccagccccaccaactacgcatggtttatttttgttcggttgaggcttaaggaaaaatattcggcggaacatagcaaaatgaggtctaatgcccaaaaaagcttcgcagacatggacgaaatttgcaatatggactatggagttcggattcaagtgatgtaagctgattccatagaaattcagtatcccacggaagaactttgaggttggaagagcaaatccgccataaaagaaatgagagaagaccacgacctcgtgtgtatcgggggttggaaaggcttcaccgcatgctggccgccacccgatgatctccttggcagggagaacgccgtgcgctaccatctccttcaggttttcttccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatcacgttttgaaggtggatttgggtggattggtgaaccctagttcgccggcgcagctctttactgtagcagggagtggggaaaatggcgagcgttccggcggggaagacgaagcgtcgcttggatctcggatttcttcagttaagggtatcggaggtgcaaatgggcctaggcctgaacagtacttcagcccaatattttcgacagcgtggcccattgtgttccttagggacttaggcattttttgctttggcaatttatgcgcacaatagtgttgcccaatgctgataaaatcctttttatgcggtcatataattctttggaattattgcaatgcaaattaaaaggtgcccgacagaaaggtgttatgctgtttttgtacgcttttttaggctacaaaagctgtctgggctgacttggaatgacttgtttttaccatagtcatttccttggtatgttatatacctgttttcattatggtaaatagtcatagcctaggctattagacttattcattatcataatttttataatatttggtgggtaatctttagagttttatattcggatgcctgtcaagtgagttcattcgtgaaccttttagagtgtaaatcactcggattcattttattatggctaaaaagcagtcggcaagaatgtctctttaggcgccgcgtatgcttttgccgtatgatgcatgattatgctattattttgttctcaactatatgtttagtttgttaactaatcacatagttgggggctacacctaattaggtgcatctattcgatgcaccatattctttgtcttttcgccctttacagtcttcgtctttgctactcggcaggccttggcatgcataatttgaagcactcggattactatctttgagaaggctatgatggttgactgcaaaggtctcgggggctactgtggagattatggatatcccatatctacacggcgatgatatttgggctgaatataggataccgaatatagatagaatatcttatgtgtatcctgggtttgtttcttaacttgtacatcaaggaaacaccttgagacttagtcggtcacgactgtatttaatctgtatctgtgtattccgttagggatatagattaacttttgtaacccggactccttcccatatataaggggggtccgggcgcctctaggggcgaaggttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaagcagcccatgcacgagtgactctgcttcctcgccaagatcgaacggtgactgcagcctcaagccgcagcacgcttgagtggtaatagcacacatcctgataaacgtaatcattgtaaacattggagcccttatcggtgataattgaaaccctgcctgcgagccattgaaactgacatcaatgtggaggcacctattgcggataagcttgatccgcagacagccatcacggacctcgacgaggaacctgatgcttccgcgagtgtgaatttgaacccttcaccgatgaggagaaatatggaggagtcagcttcagatctgtggagattgtgggtatcccatatctacacggcgatggtattcgaactgggtacaggatacctaatgtaaatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttccccgaatcatacaatcaataatacactcggcggattcatccccggacaggagtagggtattacttcttttataagaaggcctgaacctgtataaatcttttgtctccaaacccatacacttttctagcttgatagccacccccttttattattgccgaaatctagtttcgacagttggcgcgccaggtaggggcagcgtcaagcttttcgccgatcagtgcaatgggtcctttctctggcatcgacgacctcgtcttcccgcccgggcagacgtttcggttcggcagcctcgacttcatcaccgacaacttcggcaagatttctctcctcgactcggaatcaaaccagtcgggagagaaccggatttcggtcccgtttggattcccgaacgcggctgaaagctacttcaagaccatctcaaccgagtcggcttcaaaccactcggccgagattgcatcttctccaatgacaccagatcaagatgatggggcttacccaccggtcctgatgaagctccccgacgatttagcagccgtctccaccatgacagcgtcttcatcccgtaggcctaggcggaagtcggcttcaacaccgatttcgcctagcttcagggaagtcggcgtcatcctccaaccactcggcacggtttcgacggatcagctagatgaccactacagctctcccaccgtcgactcgcgccccaccgacatcgtggagtacgacgaatttagttctcgctacaacgacttccacgacttcgacgacttcgacggaagcctagatgacgactacacccctctctactttggcgttttcatggccaataatgagacggaggagcaacgccaagcccgggaggccgaagagcgtcgccgactggaggaggagcaccaagcacaagaacaagaacggctacggcgtgagcagcaggaccgtgagcggatcgcgaaggaggctgaggaccgacgtcaacgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgatcgcggcttcggtcccagttaactccgaaagcgtccacacgccgactggcagccgagtcccccacttccgatctcatgactaccgtcatccaagcctcagcatcaccggcgcaggatccaaccgcaggagcaggggccacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccctgaatcgtggcttaccgtctacggtctcgcaatccgcgcagcaggaggtgacaacaaggccatggcgaactatttaccagtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctccgacatcaccgacgacgtcatcatcgccgcgttcaccaaagggattcgccacgaagaattggtcggcaagttcgggcgcaagcctcccaggacagtcaagctcatgtttgaaaaagccaacgagtacgccaaagctgaagacgccgtcaccgcgtcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcgaggaagaaggacgacggcgacaccctggcaggttttcaagatcaccgcaaggagctcaaccatatctttggcggccccctagcttatgaatctaaacggaagcagaagttaactgaacgagagatcaatgctgttcagcccgacacgccccagtatcttcgatggtcagagattgcaatcaagtttgaccgctcggatcatcctgaccgagtggtccacccggggcggtaccccctggtactagacccagtggtccgtaacgtcaagcttcgcagaaccctcattgatggcggcagcgcactcaatatcctcttcgccaagactttggatgatatgcagatccctcgctccgagttaaaatcaagcaatgcgcctttccatggagtaattccaggattatccgcaactccactcggtcagatcactcttccggtcacttttggcactcgggaaaacttccgcacagagaatatcagctttgaagttgccgatttcgagacagcataccatgccatactcggacacccggcgttagccaagttcatggccgtcccgcactacacgtacatgatgatgaagatgcctggtccccgaggagtcctaaccctacggagcgacatcaagcaagctgtcacatgcgacaaggagagttgcgacatggcccaaacccgcgagatagcgtctgcccgagaggaaatccgactggccgcaaccacggtgagcgaaggagaagtgcccgctgccaagatttcaaaaagtggggaaaccgaagccgagactaagaagattcccttagatccttctgatcctaccaaaactgctgtaataggcgccgagttagattgtaaataggaaagcgcgctcatcacctttcttcaaaataataaagatatctttgcgtggaaaccgtcggatatgcccggtattcctagagaggtgattgagcactccttacatgtcaaagaagacgccaagcctatcaaacaacgactccgccgatttgcacaagacaggaaggacgcgatcaaggaggaattgaccaagctgttagcagcaggcttcatcaaagaagtccttcatcccgactggctggctaacccggttctagttcggaagaaaacagggcaatggcgcatgtgtgttgattatactgacctcaacaaatcttgccctaaagatccttttgggttgcctcgcattgaccaggtagtcgactcgaccgccggctgcgagcttctcagttttttggattgctactcggggtatcatcagatccgactgaaggaatccgactgcttgaagacttcattcatcacgccttttggtgcatactgctacgtcaccatgccgtttggactaaaaaatgcaggagcaacttatcaacgtatgattcagagatgcttctcaacacaaattggccgcaacgttgaagcctatgtggatgatgtagtcgtcaagaccaagcaaaaggatgatctgattttggatctagaagaaaccttcgcgagcatccgcgctttcaggatgaaattaaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaacttctcaccaagccaccggtcttagcttcaccacacccacaggagccgttgttgctgtatgtatcagccacctcccaggtcgtgagcacagtcttggttgtcgaacgtgaggaagaaggccatgtccagaaagttcagcgaccaatctacttcgtcagcgaggtcctggccgactccaaagcgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcgggcactggagccggagtggttttaatttccccgactggagaaagactaagttatgtgctttggatacatttttcggcgtctcacaacgtcgccgagtatgaggcgctccttcatgggctacggattgcaatttccctagggataaagcgtctaattgttcgtggtgattcacagctggttgtcaaccaagttatgaaagagtggtcctgcattgacgacaatatgatggcatatcgacaagaggtgcgcaaattggaagacaagttcgatggactcgagctcagtcacgttcttcgacacaacaatgaagctgccgacagacttgccaattttggatccaagcgcgagacggcgccctcagatgttttcgtcgaacacctttatacaccgaccgtacctcataaagataccactcaagatgcagacactcgtaacatagctatggttgaagccgactggcgagagccctttatacgatttttaacttctcaagagctccctcaagacaaagatgaagccgagcggatttcaaggcggagcaaactttatgttttgcacgaatctgagttatacaagaaaagcccttcaggaattctgcaacgctgcgtatctttagaggaagggagacaattgctgaaggacatacattctgggatatgcggaaaccatgctgctgcgcgcaccattgtcggcaaagcttaccggcagggttttttctggcctactgcagtgtccgacgccgacaaaattgtgcgcacatgtgaaggttgccaattttttgccagacaaattcatctaccagctcaagagttgcagactatcccactgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagttttcaaagacttttgtgaagactttggaatcaagatttgctatgcctcagtagcacaccccatgagcaatggacaggtggagcgagccaatggcatgatacttcaagggattaaagcacgtgtttttgaccggctaaaaccctatgccggcaaatgggtccaacagttgccatcagtactttggtctttgcgaactacacccagtcgagccacaggccagtcaccttttttccttgtctatggggcagaagcaatgttgccgagtgaagttgaattcgagtctttgcgctttcgaaatttccgtgaggaacgctacgaagaagaccgagtggatgacttgcaccgattggaagaagtccgcgaagcagctttgattcagtcagctcggtacttacaagggttgcgacgttatcataatcgcaatgttcgatctcgtgcctttctagtcggcgacctggttttgaggaaaattcaaaccacacgagatcggcacaagttatcccctctatgggaagggccatttattatctctgaagttacccggccaggttcatatcgactcaagcgcgaagacggcactctcgtcgacaactcttggaacattgaacatcttcgtcgtttctacgcttaactttatcattgtacttccctgttttgactgtcaacatcaagttttcttcttgccgttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacattcaaactcagtccgaatcagtcctttcatcatcagagtcatcattactcggctggaggtcgttgttgcgaaattgctctacaacatcactcgcaattttgtcagccgcagtttgcgcactgctgataagatcaagggcagcttcttcacttgtcccgtctgcaaatccatcaatggtgtcgatttcaattctcgggtacaaggattttgtcatcgccaaggccatgccagctcccatacttccagctttcttgatattcttgaaatatacttccggagcaacactcagcttatcaaatatttcggttgcgtcgagtgcactcggaccaccattattgaggaacatggcttggataattggtgcagcggcattggcgacgttatcccttgctccttcaagcctcttgatcttaccaaccaggacgtcaaactgagcttgagatttgatcttgcgatctacaaaacacatttatgatgagaatctgttgcattataagcagaaaagctcaggttgtcagctggcgattacctttgacttcctttaaggctgagtccctttgtgcagccagttctgtcttgtccctctccagggcttcaatttgcttcgccatctgttccatcctggcggcttgcgctgtttgaaattcagatggttgaggatacagttatgccagtttaaaccgatgaaacgaatctagggattaccttttgatgaaccactcagctcatagtttgaatcctggagctgggcgattcggtcccttaactctttctctgtctttttggcgcactccttggcctcatgcagctggtccctaactgcttctagagttcccaaatgaggaaccagcttttccaaagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatgcgagggatttcttctccgtcatcacctgatggtcctgatgtgtttccaagacattagacggatacactgaggttatttaaatcgccattgtttgagaagacaactaacctgaagatgtacctagctgagcgtgaggtgatctttgttctttacctgaagacccagctattgagtcgttaccagcctctggtccttgcgaagtcgtcgtctgcgcttctacttcggggatctcttgatcagggcctgcgtccgactggcttccagtcgggggctcttgagttgttgccgtttcagttgttgccgactggcttccagtcggcggcaggtcactcggattggccctatcgcccgaagcatgggcgccagtcggctggctttcagcagtctgctggttttcagcagtcggctcagggtccttggatatattttgctctgtcatagccggatcagggtcttttccagatggatctatgtcagatggtttcctgcagagtgttctttcagtattcagcatcattttcatgagcaaaacatgccgaagcggaatcataccgagaggtctaatacctggaagatgttctgatctttggcgttgcacggccagccagttttttcctgggcatggtacgctttgggggtttattaggcgagcccttatccccagatttatcatcgtcgccttcatcatcatcaagtaccagctttctcttgcgaggacctgtttgaccagccaatttggaggtctgaggttgcggatctggtctgatcgttggccctccacctccctgagcggtgtgttggcgaggagaccggcgctgagagactggtggatctgactttatcagtgcatattcctgaacaagatgcttccatagttagtcaactcagcatgaagataaaactatgttctgatcacggtttggaggtttcagatacatacctgcggaggcggattgaatgcgttgtatggcacgactggcagctggtgtgagtagctaacgacaatggcgttcgagaatatcttgtacatcctctccttcatgattttaaagtccagagagtctgggtcttcacggtttggatcatgcttgccgtcgaattcgaatgctgtccgggatctttccttgagtggcgccagtcggcatttgatgaagtgccgagtgatttgctctccctgtaagccttgttccttaagatttaacatacgatccaacaactccaaggcttgtgctgcttcatctccaatcggaagagagttccaagtatcttggtacactggaggaagacaagtgtacccgggaagagcaggctcgggattctgaacatagaaccagtttgcatgccatcctttgttcgaagttttgaagggcatcgagaaatatttttgactcagagtaccccttagttggaatcctgcccccccgactacacacggtttgttcttgtttggttggggtttgaggaagaagatccggcggaatagggcaaagtgaggtttgatccccaaaaaggcttcacaaacatgaacgaaattggcgatatgcactatggaattcgggtttaggtgatgcaagctgattccatagaaattcaagatcccgcggaaaaattttgaggtcggaagagcaaagccgccgtagaagaaatgcgagaagactacgatctcatgtgtatcaggggtcgggaaagcctcaccgcacgctggccgccacccgatgatctccttggctgggagaacgccgtgcgccaccatctccttcaggttctcctccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatgcacttttcggaggtggatttggccggagttgtgaaccctagttcgccggcgcagcttttcactgtagcaaggagtggggaaaatggcgagagatccggcggggaaggcgaagcgtcgcttggatataggatttttttcagttaagggtatcggaggtactaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggttatataattctttggaattattgcaatgcaaattaaaaaggtgcccgacagaaaggcgttatgctgtttttgcaagcttttttaggctacaaaagctgtttgggttaactaggaatgacttgtttttattatagtcatttccttggcgtgttatatgcctgttttcatggtaaatagtcatggcctaggctattcgacttatttattaccataatcttcataatacttgatgggtaatctttagagtttttattcggatgcctgtcaagtgtgttcattcgtgaaccttttagagtgtaaaccactcggatttcttttattatggctaaaaagcagtcggctagcatgcctatttaggcgccgcgtacgcttttgtcatataatgcacaattgtgttattattttgtctttcaactatatgtttagtttgttaactaatcacatagttgggggctacacctaattaggtgcatctattcgatgcaccatattcttcatcttttcgccctttacagtccactcggcaggttttggcttgaagaatttaaagtacttggattatcatctttgagaaggctacgatggtcgactgcaaaggactcgggggctactgtggagattgtgggtatcccatatctacacggcgatggtattcgaactgggtacaggatacctaatgtaaatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttccccgaatcatacaatcaataatacactcggcggattcatccccggacaggagtagggtattacttcttttataagaaggcctgaacctgtataaatcttttgtctccaaacccatacacttttctagcttgatagccacccccttttattattgccgaaatctagtttcgacaagatcttagtgagggaacccggtcattgcatcccaagctagacgcggcgtctgccgctgatgaggatgttctggaacccaacgatgctttattcatctccaaatgtggctgtaatttgcgcgctatatagttccggcggtttttatgagaggaggaggagctaccatacgttgtaagctcttgtgcaggggcatcattaagtactagcatgaatagcacacatgcatgacatgcttgatattgatcatgaaggggttctgaccagcagccagataatgtcactatacaagattcctggagcacaaaatgggataccaagagcatggtgtctcatgtgtagtatattttgagctcttgtgataagctcaaattcttgtttggtgtgaactcaagcatcgatgtggaaaacgtatatattcttctcgtaaccgtcttatagttgacatattcaacccctgtcatcctgctgtagcgcaacgaagcttgaaatcaagtgacacttgcaggatggcaggtatgcaatatatatatggaggtcttgtttgacacattcagatcgttgcttgttacaaccatggaattttatttcaatatacaccatgaattgaaagtgtaacatgatgcatggtagtaggccgtaaaatttcctatcatgacttcagattgatagccatatatgacatgggagatgaatttaatatgtgagcacatgaatgacggagtgcacagctggtcctttggtagtagaaccggggtaggaagacagataatctgatgactcaggtgatgctccaaagtcacgacaatgatgctgtaattgttagttccactgaagtggaactttgacctgcccatagcacaagtgtaggcaagaattttccttcttgcccccagcccactttgattggtgctcgagcttacaatatacaatatacaagtttgtcttcaagatcatatgttccaccaaggttataatcactgtatactgattatccttcctcgttggggatccttttttttttggataaaataaaatagccacaagccacattagagaagtcagcaaagataaacttgacgaccatttgtgcgcagcaaagatgggaggagaaccaggtcccactgggcgtgccattttgtttggagagaaaattcaactttgatctccccgcccagggaaataaaatgtgcgggcgtgccagtgtactaagtacacaaataaaatagacgaaggaaaatgcatttattataattctcaaagaattacaaaaatacaaaatccttggtcaaatgcgcttcatggcctataggcaaggtggatccgaattggcgattgtgttctcctgattcccggggtctcggaagacacccggttaattactctcgtgagttaaactcgtgagaaacctccgattaagctgcgctggtcgtcgtcgtcgatcttcgcttcacgttctcccatgcatgacagtgatggtggtgtagatgtgtgtgggcgtcggcaacggtccacgacctcgtcggtccatgcgccggtgttggtgacgtcttcatatagacttcgcccgccctgccattcagcctcgtcggtggtgcttgtagtggagactagcatggcattggctggggtgagaataagatgacggtgtcggtagtggtgctgagctcgagtatgttcgtggtagccatgaagaggtcattagcgaaagcatgaatgacatcggtggtggcgtcgagtttgagagtatatatgccgacggtggtcacgaagaagtcatcagtatgtgtactgatatcgctaggagcaacagagacaccgatagagattccaagcttatggtcactggcggttgaggtagcatcacccatctagtctccacggcactggtcgatcatcatcatggtacagaagttagccttctaatcgctacagcacgcacttagtatcaagtggctgtaggggatgttaggggcgtagtgaaacctgggagcgatggataacactccaggtgtcgatgaccctgttttatgcgtgctgtgtgataggggcaaaacccaattatgttgggagtgcctccgatcatagcgagcatgagttggtcacggaatcttgccattgggcgtctttagttcgagctcaagcatgtcagccgaggcagcaacgagacgccagtagcagtgttgcgtttaggcgcgtcatcggcgaatacatgttgaagccgatggctcgtcaagctcaagggcgtccttggtgatagttggcagctccaagcttgagcacgtggcggcggatgcatgggtggcgccggcgacgatgacagggtcgagcttgtcgttgatggcagccacgaagatacacgtatgccaatgagtgatgacgaacgaggatacttccgtcttgtgggcgagatcacatcaccggcgtcgatgacaattatggagacactccggtcgtgcgggtctgagagtatgaccggcgatggcgacgagtcggaagttgtcccgacaacggtgtacatatgaacattttgtcaccgagcggtcgaggccgatgagtgtgatactgtagttgttggcatgaggatgactccgtgtgatgaagcgaaagcatcgtggatggacagcacgacgacctcagcctgatgaagataaggaatcatggccagacttgtcgacggcgtgtgggcacctagcgatggcgctccagtgttctcctcaagaggcttgacaatgaatgagaggaaggtgaaattgccggcgagggtgagcgtacgtcggcggcgtcatgacgaaggaacagtggccaacaaggcgacgacgtccggcatggcattggcagcaggtagatggtgtcaccggcgactgatgcctctgatgggatgctgcagccgtggtcaccggacgacatgatcgaggatgatcaaagatgtggcatttgcttccgagcaccatggtccatggacgatcgaacaccagtcttgtgcatgcaagcatgaaactgaaacaggagaacaaaataaaatacatggatagattagctaccaatagcagtgggctggaacagcatcatctcctccccggcgacgcctccttctcagcgcacgcgccctcttgccaaacgccgaggtgctgcagccgaggtcaccagccaccgagcgcacgcgtcctccccacgagcgccgaagcagtgagcatgcaggctctcgacttttctctctctctctctgttgctgccctctcgtgtgtgtgtctccgtctctgtgtgttgtgtccctgtgtttctcctcccccctgtaaaatgaaatggacaatcttttataggggtgataagtcggttcacaggctagctcatacatggattagtatctgctcagccagccagccgcttccatctataagccaaatttccatttagcaaatatcatgattatgataattccattgtattgtgatatgattattggagcttccattctatggtgatacggagagtagtatttccatgtgaaatctcaagtgcttgctgctattatctgtttcgtttccaatctgacgtgatatggatcaattttccttgtatacttatacgctcacgcactgctcatagaaagaaactttcatatagagctatcttgcccttttgatttccttggtttccatgcaagcatgtacgtggtttccatgcatatgacgtgagagattaacggccggcaaatgatgtgattaacttcctctaatgacagtgctacagtggcatatgcttccattcccatgaaaacattcacacctttttccttccatcagccaaccatgaaattggatcgatcacgctatatcaaaatgtcgtgagtacgtatatactagagcagccgacggcaagtgtctcataatattcatacgtatacgccatgtacgccaggttgtattattagtgataattaatcaccaatttcgttattatgtcaccattcccgaaattaatactttgacacacttcatttctttcatttataaaaaaaatgtacaaaatatcgtcgaacaaatgccccctcaccaagttaaattcgagcgtggagcggctcggaattaacttggtgaaaattttccatttcctgaggaacaatgaattaagtcccacagcatatatatattttttaatctcataactacaagcagagttcaagcactgaataaaccaagacgaacttggtggttttttctatgttgaagaagcgtatgtagctgccgccatactgcttaaagacattaatcctttctactagggcaaatctcacggtagttgtagattatgccaccaaaattttgcaacaaaggaccgtatggattttcactatggtatatagtccacccggatgtactggggcaaaataaatccatgccagcgtctaatgaattaacagaacatgaggcaaaaaatccatgccattgtcgaaaaaaacaattcttcagacctgtgtattgatgataaggtctaaagtaaattaatcaggcgaacggccatgccattgttaataaatatcccacggaccagtgtattagtgataagatcccaagtaaacggatgaggcgaacaaccatgccattattaacaaaatactccttggacctctacatgattgataagatccgaagtttgataagatccaaagcaaaaggatgaggcgaacaaccatgccgatattnnnnnnnnnnnnnnnnnnnnncattcttgatgggggtccgagagtaaatatatgaggttaatatccatgccataatctatcccggtcacagcgaaacaaacgtgccgtgtccggagagaattttatcaacccacacacgatcgcttttttaaaaaaatccacgatgtcagctgaatgggttgaagggtttcacagattcacactggccgcattggcgtgctgcactactcccaaaatatgcgtagcggcacatccatcgctatatacgaaaaatcaatagttatctgggagacatattgatcggagtcttaagttcttttaagaacaagtgagacgaaagatcatgcccaaggaataagaaaatcgattttcttgcccgagacatatattaatgtcaggggtacaaggaattaagaatatgtgaggcttaaatcagtgacatcgataaaatataatttataagaccaagtacaaatggtctcaagaatatttaaggtagaaatccatgccaaaaatttattcttcaagggatcaagactagcatgaagaattgccaggcaaaagtatatgccccagataaaatttatatttcttgagacaatgacaactagtctcaaggatatttgaggtgaaggtccatgccggaaattcattcttcaaactagccggatgacacatgttagctagtctgaagaattgtgaggcgaaaatacgtgcctccgataaacaattatatatttcttaaaacccttcatgaatggttttaagaatatttgaggcgaatccatgccaaaatgatgatttattctttaaaccggcttggctgtagattaatgccagtgtaaagaatggtgaggcaacactacatgccccctgtaaacatatatatatttttcaagaccaatgatgaactgtctcaagaatattgtggcgcaaatccatgccgaaaatgggaatttattctttgaacctgtcatcagattaatgatggtctaaagaattgtgtggcgaaagtccatgccactactaaagaaaacatgtgtgaggcgtaaatccatgcctttctcaatccatggcgaaagaacatgccatttcatgaagggttttatcaaccaagtcgcgaccatttaaactccacggtgccagccgacctgatcgaagggtttcacagattcacactagccacactggcgtgctgcactgctcccatttatcgacagcagaatcaccatcactgtaggtataaataaattaccatcacggatgatttaaagcggaatggaccatcacttatagagaatgatagtgtgctatacggtagatgcatatagtactagcagaatgaaccattgctaggcatcaatttgaattgaccatgtaggtaagaaaagg

SEQ ID NO: 58165 - DNA, 1364 bp, Oryza sativa
ctcggtacccaatctatatatatgtatgaaattattgatcatacgagttgggtttcaaccatgataatataaatgttttataatgaatgattttgggcatatatacatatgaaaatgacgtaactaagaaaatttttcatgggcatgtcaagttaatttgtgtttagttttcacttgtgtcaaggagccaaaatctgttccaagtatttttcatggtagtaaacttgtatatatattttcactcgtgtcaaagattcaagctagctgccaaattatgaatttatgttttttttacatttaatatgattgttagaaatatcattatatattttattctattcttttattaaccccatcttatcatgcacctaactgattattcatgccgatcatcactcatcaggatatataattaatctgttaaacgcacgaattaattaaatcaagctcctaattactaacaaccaaattatggatgaagaaacaagaactgaacaaataataaaaccccaaaaatttaaaatttgggaatacagatcgatcgaagcaacagataattaatccatgtaaactcactggtcggcgaggaactggagcacttcgtcgtcgccgccgaccttgctccagaactcctcgcaccgcccgtcgctgcggcgcaccgcctcgcgcgccatggcgcggacggtgtcgcgccggtggcgctgccagtaggggaggcaggcgaacccccgcatgtcgatgcggcgccacagcgccggctcgtcgcgtgcggcggcgcgccacgactggcacgccagcccggcgcccatcaggatgtcgacgtggtcgagccagcggaacacctggaggatcgcgtccaccggcagctccgcccagtccctcgccgccggcagggtcgtgtggtagaggaacacgccgagcgggaccgtccgggtcctcctcctctggcgccggcgccggcgccgccgccgccgcgacggggaagccatggcgatcgatctcgatcgctaggattctcggatcagtcgtatagccttctagtccataagtcatatgccttcagttggatgcggatactcatatgctgaacatatacggattcaggtgatttgaaataatacagattggaacatggttttgcattttgggataaaattaaataaaattccgatggatatttggtgatactttcgaacaaaattctcagacaaaattttaaataaatttatactgaatgcatgcatgcctgaattcaaacaagtattttttatatatatatcgcgttgaaaagtttaatacacctgtttttctttcttttgattacaatatatatatatatcccccaactcatgattgccagaaag

SEQ ID NO: 58166 - DNA, 5098 bp, Oryza sativa
tgagaaatgccaaagtcttgagttaacgatcgacgctagctatcgcatcgatcgatctatcctgagatatgatcatatacctccattcatatgtagggacccgttaattatttggagtatattagtattaactaggagtaggactaggacattcgtggtggttgggaagggagttaagttagtttggcatctgttattaaaaaaaaagttagtttgtcatccaataattattaacaactgttaagcaagcatgccttgtacagagttgtatgcatttaagctatatatatctttcttgactattgatcttttgatcgttatgtgaatttcaaagttaggccttgcttagttagggaaagtttttgggtttggttctcacatcagatatacggactcacatttacagtattaaacgaagtctaattacaaaacaaattacagattccgctagaaaactgtgagacgaatttattaagcctaataaatccattattagcaaatgtttactgtagcactacattgtcaaatcatggcacaattagacttaaaagattcgtctcgcaatttacacgtaatctgtgtaattggtctttttttctacatttaacactccatacatgtgtcaaacattcaatgtgacagcgtgaaaattgtgttttgggaactaagcagggccttagctactactactacaattgttacagtacatgtagagcagtatacgggaaaaggagagaaaatgaaatattgtaaaacggtgctgcagatggatgcatggtctctcgagctacgtacagcccataaatcaagatcaaacgggccactttgtgtagttgtgaacaaagctcattttcttggcccattactacatattgggctctttaggtgatttgagaattgaggcccatgaatatattgtttagcattgggattaggttgcagtaagttcactttgacttcttaactagggaccaaatctgattcgtatccctgaaccacaataccgaatatctcgaccccccaactattaaaaccacaatttaactccctcggtggttttggaggacagtttcactaatgtgggccctacgcggcaatattgacttggtcttcgttacatgtggcgttgacgtggcattataattaaaaatatgtgggagacccatatgtcattgaacaaaagtatgtgtgggactcactgacatgtggagcccacataatcatgctctttctttttccttcttcctcttcccccctctccctctctctcttcttccctgcggcaagccgcaagtgtgggacgggggcccggagctcgtggcggagtggccccgccgccttgccgtcgcccgcgacgtggccgccgcgctccattacctccactccgtcgtcaagccgccggtcgtgcacggcgacgtcaagcccaacaacgtcttgctcgacacgtcgagctcatctagggcggaagcggcagcagctagggaatcgggctgctgccactcccacatctccaccgctcgagggccgccgcgccacgccctcgtctccgccgctcgccgccgtctccgctgcccgccgccgtctcgaagtcgcgagctcgcaaaggggatccgatcctcgcccgcccgctgtcccaccgccgctggctcccggctcctgcccgccgctggcagcgccgccccagcagcgcgtcctgcatgcagcgacccgttgggcatgaggtcatacaccagcatcatcacatgcgaattgggtttgtagtaggaatggttatcctctcgtgtgtgatgctctaaccaatttgtgaaaatgcggtttgaatctactatctatcaatataaaactctagctttacgcaaagaaacatatatatagctatccttattatatcctgcatataactgcatgcatattctgtggtgactcgctaagtatgtaagtactcatccttacttataattaagtagtacaggagaagggatcgaattgtcgaacgtgagctaggtcctcacggccctagtcaactgcctgtgggcatgttgtttggacccactatatatatgttcttctacagttggttatctgatagatagattatgacctatttagcactattaattgaaggtaattaatcattttagtcttatttccgcgcaccctatgttatgatattgctttatatgtgcgtaccaactactgatataggaaaacacatgaggtttctggtttctaaaattgggggctgacaacataaaacgatactcactccgctttatactctaagattttctagcatgatctacattcatatagatatattaatgaaacatataaatgaatatgtacaatgctagaaagtcgtataatataaaacggaggaagtatatatgctagaaaaattaaaaaacattgaaaataacacaacaaacatgcacatgatgcatgtctttattttaattatcaggccgggattaccagcttgagtatgtttacatatgcaccgatcgagtattatatgtagttacttacgtacatacatgaaaacaatatatattttatttagccgttgttgttcgatcgatgagaatgatgattaataagtaatgacaggggggtgcatgcaggccttggaggcggcctttgccatgtggttgtggtcgagggcggcgttgcacatgttggcgaaggcgcgtgtgtgcttcatcccatactgccccagcgggccacagtgagcctcgaacgtgcgcaccatggacttgaggcaatcccagtcgtcaaccagcggctgccccgccggacgccggatgtgcaggagcttcttcttggaggagtcgcccaagaggatgtctccgatgaggtcgacgctgctgtcgacgcgtgatcgcctctccatttctcggagaaggcgctcccatgcctccaccgatttctcctcgtagtacttacgccacaggtagacgagtcccgcatcccgttggttcacgccgccgacgcggccttcgtcatcgatgacggcactagctgttgaggtgccggggccggggggcaagtagtagaggctgacgggttgggaggagaggcttaggtcgccgtaccgactgacgtgtgacaggttggtgcgcttcgcgacgatgtcgtacagctggccgagcgtctcgggatcgccggggcggcgcgcgtcggcgtcctccatccaggccacgctgaagaggtcgccgaggcaggtgttgtactccggcgtgtcgcagtaggtggcccagctgttctccgtcgcgttcgacgccgtcatcgcgtacacgccgatgttggacggaagaagctggccctcgaacatgctacccgactcgcacgcctccacgtacaccaccaggttcttgtacgcgccggccgcgttcttattcttcagtgcttgagaaagatcgttcgcgtgcaggttcccccccgatggcatgcctgtacgtagtgtcgtatccaattcaatttaattaatcgtatgcattatattattctttgtttatatatatacaaggattccattggttactaaaaattacgtacagacgtatccggggctgccatgatctgagtaatagacgaagatatggtcgttggggccgctgctgatgaccttgccgctgccggcgccggtgagagccgacttcttgcccagcaacacggccaggaagttgttcttattcacgtcattcccattgtaatcctgcaagtgatcacgcatgcatccatgggcataattaaccattatacatatatagtggacgagcggcagcgctcgcggaggtgacggagggcgtggacgagcgcggacaagctgacgttgtttctatcaggaaccaactcattacgctcacctctaaatcaaacacctctgggttcatctcatttcatcccatcccatccttgtaatgaaatactccctctgtttcaaaatatttgataccattgactttatagcacatgtttgaccattcgtcttattaaaaaaatttgtgaaatatgtaaaattatatgtgtacatgaaagtatatttaacaatgaatcaaataatatgaaaagaataaataattacttaaattttttgaataagacgaatggtcaaccacattcaaacattttaaaacggagaaagtactatctaatggacacgtacctttgggactccagcgtagacgttcggaccgttgggtttgttgatgatgacacccttgtgaggattctcggggttataggcgatgtcgtcgtacatcataaccacgatgttctggtccttgagtcctcccttcttcattatctggtacgcgtggcacacgtctgcctggtgacggtagttttcgtaccccttcgaccccgcgatgagcaacgcccacttcgtccccccattctccgtcggcagccggaggaactcctgccacagcccgccgttgccgaggcccagcccaacttgcagatgcatcagcatcagcatcagcaggaggacacccatggccatggatcttcttcctagctaattcgttcgtgctagcgtagtgtattgatcgatggaatgtactgggctagctattgagttccgatttccccagcaaagtacgtacccctatatatagcactagcaagtagcttagttaccatgcgtgcgtacgtacccctattattactgatacaaaatacgtacatacgcctccaattggaagagggtaagtgaggcaagcaaggttagcccaattctactacctaattaagcttagtttacgcgttactactgctactatactattaaacaactcttttttggacccttaataatgatcatgcgttgtttcttttacttagatttcaaaataaaaggtcaattgttcgttaagtagttttcataaccgatggatcgtacaaggttaggataatacatgttcgctttcatagcctaaaaattctcatattaatctgagaaaaagaaaaaacagagtctatataggaatgaaatttaaaaataactgaaattcgaaataaaaaataaggaatatataaagagaaaactagagtctataccgatatacaatagaactaaggaagggctgcagga

SEQ ID NO: 58167 - DNA, 5344 bp, Oryza sativa
cttacatcgaattggatactggtgacttaccaaacgaatgacgaaaacatctttaatttttacaatagtagagaagagatagagatagagataaagaaaaaaataactaaaaaccgatttaagcacagatgatataccataatcccagtagaaacataagtagagaagagatagagatagacatatactactatataattcacgttgcaaataaaaaaaagtacgtccatggctgctggacagctcgatcggtcggcacgtaccaaaaattgtaaaactcaaactcgtccagtcctacataagtacatgatgtgacttcaccggcataaacaaattcgctacgggcatgtttagttgatgaaataaaattttttgagtgtcacatcggacgtttgaccagatgtcggtagggttttcggacacgaataaaaaaactaatttcataacttacctggaaaccgtgagacgaatcttttgagcctaattaagctgttattagcacatgcatgtgggttattgtagcacttatggctaatcatggactaattaggctcaaaagattagtctcgcgatttacatgcaaattgtgcgattagtttatctttttttatctatatttaatgctccatacatgtgtccaaagatttaatgtgatgtttttgcgaaaatgttttgggaactaaaccgagccacatggtatttgtccattaccacaccatacttgtatgatacaaatgaaccaaacggtacgttatgcgatataaatattagaaaaccaactaaaaacttaatcaaacacgaatgacgtactaaaattccggcaaaaacatctttaattttcataatatagttaaagaaataaggaatattgtaagaaaaatatagagtccatatagaaatacaatttaaaaataactaaaattaggaattaaaaaaataaatattgaaagataagtttagagtccatatggaaatataatttagaaataatagaaatcagaaattaaaataagggatattggaagaagagtatagagtttatataggaatttagaattaattaaaatatggcaaaaaataaaattaaaagtagagtttagagtccatatataaatataatttataaataactgaaattcggaattaaaaataagaaatattgtaagaagaatatagggtccatatataaatacaatttgaaaataactgaaattaggaattaaaaaaataaatattaaaagataagcttagagtccatatagaaatgcaatttaaaaataatagaaatcagaaattaaaataagggatattagaagaagagtatagagtctttataggaatttagaattaattaaaattaggaataaaaataataaaattaaaagtagagtttagagtccatatagaaatacaattggaaataataaaaattcagttttctttaaaaataatattagaagaagagtctagagttcatatagaaatataatttattaatagtaaaaattcggaattaaaaaataagtctagagttcatatagaagaataatttaaaaataactaaaattttggatttaaaataagaaatataggaataaaatttataaataatagaaattcatagttaaaaaataaagtatgttggaagatgagtctggaatccatataaaaatataatttagaaataactaaaaattgatattaaaaatagttaataactattatgtgcatacaacacgatatgaatattgcacattgatagtttgatcaagctagtacaaaatttaaattatgttattatttttaagatatcttaataataaaatgagaatatgtatatatatgctactatatgagagaaaatataaaggatatgctagccgcacaatttacgtgggtaagcatgaaccatgattgttactgatataaaatatgactcctccaagagggtaagtcaggcaagcaaggttagtccaattctactacctaattaagcttagcttacgcattactactactactactattaaacaactattttttggacccttaatgatcctgcgttgtttcttctatttagatttaaaaataaaaggtcaattgttcgttaagtagttttcattaccgatggatcgtagaaggttaggataatatatagtaataaaatccacatgtgtcctaatcagctgtagaggacttatgtaccgagtatttagttacttgttatacatacatgaaagacatcgagcgaaagcaacggtccgatctgtattttacttagccgttgttttactatatatatgtacgtacatattatcatatttgatgagaatgaaaccttcagtgacactaattattgccatcgtagtagtagcagctagccatcggattagacgagaaagaatcgaaccattatattatattcttaaaaaccgaacaaaggaacagtaaaacggagcacgtgtagaggcatgcaccatgcatgaaagcaagacatgcatgatgacagcaaatcgaacaacaatataataatcaatgcgccagcaccgcgagactaaacagcctaaaaacgcatgcccaacacgcaaagagatgaatcagcactaacaacacaccgcgtaactaacaactaacatccatatcgatccctacataatcactcattccaaacaaggaacagagaacggaattttctcttctctagcttcatgttacataagtaagaaagacaggcacataaaaggaaaagcaacaagacacatagagaaagaaggaagggcacgtactgaaatagaaaaggaatcggatgattaaaaaggaagaggacagttagaattaaccggcaacgacccgtacgtccacagctaccggcacgtacgcaagcgcaagaagaagcaaggctaatctacgagattaaccggacgatcaatacctgccagtgacgaacgcatgcacgaggagatcaagtttagcgtaaacatgcaacgtgtcagggaacgaaatagcctgaaaaaattctccaaactgagattaacgcaacggttaggagaattatcaatatagatgattgtctcatcccagctatcttcaacttgacagacaatagcaagtcgtctctttttgagaaatataaattttattaagcatgaacagattttaggggataaaccccgttacatatctaaagatgaaaattgtaaacaactagccatccttgtgaaaagaagggttaactgaactacagaagcaaccatcttgatgtaaccaaacagtagaaaaagaagcagatcgatagggagctgcgggctgcggcactgccgcgacaaccgctaccttgggcctcaaataacgtgcactccacttgacaagccgttaatcccaatcggctgcctccatagaaacgacacaaaacagaggtttgttgctgagccgtggattttggttgtgagcatcactggactcagcaaaggattcccacggagttcgtcattgaatctaaggagctctaacatcaaacctgccaaccgaggttgcataggtagttcgagctcaacccgaatgacaaaccctgcatggtttcttctgttagggaacaaaggagagggcaaattcaaagaccaatcaaccttcaacattgaagtatttgaatggctgcacaataacttatgtcttgctgagaggacaaagacggtcgaggaagaggtggcctgcaacttgaaattacaagatcatggtgttaacaatagaatttggcatcagactcgaataaggaggaaggagatcgagatggatttggtgttgaaacaagttaaactcgggatcggactgtgcatcggctaaagatcgagactggagattgatctgattgatggccaatacagccaatacggcataacttggacttggcatgggcccagattggaataaccgtcattgccaattagagataaagctcaataaaggcaattgtatctattaattaggttagttatgttggttttgttagttttggtaagagaacgccatcgatggtcttgttcatatctaagtttttagaaagtttaagtcgtgtccataatggacttagtttgtatccggggtataaatataaaccccacagcactgtaatacgggagacaatccaatacaatttcacacttttttacttttcctcttttttacgttccgacagaacttgagtaacatccttaaattttaatctaaaatttgactgcatcattcttgctcttaaattttaatctcaatttagcaaataaaaaatctcttaaaaatttcttgtttaattcttaattttggttcaagtattgtacccttagaattccttcggactatactatgccatcctattcaaatattcctttatcctaaactttagaaattttatgaaatccttccaaagaccaaaacctagaaccctcttttatattatctcaatattagtgaaacccttttatactaccaaaaccttccaaaaattaagaggaaattctattctctttaggcatttttgtcaaaatttgaaaatgtactattcattgcacacaacgtgctcgacaaatcgcctagcccactctgacccaaattgttcttcaagtcttcattttgaactaaccaacatcaaataaaaaaaaagggaggtagtatgatttatgtccccattggttgcctgcaaagccaaagctaaaaccaaaatttaaaatttaaaacttaatttgaggttacttttaagatgttttaaacatagtttctttctagcatgacttttaagcttctaaaacacacatatataaaaattttacatataaattatttgttaatcgctaataaaacacaccaagcacggtatcacactgcatttctcgtcctcgctttcgatgaaaaaaaaaccatattcgttgtttacagtgaacgggcgagaaacaggtgaagctgcggctaggaaagcgaggtgggactgaactgctacagcgccgtgatgtactgtagcgctgctgctctgctatgcctgttgcgctgctgctttgcatgcttgggccaaaggcccaagtcctgctgctgggctgctttgctctttttcctctaattattgcggagcgtcacatgaggcccttaattagacatcactatcattctcagttcaattaacaccagttcttctacatatactctttttagtcatcaataaatcgatatgcaagcttcagtttttctgcatataatctttttgaagttagtacaatcgcaactattgaaatacaacaaataagattgtactaacctcgatatttaaaattaaagcaacttacttgcccacagttatcaa

SEQ ID NO: 58168 - DNA, 3326 bp, Oryza sativa
tagttggcacattaattaattaactaatcacgattgaccatcgtgaactatcattaagccatcattaaataatagtgagtcataagttgtcccgaatgtgtactaatgtgtcacgtcccaaaacgactctaaaatgcatcctcgaaattatgcaaagaataagtaaaatccatgtgaaagcctccaacaattaaaatgtgcaaagttaaaagtcgaataaggcttggaggatttttgtatatttcctaaaagcttaaaatgcgtaaataaattttagtggaattttcagagcacaaataataattaagaagaaataaacaaagttaaagtggttttgtaaaaagaaaaaccctaaaagtctttttccccccccccttccccctcttgggccggctcggcccacctccctccctctctctcctctcccccgcggcccatcggcctcctccccgcgcgcgcgccgctgacgggcgggcccgcccgccaccctcgctgacgggtggggcccacccgtcatcccatacctcgcgccgcacccgccgcctcgcccgtgccctagcgccgccgccgccgcggattccgccgcatcccgccgtccccgcgcgcaataaagagggggaaatcattccccgtgattccctctccctttcccccctacttttccctctctctctccctcggattcgtttggaaactctcccgcaaacttcgccggcgcatcaatggcggccggatcttccgcgaccgattccccctcatccggccgctctctcctcctcccaacactacataaacactccccgtgcctccctccttcgtttccgccactcgccgctctctctccccgtcggaatcgagctcgcgccgtcgtcctctctctccgccgtcgccgccgagctccggtccgccgccgtcgtcgccccgggcctcctcccgtttcggcgtcgccttcttcgggttcgccgcgtcctcgccgatctcgtccaccccttcgtttcgcccgccgaccgccggaacgccgccgtcctcgtcgacccgagccgcgccgccgccttcctccgcttcggtcgccgttcccgtcgtcgccgtcgacccggggtgagccatggaccgcccatttcgtttcccccttccctctcctctctcgggcgccgctccgtcgcgccggaggtcgccgccggcgaccatcggggcgcgggtgcgccgcctcccgtcggctgtgccggcgaggccgccttcgggcgcgccccgcggctgccatgtggggcccggccgtcagccgcccgtgtcctcgggtgcggctgacgcgtgggacccacggcgccgggccggcgtaagccgcgtgcacccggtccaccgtggaccgtgaggctgccgtgtgggccccactcccgtggacccagtccgcgcgccattccctcggctgacgcaataaatccgattttaaattaaaatttaaatgaagaaattcgcaaatattcatttaaagagcatataaacttcaaatggccataacttgaccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagacccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctatttacctttgttatgaccttattattattgttattgttagtatttccttgttcaccctagattaaacaaaaccccaactagtggacactctactcatggtaccactagcatgattttaggtagatgcttcgctgtttaattaggtaacattaggtggttttacaactctagactttgggaatattcatatcacctggacactttggaactgttggattattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaactaaatatctttaaatgctgtttactgcaaccctaacccctttatagtataactcctttgtactcccttgcatttattctgcacttgtgggtgtgtcttgttgagtacggtggttgtactcagtcttgctcaatttttcccaaacccagaagaggagttcctgcaggatgaaggctttggtgtctagctcgtgcctgccgtcaagtgcctgtggtcgtcgccctagtcttccgctgtttctcgtttgtctttgtgtgtgctgggccttcgctgcccatgtaataaattatctatttacgcttccgcttgttaaactctgaattgtatcaacttttggtgtaccttgcctcctgggacaaggattaatgcacgcacgcaaggaacacccgttgggtcagttccggtcgtgacaagttggtatcagagcccccttgaccctaggacgagccttagatcccgagccttagcaatattt

SEQ ID NO: 58169 - DNA, 4684 bp, Oryza sativa
attcctgcagccccttgttcatactcctcattccttgactgatgtatccattcctcctgtcagaaaggaaaaaaaaaacaatcataacatcatacttagaccatgtgttaattttcctttttccatgggcttgtcaactcgaagcttaattcctactgttaaatcctagtcaaatcaacaaaaaaaaaacataagcccagcgagagaacaatagaaaccttgaaagggtgtctagtctcaccgctcaccaatttggtaggaaatattgctaaagttctgagaataagttgtcctaaatcctaacaacaacatcttatcgcatcaaaattgctggcataaagactctatttagcaagtttgggctttctttcaaaaatctgggtattaaatctacctggattctggaacaaaaacttactggcataatacagaaaatgcttacactgatcgcataggaatgggtttaagaaggcaaaatttgctacaggacacccaaaaaacgtataattagctatgggacaccgcaaaaacgcgtatttgctatagaacatcgcaaaaaactggacattagctcctggacacccgtgtcattattttattatttttagaggaataggagagagaaacagctgtgtaagtacggttctacccttcgaattatttttctttattcttccttattcttctctttctcattctttctctctctgctatttcttcaagtgagcccgaggcagagggagagcgctggcgacagcgtgggctggtgcagtgcctcggttggggcggcgctgcacggtcatgcgggaggtggtggcagagctagaggccagggcggcgctggggcggcgctgcgcaggcaagggcagccgggctcggcagcgcaacaacgccaagagcgcggctgctccaggccgacttcaggaggctggatcggatggcaccggcgccggcgcggcgaggctcaagccgtcgctgcgggcgctcttctcatgcgggatcttcagcgcctgcacgcatctagcactcagcccgacggtgacgcccaacaacaatgtcgcatgccatcaagctggttgtggaggcggcgtcgtcgctggttgtggaggcggcggcggaggtgacggcggatgcagcagcgggcggcggcggctgcttcgatgatggttgacgagcccgacgactgcagtgacggaggcagcggcgagcagcgctgggaagcgggcggtggtgatagtttcaatgatgatcagcgagctggcgacagcggcttcgatggtgacggttggcgagcggcgctgggaagcggctgccagcaatggggattagatagagctaagggaaattttgtctttttgaaatttctctctcctctttttgataagaaatgataaaatattgtctcgggtgtcctatagcaaattacacaaattttgtggtgtctatcagcagcgacgcaaatttgcagtgtctcccagccaattacacaatttttggatgtcctagggcaaattttgccttttcatttatattaggtcaatgctcctctgatccctctccttcaggttgtgccttgtacatagttgtatgcctttaagcaatatctttcttgacgattgatcttttgattgtttctgcaaactatttggttgtgaatttcaatgttagctactactactacagttggtaaagtacatgtagaacagtatccagaaaaaagagagaaaatgaatatgtaaacgatgctgcaaatggatgcatggtctctcgagctacgtacagcctagaaatcaagatcaaatgggcccctttgtagctgtgaacaaagctcatttttatggcccattactacatattcggctctgtggtctgagaattgaggcccatgaatgtattgtttagcattgggattagatttgatcgctcatatgaaatctggcccgttataaatgtcgatatgctaaactatgtacttttgactctcaaaaccttgcaaacttctaatatgcattattgggatctgtgctctggtcagtttcccaacttcaataacgttgatgaactccgatgtgggtaagggaagaggaagttcccctgactggcctgggagatcggggaggtggcggcctgacggtgggtagcgttgacatcgctagagctatgggattagctagacggtgggtaaggttggcggcaagggcaaaaaataaaaaaaatgatggtcgagttaggaagcgacaggaagtgacagtgtattcgacgacaataaccaccggagataggtaactaagatgtactccctccgtcaaaaaaaaaatcaattcctagatttctgtgtctaacgtttctccgtccgtcttattttaaaaaaatataaaaaaattaaaaagataagtcatgtataaagtattattcatgttttatcatctatcaataatgaaaatgctagtcataaaaaaattcatataagacggacggtcaaacgttggacacggaaaccaaagaattaagtctttttgggacagaggggtaggtgcaacaaaatttaaagtccgtgttggcaatattggtggatgaagaaaccaccggagaagggggtgggtgggggagaggatgattgtgaaggaggttgtcatgcctccacaatgtcgggatgacaccattagatcagatttttggaaaggctcgcctgaattttcacctgtgtgtgtttcaattcctcacctgaattttcattacggaatctgtgctctaatttaatttgttacacatgaattcttatgaacgaacaagctaggataactgctccaaaatcgatacgaaaactaagaaacaattaaagggaagacgtactcacgtgcatatatagctgatagcttgatcactatgcaggatatatgtagactatatatattcgctctagccgttgatctgatcagcatctgatcgctgtgctggaaactgcatcgatcggtaggacgtctggatatacatatatctgcatgcagttaatacggggggaatccatcgatggatgcttccaagaaactaacttttgccggccggaatggtcgaccaaagtccaattatatgtcatcatggcatatatatgcacgccagcagatatagaataatggtcaatatataacccggtcactgcaaaatggattaatcaaagtagcacaattaacttcatttgtggtcactatcaagctagaaagaacaatgagtatatacacattcgatcggccattatatattattatattcgacggtgaccagctagccgtctgatttcagctgattgatatgatcagctgagagaccatcttgcttatcatattcttaccgaccttttcaactactaacatcgatcttccttttcttctttttagggagaaagtaacaaagcggaattaagaaaccgtgcgcgctctcaaattaaaccagcggcagctcgtagtacctaggatcatgcttggccacgaacttataattactgtgttaagtagtggcccctacagctacttgtagcttgtttcgcaaggcccttcatgcatttacttagtagtactactgattatcatatcaagggtgtctctgtcaaggatgatctgagcttgaatcgatctatgtaatcagcagtcatgcatgatgtttctgtgttggtggacgccacggttttctccctcagctcatcgtttcaaaccgaaaaaaaagaatggaatcttgatcaagattcttaagacctaattaccactacagccgcgacctcgattttgttttcttccggcctgatccaacaggcatcgcaagttaagtacgtggttttcatccccatcaattcaattctacccaaatcaagtcttatgttaacggcatgcgttggtcgtctaattcatgctgaccactaattaagttactggctagtagcttagctactgacaacattctttcttaaaaagggagatctatatacattcatatatatgtacatgtgtgtgtcgctttattaaagtggatcgatgaaccgacgaagaaattaggtaccacaaattaaaggtagcagtactgccgccattgtgccaaaaaccagctaattaaccatcggttttcactaatcaagcacaatcatgctactaattacccttttcaacctataaatttatcacggtcagatcaatttttctaattactttaaagataatataatagtagtaatcaaccctataaatacacaaggggtgcaacgaccatgcatgtatagcaaaaacacatttccaacattcggtcttcactactagctagtagtgtttttttcctacatatataaacaataattattcattgacaggcatcaagctagctagctagccaactgtctgcaagaagaagaagaagaagaaggtgcaggataaatcgatgaagaaggcgtcgtcgctgtctgagctggggttcgacgccgatggcccgtcattcttccggcacctgacgctgaccgatggcgacgacggcacgctgccccggcggcggctgatcaagatctcggtgatcggcgcgggcaacgtgggcatggccatcgcgcagacgatcctgacgcaggacctcgccgacgagatcgtgctgatcgacgcggtggcggacaaggtgcggggcgagatgctggacctgcagcacgcggcgg

SEQ ID NO: 58170 - DNA, 3141 bp, Oryza sativa
gacactatagaatactcaagcttggagatcactttttgtgaaagaaattcttctacatatgtcccttaaaacaaattgtttctgattggttaaaaactttatagtctttgtgtggtttctttcctctgtaattttgaaaacattttttgagttctataaaactacactgctgggcaaagtcctggcagtatttctagtcaaaaaaaaagttgtcttacctagcataataaagtctaacctatttttttggtattttctattttgcaatttttatgttgtttttagtttataagatgcaatgaaaataaaacatgcatttggaaagggaaacatgcaatgtgatacaagttacctcagcggggggagagacgtctcccaccaagcttgcctttcgctcagggtccttgataaggattgaacccctggaagcgaaagtacgcttgaaggtcgtcatgctgttgctgcatcaggttgcgttgttggtgttggtgaactgagcatcaacattcggttgtcattcttgcgtctgtgttaagtgttcatcgagtggggggtacacggtacccgggtacccaatgacaacccttgggccacactgcatggggtgggccaagtgtcctaggccccatgcgtcatacttgtaaataaagaaagagagattcccgggataagatataaatcccgaggatcctgcatatcttttatagatagaataggttgatctagttgcaatcaactagatactttccttgtaaccctccccctcatcctatataagagggggaaggggtccctagaggaggtcgaatcatctccacgactcttctgtctagcttctccgaccatttttccactatacacaagaaagaacacactggacgtacggtatttcctctctcagagggcttgaaccaggataatccctgcgtcaccatctctccttgatctagcgcacctcttaaaatatattgccgatcctagaaatcgacatcgaggttgtattggatctctcccgtttgcatgtcaattttatccatcctccttgtaatttctcccaagtcctaacgagaggaacttgagcaccattcaccattcattgggggatgaaggcatactgcttgatctgagggaatgaatgttcatgttccccagtgtatgtcatgagatgctctctgtcggctctcgctggcactcttccagaccgagcctctgaggctatggtgtagagcttgggtccatccgggtgcatccccagttggttcctaaccggcttcgtacatttgcacggatgttgaaccttcttgttcatttctcgccatgttgcgtgtgtccctatatgatccacctgcacaagattcttctatggtctatacgggaatggttagttcatgacagttgtacaaatgatatcccgagttaggtaatgggattttttttgtacaaccggggaaaaagaatatcaaagatccatctactccatgcttaagaatatgaccttgcactaaataattctcgtcaacacacggatgaggggttgaaatataagcaatctgatcattagaaataaccccaagtctgtatgctatgctagtaattagggaagtgcactcaacaggagcagtaaactttatactctctaaccattgcacatttcacaggagcaactttaatcttcctaactgtgacaaacatgataatcaatttatcctctcttataggcctaagatcacctctaggaaacaaagtcataacaatccatttgtgcataagcctaagtgtaggattatggatgtcattcgttctaggtttcttgcaaattggaccaccagaaatattttcccaaaatctgtttttctcgaacccagaaattccgaagaacggttttatagtcatcgtgaaaacaaagaagtgtacttaatcatttccatgtaagtgtaaattctttacggaaaaagcgaaaggaaattccatcttctatttctttcaaagtgtaccgaaattgtaaagtaagcaaacgagaaccaggctcatctgccaccgcaaatctctgccatccaacaactttccaaatggtatgagaattaacatccatacctatcttttttagtagctccggatcgtatgcccgcgtgtgagcaaatatctgatcctttagcatgtagtaggcttgcatctcctgatcaccgacaagatcgaggtcagcatcgttcaagaggcatggcgggatgccagttgttggtatttcttacgatcacagatagaatccgcaagcgcatggatataccgatgtaggactttccctacggagtatttcaagggtatcgaatccaagggaacgtgtgtgattatctcttcctccggttcatcaaggacataagataaatatgggcacagggcagagaggatttcttagtgagaaaaagtgtccaaggaaagcttaattttaatcctaacgcgatacttcaggcactagcaactcgctgttcctagatgtcgctctactatgtacccgcacagggaggacttaagtgctcttgagggctatcaccacctctacacccacgtctaacgtattgtgggatacgcagcaagtactggaaattaattatccagacaccgtgtctacgcaattaataactactctagtgctagctaaagactaaagcaatcactatataattaatggactatagtgaacaataatcccatatgctaattaggaactaacgaagaataattctcgctaagcaaatcttaattactcagaatgatatttctattgaaccagagtaattaacaaagtacaagaataaagagaggattatcgacaactctgggattcctccgacttcttctactttactctatccctattctaagtgtactatagaacatataatgaacctaaagtatacttagagcctcttgtaattcagctctacgtcttggtgtgtgttggaatgagggagaggagctctatttataggcttcatatgatagttacattatgggaaatgtcccaaacaccatccaaccatcattagggagcaatcctggacgcccacatggaaggctgggatgaattgggcttcatggcggttcagccgaaccatgggctggcccaactgcctccggccttct

SEQ ID NO: 58171 - DNA, 3503 bp, Oryza sativa
ccctaccactatggttgatgttttacatttatggttttatgcaggtattgacggcatatattttgtatttaacagccatcaacaaaacctcccacacttagctctttactcgttccgagtaatggttaaggatgaatgtggaataaaactttccaagatataatacaggtatacaatttattctaagccatacaagtacttgtgaactttccagtgtctaactatccatcttgggtaattgatgaatggaactgtcgtggctcaagtccttcttgttcctcctgtcaatctcttgggttttcatatattttttcaaagtagatatactcctcgaatgactttctctcaagtctctcgtgtggtttgatttgtggattctcaccaaggcatattttgctgaattgtcccaattctacaaggttgtatatgtggagcttggtagggatcaatcggggcatacctgcatcacatatttcaccaagccaaaagaccagacctaaggagatcgcaagtcatactctctgatcaagaatgtgcatgtgtgtgatatgtgtatggttgttttgtgggtggaaaaaggaaaaataaatgataacaactcctttgatatacctcctcctccaattttctctcattgtccaatttgagagagtgcatggctatccgtttttttcttcttttttttttcattccccatactttatatgagcaagattttctctctcttttttttcttttcaatgctccatttttctatgagcaaaaatttatttttctttattttgcgtagccatgcctctctctctcttttttttttgaaagaattttggaggatgaggcataaatgacatggagtatttattttgtggataatggataaaataaatgatggacaatggatgctagcttccagtgtagaaatttagcttacgtgcttgtaagtttagtgtacgtgatcttgataatgaaagtatcaaaaagcatctcacatgggtcacaataatttgagaaagctcaatgtaatgtcagtcagcctatacatgtaatgttttgcaatgagaatcatatatggccttggtagttaataatatagtcgctgaggagtattgccttgcaatgagaatcatatatgactgctgaattttgtgcgcggccataggctggtgttcatcacagtgtcatgttgagtcgatgctgttgcgcgtcgagagttcgaaaagactcccccacacttgtgttgtggcttgtctttattcaacaaaaaggatggaaagcaaaataggcttctaccggggtaaaatatcggtgagccaaattttatttaagtaactctaggcgcatgaagtgcctaaatttacttttattttatttcacttttattttgtttttatttttattttcattttataatttttatagttttatttttatttttattatggcatcaattgaggtgatgggtaacttagcagggtggacatatgtgaggcgaggatgcacgaggtgtttcgaattattaccagataggtcttaccaagctttgatttggatgcaagaatacagcacaactttgcatttgttctgcttggtttcctaagcatctgtcttctcatagactaaggagcgtggtatgaatgttggagttattttacactactcctctattgtcttttttatttcctgcaaaaggttagtggataacaaatacccgagggacaacaaaaaattgaaaagattttatcatagcctgaagattaattgttcacatccatgctaacaaggaattgaattcttaataagcatggatcccacaattttgccataattttattttgtcatcatctttttttctttttactccagagacacatttttttaatcgagagacgcttcttttattctttgaaaacaaaattttcttttttttctctttctttctttcaattttttttattgttcaccaaattttcatttaagcaaaactcatacagggctaaggtaaatttgcatgaacatgctaaaggagcaattagaaatatgcgcaccgtacaccttgataggtgatatgtttctcctttttatgttagcaactgatttttctcctagctctgtcttacctccagtgtgactcgtgcttgaggactcgctcgtcaatttgaaaaattccctgcaggggttagttcacgaaggatatacatccgaagtccatgaaagtactggacctacggttcatttaagcaaacttgacaccacgtcaactttaattaaagaaggctatttatcctaagcatcatgcttaattttaaaaagcctatgaatgtcgacgaccacccaaaccatagcatacgaaaatggactgaggacgcataaccaggtatgatcaagccaaactcatctaaagacaagtatgtgtaaaagaaatggtgaatcatttgctgtcttttgtataccttaccgccggcatgatgcatatgttgaaatctctggagcggtagcatgatcacatgtgattgtcgatctctcctccgtcttgatgcgggttgtggtggaggaaggcactttgatcacgccaactcaagcgagtgcttcggttatgcacacatctcaggtgcaagaaccctttaccttgtgttggacgagattttgtgcattttttttaagtaaaactaaaaatcatgaatgtgccaatcgaaggaacaaacaaacaagctgtgtgcatttcccacaagttttcactatatgcgtaaattccatgattagttaaacacggtaattagtcttaactgaagtgattactgacaaggacgcacaaatgcaccagaaagtaataggggttgcttgtctgacatctttatcagtgccatatgcatctatacttgatcacctgggttcacaggtcagcctgatgatgaatggcaatatatatgggacaatcgatcggcagctatgcatgctctctgctggtcaatacaatgtgtatataaagcaaaatggaaacacacacgatcccattccatgctagaaaattttggaatggaagcattccatcacaatatcctctttgaaaagctgaaattgagctatctagcctgaaaattaattttcacaaaagtgaattattttgttttggtcacgcaaaggattattatgatcagtattataatatcttcggttgtaagttaggtaacttccctgtcaaatatctcggtattccaatgcattttaaaaagcttagtaacaaggattggaaagttattgcacaaagaattgaaaagaaacttagtagttggaaaggtaaacatatgtctgtcggaggtagattggttttgattaattatgtactttcaagtttagctatgtttatgatatccttttttgagataccaaaaggggttcttaaaaaaatgattattatagatcacgcttctttttgcaaggggatgatcataagaaaaagtaaaggcttggtagatgggatattatatgccaggccaaagatcagg

SEQ ID NO: 58172 - DNA, 7305 bp, Oryza sativa
cttgagacgacggttatacaactttttaccaactatggatggagattcacaaataggcttcaataaatgtgtactccttatcctattttggttattttacttcttaaattggtgtcctatttttttttttgaactttacttgttttagagtgttagtttgtaataattggttgtagctcttttgagcaaaggccgggatgatctattccattatctaaaaaaaatcctctttagttggatagttatcgggctctaactcatttggaatcaacagtagatttcgaatatgcatttgcatggaattaaaataaatacggtggataatattgttttggccaaagatccttgctatatatgtccgcgcggctgggacgcgcgtgtgcatacaaatacaaggaaatgctctctttgcgccacagtcgattggaaagtgatcgcacatcaatggatctctgatacggccggatcgccactataaaacaggccatttccttcacggcggggggaggcagcagagagagtacagaggcacgagccgagggcctgcagttcacgccgccgctgccgccatgcccagccttggcagtagtccctagagagacatacacagagacacaggagagaaacacagaaacacaaggacaaggagagcggacacaggctgctcatcggcaaccatcacgcacgtcgtcttggccggagtatctcggcgtcctgcgggaacgagcgtgctctgcggccggcgacatcggctgccgtacctcggcgtccggcaaggaggcgcgtgcgctgagccgctgaggaagcgcgctaaggaggagacgatcaccagggagacgatgccgctccagttcactgccatgggtaactagcctattttcttatcatccctttgctccatttcagcgcatgcacgccggtatgaagctcctcagcagagaagatgccggatgcaccgccatcgtcagagtcgccagagttgacgtcgtctgcaagtctccgtcaaggtgaagacgatgtttctatatggcgcggcgatgttgaagacgatgtttctatatggcgaggagatgtcgccgagatgctcggacgtcgtcaccttgctggtcggcctcttctctgcaacgccgtcgacgtccgctccccctcatcaacgctgctatcttcttcacattcattgccttgctgcctgaagagaacgccggccggagcaccactacttggtgcctgcaaggctattggattgtaatcttagagcatttatattctcttttgtttcgttgcatgtagagttcggttggagtctgaattctagccggtagaatagcatttttctgttttagcatatttgcttccttctttagctgcgttgactcggctcggatcgtgggatggcgcggtcagtagttgatccgagattgtcgtgatttgattcttttatgcatgtaacaaactccgtctggagatgaataaatagaagagaaaaccgaaaaagctgcactgtattacgcagtgccaactctgttcgtcagttgttctgttcgactctgttttttcggaacttcttcagttagctgtagctgcacctacaagcgtcagagtgtgtgtttcagagagactgagagccagttcgcatgagttttttctgacatttggtatcagagctttgctgagacgatccggtaatgtcatacacaccgcctggccgtcgtggtggcggtggcggcgggggaagcgacaacggctgcggcatcactcccgctagtcgatgcagggcacactgcccgtctcttgatcctgtcgaggacaaattatatagactgagcgctgttgatgcgcgtcaacctgcaggcgcaggggctctggacggccatcgatccctgctatgcggagtaccgcgaggatcgtgcagcgctctcggcgattctccaagctgtgccccgcgagatgttgcgcggcttggcaaagcacgacacggcgaaggcggcgtgggatgccattaaaaccatgcgggtcggtgtcgaccgcgtgagcgaggcgagggagcagggattccgccgtcagttcgaggcgatgcgcttcaaggacggtgagacaccggaggaatttgcgatgcggctcactgccatcgttgcggacatgcgcaacatgggcggagtcatggaagacgaacacatcaacaagaagctgctgcgtgttgtccccaagaagtacaagccggtggcaatttccctcgagcagctcctcgacgtgaagaccatggccctggaggagctcatcgagtggctgtcgacggtcgactcctacagtgatgatgaggaggcaagtgacggtggcaaattgtacctcactaaggagcagtggcaggccggtgtcaagcagcgggagtaggagggatctggcagcagcaacaagggccgggcgggctctggcaaccagaaccgtcgaggcaaggccggcgattcaccgaagggaaaggagatggccaccagcggccatggctgtcgtgacatctctaaggtgaagtgtttcaattgtgatgaatacggtcattactcgaagcagtgccgtatgccgcgtcgccaatgtcggggagaggcaaatgcaaatctggtccaggctgaggaagagccgactctgctcatggcacacgtgatgggggtgtcgctcgccggcgaagcggccgttggtcgaacaccttgtgtgcaggaagtgcatctcacagagaagaaggttgtgctggaccatgaggatgggcgtaaggaggagaagactggagagtggttcctggacaccggggccacgaatcacttgacgggcgcacgctcagcgttcgcggagcttgacactggtgttgtgggcacggttaaattcagcgatggctcagtggttgacatctaggggcgcggaactgtggtgtttcagagcaagaatggtgatcaccgctcactagaggcagtgtactacatccccaagctgagaaaaaacattgttagtgttggtcgcctcgatgcgcgcggctacgacgcacacatttggcatggtgttttcacgttgcgtgacccggaagggatgcagctagctaaggtaaatcgtgattcaagttacctgtatgttctcaagttgaaccttgcgacactaatctgtatggcagcgagcggctccgagctagcatggcgatggcatgcacgatttggccatctgaatttcctggcacttcggaggttggcaaaaggaggcgtggtccgcaggatcccgcaaattgatcacattgatcagttgtgtgacgggtacctcgcgggcaaacaacatcgcacaccgttcccagaggaggcgcagtacagggcgcagacggcgctcgagctggtgcacggtgacctctgcggaccaatcacgccggcgacgacagggggcaagaagtatttcttgctcctagtcgatgacatgagtcatcacatgtggatacgactcctctctgccaaacacgaagcatcggcagcgattaagccggcgtggagaaggatagcaatcggaagctcatggcgctgcgcactgatcgcgggggtgaattcacctctatagagttcatggagtactacgcggacacaggggtgaaacgttaaatcactgcaccctactcacggcagcagaacagtgtcgtggagcggcgcaatcagactgtggtggcagcagctaggtccatgctgaaggcggcaaacatgctggcatatttctggggagaggcggtggttgcagccgtctatgtcttgagcaaatcaccaatgaagagtcttgatggggtgacgccgtatgaagcgtggtatggtcgccgacccactgtcgaacacctgcgtgtgtttgagtgtgtgggctatgttaagacagccaagccaaacttgagaaagcttgatgatcgtagcacgaggatggtcttcatcggctacgagcaaggatcaaaagcctacaagatgtatgattttgtggggcgacgcgtgtgtgtgtcacgcgacgtcgtttttttatgagacgacgttctgggactggggcagcaacactgatgaagaaggagatcaggacgcgtatgtggagtttacggtggagaatttcacaatcccagtccaagggagtgagacacatgcccaggatgcagcagccactccaaccatgctagcaacatcaccaacatcaagcaccggaactgcaacaactctgccatctggtgttgaattctgttcccctccaactgatgctagtgaagggactgatgaagggcccaggagctacagaacagtggtgaacacgcttgccaccttgaccccaatcctagattttaattacagtgatcaatgccttatggcagcagaggaaccagcaagtttcttggaggctgagcaggagagctgctggaggaaggccatgcttgaagagatggaatcaattgaaggtaacaacacctggactctctatgatttgccctctagccacagagcaacaggactgaaatgggtttacaaaatcaaacgtgatgccaaagatgtcattgtgaagtacaaagctcgattggtggcaaagggatatgtccatcaacaaggagttgattttgatgaagtatttgccccagtgacgaggatggagactgtgcgattgctgattgcaacggctgctcatcagggatgggaagttcatcagatggatgtgaaattagctttcttgaatagggaattggaagaagatgcttaggtggttcaaccacctggttttgttgttgatggaaaagaagacaaggtgttgaaattgaagaaggccctatatggactgaaacaagcaccacgtgcatgttatgcgaagttggattctagtcttgtgagcctgaattttgtcaagagtggtgtcaaaagtgctgtgtatactcgaggagagaagaactcatgacttgtggttggtgtatatgtggatgatctcattactacaggagcaagtctgatggaaataaacaagtttaaggagcagatgcaggctctttttaaaatgagtgatctcggtctgctctcttattatctcgggatggaggtgaaacatgcaaaggaagggatcacagtgtctcaaggtgcatatgcagcaaagatacttgacaaagctgggatgagggattgtaatccatgtcagactcccatggatgctcggttgaagttgagaaaggagggaggagaatgtatggaggaaactcaattcagaagcataattgggagcttgaggtacttggtgaacacaagacctcatctaagttattcggttggttatgttagcaggtttatggagaaaccgacctctgaacattgggctgccatgaaacatatctattattatattattaaaacagccttgaaaggaggcaccacgttcgctgtgggggctagaaattcccacattaatcgaagaaaaagaaaaaaagaaaaaggagagtccaagtagaagtctaatttaaaaatacttgaaattcggaattaaaaataagaaatattgaaagaagtttccatataagaacccaatatgagattaaccaaaatttaaaataaaaaaaataaaatctaaaattagaaaaggaaaggagagtccaagtagaagtccaatttaaaaatagctgaaattcgaaattaaaaataagaaatattaaaagaagagtccatataagaacccaatacgagattaattaaaattcggaataaaaataaaaaaaatccgaaattagaaatggaaaggagagcccaagtagaaatacaatttaaaaatagctgaaattcggaattaaaactaagcaatattaaaagaagtgtccatataagaacccaatccgagattaaccaaaattcgaaataaaattaaaataaaatccaaaattagaaaaggaaagaagagttcaagttggaatacaatttaaaaatagctgaaattcggaattaaaaataaggaatattaaaagaagagtccatataagaacccaatacgagattaattaaaattcagaataaaaataaaaataaattcaaaattagcaaaagaaaataaaagaagagttcaagtagaaattcaatttaaaattagctgaaattcggaattaaaaataagcaatgttgaaagaagaatccgtataagaacccaatacgagattaattaaaatttcaaataaaaaataaaataatatctaaaatttgaaaaactaaaagagagtttaagtaggaatacaattttgaaacaactgaaattaaaaataaaaaaaataaaaacatttaaagaacacaatacggtattaactaatttttttaaaaaaataagttctgaaattagaaatgttaataaaacaacaaatagaatcctaatgacgattaaaaggagggacgtcaggcaggctgtgaagcaaacaagtaaggcggttgccgggacttctagaaagtaaaaaaataaaccccattgataatcatattcgatttttaaaatttcaatgacataaaaggagaagcagcgggcgggcgtataagagttatagaaaataaaaaatgaatttcaacaatagttatgttcgatctttagaatcacaatgacaataaagagtaggcgacagacgggctgtagaggggcatagtggcatcgttcaaattttaaaggatcggaacttccaaaaagtaaaaaaacctaatgataatcatgttcgattttaaaatctcaacgacaataaagaaaggaggcagcgggcgagccgtagaagagtacaatagcaaagccgctgacggtttgacgggacttaaagtaaaaatgaacccaaacgataattatgtttgatttttaaaatcttgtcacgaccggaaataacccaacgggcgttccttacgtgcgtgtattattccttgtccgaggaggcaaggtacaccaaaagttgatacatttcagagtttatcaagcggaagcgtaaatagttaatttattacatgggcagcgaaggcccagcacacaagaagacaaacaaaaaacagcgaaagactagggcgacgaccacaggcgcttgacggcaggcacgagctagacaccaaagccttcatcttccaggaactcctcttctgggtttgggaaaaattgagcaagactgagtacaaccaccggactcaacaagacacacccataagtgcagaataaatggaagggagtacaagggagccataatataggggttagggtttgcagtaaacagcattaaaagacacttaggtgctcacagctattttgtaaatatgtctctagagctatgcaata

SEQ ID NO: 58173 - DNA, 4736 bp, Oryza sativa
  unsure (1)..(4736): unsure at all n locations
aaaacatgttttggcagggctaccagttgacaatagacctcccaatgcttgtctcatcgcaacctagagacttgggtgggctaagattaggaatggttttttaggacatcggctatggaataatgccattacttttgctgaagggtgttaaatggctactctcctccttcaaatcaaatgtgcaatatgccttattttctactttgatattctggagacttaaacatcaagagcttatttatcttcttcttcattttttttttatatccttgatacttcttgcttgaaaacggaatgatcccatctaaaatattgtttgatggtcatagcttgattataaaatttcttccaataactgtagttcttcatatgacttgttggagaaccatccccttgggaattcagagagtagccattcaactttgtgactaaagaacccctcgcaggcttgattttcttttttttttttttgggtcccttgttatcaccgcacagggttggcaagtggctgcacaccgcatcacaacttttgttgggacaggtagccctttcatgctctttatctctatatttttcccctggggttttgtgtctccactggtctgagacgcattgagaaaacgagggacatgttgacctcgctaatcggtagttatccgagcaattatttccattgcccccggtagccgctgcttgacatgtgtgttgtgtgatgaaagtagattgattcttttgcttgattagttttggacaagtcctagggcagccaaatctttagtcgtgagcatgacatgacatagagaaagccagttgcccctgtttcatatgggaactgaatggaattttgtaggaaaaaaacaatttttttttaaaaaaaatgaaggctataattgcatagcatctccatgataatgtaagaaagtagatgttgatggcagaagtagctagatgaaacatggctttgcactgtcctctgtatagtaacagcttgaaagagtggagggagaggtcggtgcggacgaccgtcgaaggaacgtgactcggcaccttcctgtagcaaagactcaagaagaaaatatcgatggagaagttggtgcagatggcagccgaaggaaacgtggcttggcacctctccatgtggtagattacacctaacatagtaccggcgaaagtttgaaagcgagtccggtagtgacggtgacctaggaggaagcaattcctcgttgaattggcggggcagttgtggaggtcatagatgcatcttcaacacagacagctccctaatatcacaaatagtgccacgttgcttcatgacatagtcgagcggcgctcaaaagacatgggcagcagtgtattgactcatgccggtgtagacggggctaagctccacggccacagccgacatctccgtgtcgtgattatgggtcctcgatcaggcacagctaagtggcgtccacggctgcttcgacgacctcctgtgaggaagcgtgatgatgctctcacgtgagatggtgtgatggaaatctttcgtgaggtcggatatttagttgttatggatgcgggcagctcagcgatgttctcgatggctccggtgagaccttctagatcggggatggcttggcgacatctgcagctgctccgttgatccacgacgcactccggcagggcgatgtaacgacatcctcctcctgcagatgatgattgctcggcgaggatgagcattatttgacagtgcctcgtctgctcgatgatggcaataaggtctcatgtatcgtggatgcgagcagctcgatgacgtccacatcggctccaaccaccctcgacgcactctggcagggtagcgacaatggagagagcgagcatcatggatagataacatcgatcttgacatgatggggaggaaaaaaaaacgactccgatgtgacggaggacaggttcccctaacgagaagcacgacgacaactccgacatggcaagttcgcctcagcaaattgagggcgtccggcctcttgacgacgttgcaacgtcaggtagatgcatcaccagtgactcgaacgggtgatgtcgacaccaaggatgagtagcatctcgtcgactcggatgggtggcatgacggcattcttgggcagccattgatctcactttcatgcttgctgatggtcagggcgctcgtcctcctgccggacgcggtgcttcggccgaggtcgttcgccgtcgctgatgtgctacggccgcgtttgtgctgctgctccgccgcgggtcagtgtgtattgttggtgtgcctggataggaataaatggatggatgtgttggatgtatatgattatcaaagttgatggtctactggccgccggtgcgtgcgcccagatggctttctcctcctttggcctctgcctccctatcgcgccgggcaccggtgatgtgcaagcgtcccagctgtggatgagtagatgtatctgttctcttgccgctatgttctacctttgtcctctctctatagtgagatggcctcccttctatagtggagaggagatagttcacagccagctgcatgcatggctttatcgatatatgcatggccagttgtccaactaaatactccggtgttcacgtcatggttgtaagttcgggcaattttgacatgcccccggcacaaatttaagtatgaatttgcttgcccccggttgagcatcttgaattcccgatttcttgagcacttcacaacctatgaggctgctttcgaaatcgcaagtgccaccgggttgttatcattatggaagaaaatagctcttaaccagagcatttcatcaaccatcatatgtgttggagaaagaacacgaaagatgggaggaaaccagggcagtagacaatatgagtagctcatccaacacaatggaagtgaagaaggattgacatacgtgaaaaaaatcacttgattatttttttttgcggggaaaatcacttgattattacttcgcagtgtgagaagagctcttctacgcttgattattttaataaagaaaantttaacaactatttattagccggtgttgcatgagtcgacactatttgttaaagcccttgatagggtactgttcatgacttgctctttttcttgcctaggaaattacttcctcattttgctgtacgatgaaccgagtttatctgaagagcaccaagtattgcagttgttgggtagtataatttatataagtaccatgcagaaccacggcaggtgatcatgctattaggccatcagaaatgttgcattttaagaggctaccatggttttgtgcttgttgttcaggagctggcccgcttagctccattcccctgttcaagactcaagagcagccatactcaatatgatcgctacgcttggcatggtcactgcggtcgcatgctagccgtagttgcggtgcgcgcgctcacgtagtgaccatttttgccaagccagctgtcccgtgccgcctgctcttcccactgccagtctgccccttgccacaccggcgcgcctatgaccgtagcagtgtggagattatggatatcccatatctacacggcgatgatatttgggctgaatataggataccgaatatagatagaatatcttatgtgtatcctgggtttgtttcttaacttgtacatcaaggaaacaccttgagacttagtcggtcacgactgtatttaatctgtatctgtgtattccgttagggatatagattaacttttgtaacccggactccttcccatatataaggggggtccgggcgcctctaggggcgaaggttgattttctctaaatcatacaatcaataatacactcggcggattcatccccggaaaggagtagggtattacttcttttataagaaggcctgaacctgtataaatcctttgtctccaaacccatacacttttccagcttgatagccacccccttttattattgccgaaatctagtttcgacagttggcgcgccaggtaggggcagcgtcaagcttttcgccgatcagtgcaatgggtcccatctccggcatcgacgacctcgtcttcccacccgggcagacgtttcggttcggcagtctcaacttcgtcaccaacaacttcggcaagatctctctccttgactcggaatcggaccagtcgggagagaaccggatctcagtcccgttcggattcccaaacgcggctgaaagctacttcaagaccatctcaatcgagtcggcttcaaaccactcggctgagatcgcatcttcttcaacgtcaccagatcaagatgatggggcttacccaccgatcctgatgcagctccccgacgatttggcgaccgtctccatcacgacagcgtctccttcccgtaggcctgggcggaagtcggcttcaacaccgatttcacctagcttcagggaagtcggcgtcatcctccaaccactcggcacggtttcgacggatcagctggatggctaccacagctctcccaccgtcgactcgcgccccaccgacatcgtggagtacgacgagtttagctctcgctacaactacgcggatctcgacgacttcgacggaagcctagatgacaactacacccctctctacttcggcgtcttcatggccaataacgagacggaggaacaacgccaagcccgggagaacgaagcgcgtcgtgagactgagcgtcgccgactggaggaggagcatcaagcacaagaacaggaacggctacggcgtgagca

SEQ ID NO: 58174 - DNA, 870 bp, Oryza sativa
tgtgatatactcataaatgcccctccacaatattaatcagttagtgattagtgaataattagttgatttgcttgcacagtagaaacagagagagaaccggcggcttggggcggcggcgacggcgccttggggcggctctgcttcttcgcgggagtcgggcagcggcagcggcttgcacgagagagacggagagacaaccggcgccttggggcggcggcgatggcgccctggggaggctctccttcacggcagaggggcggcggaggcggctttgggcggcacggattcttcgcgggagaggggcggcggcggcggcggagggccggcgcgacggcgcggaagaagcagcgcgggatggccggcgcggcagcagcggcgggggatggctggcgcggcagcaagggaggggcggcgacgctacgatgaggcgagagagagagagagagagagagagcttgcgcggcgaggtagcagctgcgcgggagggccggcgcggcagcggcggcggcggtggccggcgcggcagcaagggaggggcggcggcgcttcgatgaggcgagagagagagagagcttgcgcgcacggtgaggcgagaaagacgaagaggagacagagcgagagagaaggggaggcgcttttattggtgagcggcttcgccgcttcggtgggaacggacaccacgcttagagtctttttaatatggtatagatatacctagaaccaaaatcaaacaaaaaaagttcaaactcagttcaatgaacttgctagtaaagaagttaatgttcatacctaaacattttcaaaaaattcatactcattcaaattgggtacatactcaatttgagtcttggagcccatactccatatagc

SEQ ID NO: 58175 - DNA, 5897 bp, Oryza sativa
cccctacacccacgagacccatggatcagtcaacagcgcggacgtcgaggcagacgcgggcggcgatgtcgacgacggagccggtgggcggtgctggctcagagatgaagaccgggagaaggagcagccaatgctccattttagatatgaagcttcttcttcagaaaccgtctgacgggacgaagaagatagcctatgagctatacctgtgcagatccacatagctttggatggtccgatgctgcgagttattccttgggccacggacatgccagtgttggctatggctccggcggcgctgctctgatccccgaattggattgacgcgattggggttgaggtgtactgatccatggctagatgacgtaggctgctgtgtaacgtaccgggcataatatagacctcagctcgctagtcgcgatcaaagctggcatgctcctacacgccaggttcatcagtaaaaggagatataataactgcaaaactgaaatcaaggtagttgcttgcttgcttgcttgcatccagcgtggcacgtcgccttgatctatgtggatcgcaggtacttgctggagctgagttgaaatgttactccctccgtttcgttttatctgacatcgttgactttttagcacatatttaaccgctcgtcttatttaaaaaatttaaataattattaatttttttcatatcatttgattcattattaaatatacttttatgcatacgtataattttacatatttcacaaaaaactataagacgaacggtcaaacataaaataaaaagtcaacggtgtcaaataaaatgaaacggagggagtactgagtaatattttgggtgcacgagttgccgcccatcatcgttagtggccagcagtagctgatgttttatgtgcattttcatgcatgtcgcataattgttgtaacatatatatgacaattcggacttacgtgtacgtctcttacttgctaggaaaatcatggcgtgagttacatgtaaacaaagcaaattaagtttgtcaaggtctcctcactccggccgttccatgggaggaagttcttgctgatggacaatggatagaagaggaggatgcgtgagcgtgactagtcagcataagctttactttgctatactagtcagcatgcatgtggaatccacgttaccaaacaaatttatgaaaatgttgaatatggatcccatctgaatctctatttagaaagacaatcttgaaagcagtggaccaaatataaccatctacaacacacccacttctttgccgattttgctatacttcttacgaccgtttttttttttttgcctcaaatcactcgaatttgattccggcggatcacttgggcatgatttaatttgacagttgtgatttatcccttaccaccacggcaccacctagcagtatctttatcgggcacacaatgaacaaatgaacaatacaaacaaactgatgagtacgggcaaaaatatgaacagatgcaagttagttttgtttgatgatttgatgttctattttttcatgtcgaattagggcaggaaattgtggatttagtgattatgtttttttctcaattctttagtgcttacaaccaactatattgtaatatgtatttgttgtacagacaaaataaagtttatgttagagttacgctataattacactatagttacagtgtacttacattgtacttacattgtaattactatgtaattatagtgtaactatagtataactacaatgtaacttttggatgggttaatcatattttttatacaatataagatctagcaaataaagtatacaatatatatacctgctgatatcatactataaggcagctttcacggttacgggttaacgatgtgattaagaatttgactaattttggttagaaaatactcgtatgtgactgtagcatattaatgaactgatattatctatggtggtatggtgcccattggtatgcagactaaacatgcctcttagtatcgttgcaagtatacttgccaaatatcaaaagcgagaagcaaacccgagtagaaatcaaccagttacaaataaatttgtgcctctacagacctgacaatctggatcactaaggctacagcatgggatgctgacttcataaaagagtatacacgtcaagtttaaacatcggtatttttcttcttggcacgggggccgtaccacttcagcagacatcggtaggagggcagcagagccagtgtgtggcttaaatttctgtttttcaaaaggtagcgcatcttgaacacttttttgtgcttgcaatgttcacctctgggatttttatctgctttgtacgcttccagctcaaagccgatggagagctgtcggctctacccttgcttccgaggttgattcttcatgtgctaatgtgtcgtagcagtttctatgtcattagctttaactgttcttgctgcttttatctactattacttgattgaaatcaaagtatctgttttcgcttgtttgggtgtaggaattaaggtttctgtgtatgtttcatatgcggtctgtggagcacgctgtatttttgtatattattatttatttagtagtgtagtctatttagattagagggttgtttgtctataagcgggttacatgtgtacgtgtatgtactttggacttaacatcctccttttgtttgctttattggcatgttgtgagtattatacttatcataaatggaagattaaattagtcactacatctataaccttctattcatcgtaaaattatcagtttcacaaccgaatttcgtaatatcacctggacccatttctcagcacatatgcacttcaagatggttgcgatgtttatctttgcaatattcatatgccttatccgctactggctcaaagcacggaaaatcaagagtatacttggccttggcctccggtcaattcaacaccgcgtgggggcaaatgccccctataatttttttacttagttattgtaactaagtagtagattgtcggcctacacttgtcactaatagaattcaatggattccctagggagtttattgatcccatagccacgtacttggagtgccacactaaaatacactcaaaaccactaactttcaaaattccacgacaaacagttataaattgaactagtaataatatcattcccatagtgtgatccatccatataacccatggaaagaaactaaaagctatctaaaatattattacaagaccgaaccatgatatagtttaagtatcattatggacctaggcaatatagtttcatagtgtgcagataaatgtgtatataaggatgctacttcccacccatgcatgtcggtctcaatgcgtacctaaaaactagataaaacacaagactaagtacaaaaatactcagcaagtacaatgtggaactagaaaacacatgatgcaataaaacatgatgtgatgttgtatccatcgccgttcatcttctattgatttcttcataagcgcattaatttcttgcccccaagcaaaatcagctttcttgattacatgatttcgaaggcaaaacgataaactataccggtttcggacccggtcagcagcactgtttctagtgtttttcctgaaccgtttatcagaatcaaacgaaaccagaggtgttgaaaagataacagcaaaaactacaaatcttatttaggtcaccaaacttgaatctctatgagtaattatcagatttgaaaatacggtttcagcctagcggccgataaaaaataaattcgatctaccggaaacggatcgtcttctatataaattagaaacaaccaggggctaaaacgaattacctagcagtactagtttataagaagaacaatgaatttagaaatatccaccaaattccccaatttctcctattatttttcctgtcctccttgttccttctctgctttgctcttccattctctaaacgttgtagaagaagcagcagcagcagaccacctagcagcagcagcaaggaacgttggtagcagcagtagcgagcaaatcacaaagcggcaacaaatcagattgaagctcaccggaatgagcagaatagaaaggaaccaccgatgacgacggaggatgatggctgcagcaaccggcaacggtcggggcggtggtggcgatgcagaagcggcggcggcgtccgcaagaatggcaacaatggcggctagggcttcaagtatcgatctgttcttttttttcctttcttttttttctgttggttaaatagagggagcctaacaaagatcgagtggcccacattaattcgataaccggaaattcgtcaggactccgattaccacaaacttatagtctattttgcaagatacgctacctttcaaaaaaacagaaaattgagccacgcactggctctgctgccctcctaccgaggtctgctgcagcggcacgacccctgtgtcaagaagaaaaaggtcgagctgtacctgaacgatatggaacagctcggtaactacatgttcgaaggtgggccatgggatcaatggaactccctagggaatccattaaattctatcagtgacaagtgaaggctgacgatctactacttagttacaataacttagtaaagaaatgatagggagcatttgccccacgcggtgttgaattgactgggggccaaggcccccaactaagtatactcttgatctcacgtgctttgagccagtagcggataaggcatatgaatattgcagagataaacaatgcaaccatccagtggtggacccagcagtaaaatttagctatggcggatcaatgtgatatgactagcgtattatactcttaattaatgaattaaatataattatacacaaactatatactacaattgcacttattgaaatacatgtcactaaaatataaaattaccactataattctatatttgtcatgtggtttttacaaccaaaattttaattttctttataatatatctctattttacatatgttgtcactcatatcgaccttttttcagcatgttgctgccttttgtgcatatggtttagagcttggatagtcaggccaatcaacagttatttctgaaagtagagaagtagtaaaccactgttacacttacatccatttaactaaactgataaacttgtactaaatcagatagcaaattaatcatgtgattatcatctaaaatcaacatgctaatgaccaaatggacaaacaccaagcttgctttaccggtggcctagctatggcccatgccatggcatgccacaagagaagttccaccagtgcaaccatcctgaagtgttgaaggagtggtcgaggtggttttcaacttcggttttgactgcatatgtgctgagtaatgggtccaggtgatattacgaaattgggttgtgaaactgataatttttagtgactaatttaatcttccatttatgataagtatcatccgcgtttcggtacgggtgataaccacaggagacatggtgctgtgattgcggggcttaagagcgtgttcattcaacaagcccaatcgatttgtgtcgcgactccggctaaaccgttgattatcagaacctttcggaagatcaggaaccctagtccacatcaactagtgaatgaacatgttagttgcatagtcaaaccaccactattgagtttaaataaaaaggttatattatccacttttttaaatacttgggttgtattcaatttgatgatttttgtctacacaactgtagaaaagaaattcttggtgatatttgaagtgccatgtttttctcatataatctatcatgttattggcaattttgataacaaaggagaatattatgcattgagtatatttttgtttgaatttgaatgtacccttctttttat

SEQ ID NO: 58176 - DNA, 14900 bp, Oryza sativa
aattaccatttcaacgtcccgtgtatagtgagaaatcaatttaattaaggcgatcgtgtataccatgacatgattaattaaccgtgcctagcttacagcagttagtacttttactgtaagatatcgagagtgcccaattgatccattcattcgtgacggtgttgctgggaatgacgagagaggaggcgttagggttagaggtaggcgtacaacacacgaatcttaaaacgatgtaatggtctgaaatttgtaagattttatgaaatgttttacagtcaaatgccattaaggcagtctcgaaagaaaaagaacgaagacagaaagaaagccaaatggtcttgtctccgctttaaaaaaaaatggtcttgtctctgccataacatgaaagtgagtcaaacaattaatatactgtatatatatagtctctgtcaatcgctaatataacttcacaggaaatgtttacaattaaattacgcccatatcttcactactagatatggggattatattgttgaaactaaactacggcccgtgacctttcttcagctgccggcctaatatctccaaacctgaaccggatacggacaccaaacaagatcaagttctcatattacatcacaagtcccgccacataatgacagaccactaaacccgtgattaattgatatcgaaggcgaaacataacttaaattacacaattcacctcaaactcggcattcgcattaacaattgcaatacacgtcaataatttgtatatacttataaaagatatggatacaaatctgaatttcgtgggcaaattctaaaacattaatttacaagaaaatactagctgacatcaattgatagaaattagggagcaaaatcatgcaaatttatatcattccatttatgttataaaactaacactgagatcgactttggtagcaaaacatggaagaacaccataagagatccaaacatcgagacacgatattaaatttgttaacatggctagccaaaacgtacattcccagagcacttgttacagacgcttctccttgatcatatcacagtgtatcagatgtctatgaccctcaactggcgggtgtgacgggacgacggtgatgccaccttggctgcgaggagtagagtagtgttgatggcgaggtaagttttacattggagtagttaagaggcggaggcatgtgcatgcgtggtggatatgacggtgtaagagaatcatagtgagagaagataaagaagtgtactgaagtacggttgcgagaaggatgtaggttgatgtcacgccccgaactagtcccgaccggaactagcccgtgacgctccaaattaacctgttaatcgataccagtctgacggagcatgaggctcctcaccgggagaccgcgcaggcccccctttgccggttcggccgggggccctgggtgagattctaagctcttggtctgagtgtggaaggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttcccggatcgtttttttcctcccttctctaagtgggcaaggtcctccttttatatctcaaggggataccacatgcaccatctctccctctcacttctcttctcttcgttaatggacggagatttgtatggctgccgtccgaatgaccttctgatgggacggcccatacctacctccacttccgccggaagcaggcgcaacgtgggaacatggctgtctgctgacgacatgaccattgtcagaccggtcacaaatcggtcactcttgtccaccacgtgtcatttaacaatctgcatgttcgcccttctccatacaatatcttgcctgtaatggttaggatgaagcctggcgtatatctgaccggaaccaacgtgccatctccaggaggtaacacgccggctccggctagggacgagtgcttggaggctctcgtcctgacgggatggggcgaggcgtacgtcagaccgcctgtcgccacctaatccacgatttgaccggtctgtgactgatcacagaccggatgaacgagcgcgctgcactgcgttacatgcggcgtgacgcgctcgtccaaaccgcaataaatgcggttaggtgagcgccgctgcgctcacctaacccatacacgcggcgcaaaatccacaaggggtcagggcaccccagccctcgaggccgaaaccggagcggatcgacccctcggggagacaaagagaagggcgggcgtatcaccctcgggcccgaccccctcctcccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgctttgatcggcgagcgtaattaacgcgcgcacgagatgttccatctcgactgccacagccgcatatccacctcatgcaccgaaaacgggcgaatgggattagtggaagcgtgggcgcgagaaacgagggggcaagatagtgggtgcgagaaacgaggagccgggcacagcgttggcaagggtataaagtcgccgaggaagagatttgcttccttcctctcgccattattccccttgtcttcgccgcttgcgccctaactccttgtttcctgtaccctaccttcgccacacgcgctcgctcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccggcgccatgctacccggggcggtccgtcttcttcctcacttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagtcggtgtcgccgccgtcggtggttggtggctgctacttccagccgcgggggccggtgttgaaccgctacattccctgcgtcctccgcaagaagtgggatgactggaagagcgactggttctacacacccctcgccgacgaagcgcgcctccgacttccgagccagcccccggcgcaggcctccagctggcgggcgccggtagatctgggagatggctatgacgccgtcctcgaccgcctggcgggcctgcgatcccaggggctcacaggggccatggtgttcggcgactaccttcgtcgccggattgcgccgctccagcggcgcgctcggggcgcctgggagtacaccgggtccgaagactacatgaggacccaccagggggtcagatgggactgggctcctgaggacttcaagatagtggtccaacgggtgctgaatctcagctctgtggaggcatccctcattcctcaaggagtcctccccctctgcagcgatccagaccgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcaacgggggcccggggagcggccgccctgccgacgcccgggggaagaggaagcaggaaggaacccctcccccatctcctccccgagggggcggggtggcacgtgccagcagcaggcgcccggagggggccacgccgacgtcgcagcccgagggggagcggaagaagaaacggccccacaagatggggggcacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcgacggcatcctccgaggcgacccgtgaaactgaccagcaagaggccgcggatcgccttcgagaagccgaggaagctgctcaggtggccgtccgagctcgccaaactgaagaagccgctcgggaggaggccagacttcgccaagccgaggcgacgacgacttccgaaacagctcgcgacgaggctgcgggcgcatcgcttgggcccactccctcgtgcgacgctcgggacaaaccaggtccgggggacatccccgagtccggcacgtccatcggcgggccaagccgcgcggcatcctcttcgaggcggctcttccccacgccttccgttgctccactgagcgcagaaccccttctgcaggccttggcagtcgcaaacaccatggtgttggacgggttaagtgcccaaatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggagacggagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagtgcgggaggagcaggcgcgccgtaatctggaagatgcccgcgccgagagggccgcgctgaaccagcgggccgctgagctcgaggcgcgggagaaggagctggacgcgagggcgcgcagtggcggggcggccgcgggtgaaagcgacttaaccgcccgcctcgcagctgccgaacacaccatcgccgatctgcagggcgcgctagactcgtctgccggggaggtcgaggccctccgcttggcaggcgaggtagggcccggcatgcttcgggacgccgtctcccgtctagaccgcgccggccggcaggcgggcctctggggcgggcggactgcgaagtacgccgccaaccagaggggcctcgcccagcgcctctcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtggacgacagtggcgacgaggctggcgacccgggcgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtatatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtgatgaccgagggttatgggtgacccgattgtgggtttttgccgattcccccccggagttcaccacgccccggggcacggctcggttctgggccccgtttggcgattttagccgacccgagcccccgagggcaggattgaacacgagtaacctatttcaagtcaagatccttcaaaaggaaacaacagcacagatacagccttttaggaaatcgaaaatacttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggctgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctttgctggtagcgcgtggctcggagggacgcgcgccgccttcgctcttccaagtagtcgaggtcatctctgcgaatctgatcttgatcagcctcgcagtacatggtggcccgaggggacctcagggtgagctcggatgggagaaccgcttccacgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtagtcgccgaaaagttcactagtgaattgggtgccgttatccgtaataatacggttaggcactccaaaccgggctgtaatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatgaatatcggcaaaaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcacgtccgtctcccctaaggggtcgggtcgcgccgacggctgggcaagcctttcttcaaaggtgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcatagcaccggtactccttgcagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcggctgcgaggggcccgagctggcctcggggactgagacgggctcgggagctggggtccactctgccacaaaatcggcgagggcctggctcttgatagtgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccatatccctggggcgctctttgtccaagcggcctcgcggggtgcactcgtcttctgtgccgacgacctcggggtcggaggacgacaggggcggccttcccacagtggcctcggggccgtcctgggggtcgggggctcctggcgttgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagtgggcagagggcctgctccggtcgtcgggggccttgggccaccgttcggctcgggggcctctcctcccggctctctcccgggccaagccagcacagggtgggggtgcgcggaatgaggattgtcctcatcgcgctccaccaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctggggggcgcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccaagagtaaggtctcttggttgcgcgtctttacaaccaagtcatcgacataagcctcaacattacgtcctatttggctacccaaagaaattcgagtagtacgttgaaaagtaggacctgtattctttaacccgaagggcattgtcgtataacaataagttcctatgggggtaatgaatgcagttttttcctcatcctccctagccatgcgaatctgatggtaacccaagtatgcatctagaaaacacaaaaggtcgcaccccgctgtggagtcgataatctgatctatacgaggcagggggtaagggtccttaggacatgccttgttaaggtcggtgtagtcgatgcacatccgaagcttgtcgttcgccttgggaacgaccatcgggttcgccagccactccggatggatgacctcgcggatgaatccggcctccagaagtcgcgccacctcctcgcggatgaaggcttgacgttccggggcctggcgccgcactttctgccggaccggccttgcgcccggccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccactgcctcggggcggcgggggcaggggtgccaagcctctcgtcgcctccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaagaccgcgttgtagggcagactgaggtccgccacgtcaaagttcacccgctccgtgcggaagttggcggatccaccaaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgtgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcgacgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaagtgttgtggacgatgcaccacttgccggttgggcgctccctgctgggagcgccggcctccttctttttgtcgcccgcaggcctcccctttcgggtggcccgcgaagcgccctcgacggcgaggacatgaccctcgtcgtcggaatgggctgacctcttcttcctcctcctgtcatgccgccctgtctgagcagcaaatccgggggcggccgaagctgccacaccggaaccggaggggttccaggtccatgcctcttccttacgagccactcggtccgcgagctaaaaaagctccgtggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcaacatcccttcgctggactgcatgtaagtccacttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgccggccattacgccagcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacaaggaggcgacgctccccatctcgccgtccttccccatcacccgtggatgtcgaagtcgcggatccttcgaccctctcgagcgcctcctcccgcctaggactttggcgtggagggggcggtggagtacgatctcgacggcgtgggttcggctccccatcgtcaccgctaacactcggagagaggttgtgcgcctttgcttgttcggccattgggctgaacaggaaaagcttggcgcacacgaaagaatgcgagagcttagaaaaacacacgcaaagccccctacctggcgcgccagatgacggagcgtgaggctcctcaccgggagaccgcgcaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctactcctatgttttggtggatctgtgtatgaagaagctacaaagtgcgagccagcccccgatcgttcccggatcgtttttttcctcccttctctaagtgggcaaggtcctccttttatatctcaaggggataccacatgcaccatctctccctctcacttctcttctcttcgttaatggacggagatttgtatggctgccgtccgaatgaccttctgatgggacggcccatacctacctccacttccgccggaagcaggcgcaacgtgggaacatggctgtctgctgacgacatgaccattgtcagaccggtcacaaatcggtcactcttgtccaccacgtgtcagtttaacaatctgcatgttcgcccttctccatacaatatcttgcctgtaatggttaggatgaagcctggcgtatatctgaccggaaccaacgtgccatctccaggaggtaacacgccggctccggctagggacgagtgcttggaggctctcgtcctgacgggatggggcgaggcgtacgtcagaccgcctgtcgccacctaatccacgatttgaccggtctgtgactgatcacagaccggatgaacgagcgcgctgcactgcgttacatgcggcgtgacgcgctcgtccaaaccgcaataaatgcggttaggtgagcgccgctgcgctcacctaacccatacacgcggcgcaaaatccacaaggggtcggggcaccccagccctcggggccgaaacgggagcggtccgacccctcggggagacaaagagaagggcggccgtatcaccctcgggcccgaccccctcctcccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgctttgatcggcgagcgtaattaacgcgcgcacgagatgttccatctcgactgccacagcgcgcacgagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccaggggaaataagtgtttaatgcaggcttcaaggaaaggctgttgtttttgtaattgattttatttgaactctttttctaaaacaactagatgagtgcttctcaaacgacacggatgagacagtgcgtctcatccggtcggagtatgtgcaatgtatcagtctttaggattgcaacaaggttggcacccggccaacagcttttcaaacggccacccgggccaacaacttttcaaacggccacccgggccaacaacttttcaaacggccacccgggcctagctgatcccatcagctacagatttt

SEQ ID NO: 58177 - DNA, 5157 bp, Oryza sativa
attcctgcagcccggccaacagtctctaaaatgggcctaagcacagaaccatcacattataaaatgttttgatttctctattacttatctagaattgctaacatccatatgaatttagaagcatatatgttataatgtgaagcctatttaaaacccaacacatgttataatgtgaagcagaggaagtagtatttgtgagtgacatggcattacagaatttaccgttatttacgtacggtaccatagatgtcagattttatgatacaaaatataagggctaccacaatatgctaaaaaaaagtgatcttaagtaataaatatatagttaaggtgcatatacattgtacaagttaaaaatagtaaaaagtttcttgtgatgtaccttaagcttacaactaaccttaacaaaaacaagtacttattctttcctttactttctctctcctcaaatcacttaagagagttgggagccaccttaaattttattgagaaggctaatctctttttgcgaatcgaagaacacaaacaagaacaaagaagatacaaccaaaattgtagatgaatgatttagctcataagttggggtcttacaaaccgaactagcggcgaaattgttctcgatagaataatctaaacaaaaccccaaaccctaaaggtgacgacgggtactgatatatagattttagggtcgtgcaaccaacccttgatgcaaccctaataggttccaacacgatacacggaccaaaggcctaaatacgatgacacagcacttgaagacatcaacttgttcggtcaactagaaaggaaacccgcgcagatgcgcgggtgtcttatattactgttttatgaacacaacgctaaaaaaaaccatatttgttatttcctccgtttcatattataatactttctagtaatgcccacattcatatatatgctaatgaatctagacatatatgtatatgtgtacctaagattcattaatatctatatgaatgtgggcaatggtagaaagtcttataacctgaaacggaggtagtataagatatcgttattaccttataataaaaaagtatctacattgtcaaatagaccctagataatatgttagatgataataatttctcccagattctaataaaaatgacggcacccggttacgtataaattcccatattatcaagactacttattatcattgttttgaaacccgggcatatttaatagatgaaattgcatatgtcctatcaccaaaattaagcctaatacattattaatatactaaaaggtttaccattaatctgagtgtttgggtctcacttatttccaaatccatatataattattgcaagaatcccacttctataggttaatggaataacaccgttaaaatttgacataaatacccctctaacgggtgaagcttgccatagccgccaaggctttctttctccattaccttgaaaaaggggtcacgcatccatgtagccatgtcacttaaacctggcgttgaggacaattatcggcatgctcgtagaggattacaacggtaagtagaaagttgagcactattaccaacagtgacctccaatagggccacctaaactcagccatatgtatgcctttgctgatgcttacaacaacgtagcaagttttctcatccatgtttgatgtccttcaacgaaggacaagagagatgatggagatgataaacatagtttttctcacagaaatagttttatttacgttttgagtagatttgtggtataaagtagacatgatttgtttataatgttaatcggtactatttaatattttttatggatacaatattctcttttgaagataagcatggttgatcattcgactgtgcttaaaaaactatacataaagagacatatcacgatgataatctaaaaagcatcctatcattagtatttatattttgacctagatcctttttttggcaacatttgcttttaacacatgttgttcgtaataatatgaaaaactttcactaattccaagaatatatttattttctcaaacttatttacataattaatttgttcaagtgcacttataggcatcgttcgttctggtgagataggggagattgagtctcgtttaccgcgcgcacgcttttcaaactactaaacggtgttttttttgcaaaaaatttctatagaaaagttgctttaaaaaatcatattaattcatttttaaaatttaaaatagttaatactcaataatcatgagctaatagctcacctcgttttgcgtatcttcccaatctcctcaatccccttctcctcaaacactcccatagtcaagttagtgggggatatggcatacatatagcaattatgcccgacatattagaattcatcaacaataataaaatatatcatgagtagtttaatgtgcatgctattggactgctcatttgtagctaaaactattctgcatagaaaaatcatacatataaccatcataatccttgttatggattaaggtgcttgtgttatagaaagatcattgactcgaaatattttttatagtatttttcacattaccttgtatttaagaaagaattttccaggtgatagaaaacttgggagcaaagaagggattgggtaaaactttagggtcacatagaaaattttctctaaaatatgttgtgaaattattttaaaaaaatatcatgacattaattattttatgttggtcttatgtgtcctgatgtatttagcattataatatcattactataagtccacggtagttcatttaattagaggaatacaatatgatcacaaattgaatatctgattcaaaaataatttaaaacatggacgtatgtttagaagtaatatgttttatttttatattatagaaaattatatagaccgtccttttttccccatgatactaacacgcgtatacatgttttatttgggctttaactttttctactcgcacgtactacgtatggtattttgggttttttggctggtgaacagtacatcggctttaattattttttatcgtaagtaaatacgttgttaaattttcccagcgaaatagttacgtattttgtttgtatatatacacgggagatttggtggaagggattaattttgttcaatagatctaatctaatggtgtatactaatgggcccaccagtttaaatgaaaatcgatggtgagatggtttgcttttctataaattattagaaagtgccacgtggcggcctaggaatgtctgtaggagtccacgtggccgcttgagagcgtttgtaggaagtttaatggacttttagtatataatagatagatagattcccattgactcggaaacaatttggatgtgggaccaaaaccattggaaaggttatcttcttagctttccatccatataaagaacgccccaatccgagcacgtatgcgacctgggcacccgttttagtgtagactagtcatggactctgaattgcactcgaagtcggcttggtttgggcctccaccttgacttgcatgtccttgatgattctccatggctctaagtccttctccaagtgtctccttgtcctctccattgttgctaatcacaatataatcattaggtagcaatctattctcaaattcatacaaagaagaacataggaatgagctcacctctaaattcaattgtcgcgtgcgagctcttgttatcggtccttgaatgaccgttggaggattgttgtgtgtatccgaaggagtgatgtccgcatcgctagttgtagtatggatataagtgagacaacacacaacttttctttcttagaagaaacatcaagcaaattgttttatgacaaaggtatttcaacagttgtttccaatatgggttgctctaacgtaacatatgtagtgggcatatttcgtacatcataactattcataccttgagtaaatgtcgcaccattatcatcaccattgttctcatcttcagaaattgttggcgcttgctcaattaaactttcttaaagcatgcatggagcaacgagtaggccttcttcctctatgcctttcttctcttcctctttatcctggttgttctcaaatacctagaaaatgttagtaaatccaaaactcatgcaacaagtggcgggtatggcactgttgcagcggtggatgaaggtcgtgtactcactggcggtggtgtagtatgaaaatgaaggcttagctagtccagtaatgttaatctttcttggcatgcaggatgtgccaaaatttctctggttctttcgttgatgttcctgcaactcgttttctacaagcatagcaggctggaataaactattgatagtagtaaattctttattataaacaatatcctgaatttcgctcctcaacccaccataaaaacgaccaattgtatcccctgcttcatctactactccgtaacatatcatacacttttgaagctcgagtagtatttatgaacaatcatatcaacttgatattaatgttgtaatttcttatgcaaatcacgctggtaagaaagaggaacaaatctattacgcatgacatcttttagcttattccatatagcaggttgtaagtggatatcgcttagatcattccactagattattgcaaagtccttgaacacactagtagattgtctaaatctatgtaccttaggaactaggtgtgagttaaacttttgttctactatcatctcccaatcaaagtattcctcagtatcacaagcaccagaaaatgatggaatactaaacttgactttaacaaaattattactttccatacattgacgtagttgttcatcttgtgttgcttcatggccaacctctccatgttcatgggtactatatcagaggagtagagagccattgaactcgtgaagtctatcgtttagagtagctaaccattttttctcatgctcaagggaattggttatgtctaactaggtaatagccactactggaaaattaactattgccacataaatattgcaacgatgtataaattgttgcaattagttacactgtagccacaattttattttttgtggtatttataatagtatatcaccacaatatataattgttgtaataatagtatatccacccttttcatcgcttggtctattgtacc

SEQ ID NO: 58178 - DNA, 14635 bp, Oryza sativa
tgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaacctaagttttacccaagttgttactcagattttaaatttgaaggcgaccgtcgatactcgcacagagtgcgcgagtatcgaggcgcagctgggtggttacaaggggacatggtatagcaattaacaaaggaaggatcaaatgcgacaaattaggtaggtccgccaatctgccttgcagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactacacgggaaacgggacaactcaacaaacggcaaaaataaagccctattaacgacctctaagcgtgccataagatcgatctcgagatttggggaattttggaagttgaacggagtcaaacggatttacggttgggaagatattgaatttctaagattattgaattttttatctaaaggaaaaggatttaattaaatcctttttggaaaagaaaaagaaaagaagggagggagggaatatagacttttctcggacggctagggcgcggcccaagagaaatggagcggtccggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcgcgcgggcggggaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggccgcgaatggacggcgggcggcggcggcgagcggcggagcgaaccacggcgatacgggcaacagcgagcacaccggacggttgcacgtgacaaggggaggcgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacggtagcgtcggattgggcggaactacgccgagcgaggccggcgacgagcgggtgctacggagctcgggcggcgacggcggcgagcacacggcgagcgacggcaacggtcggggcggcgccggctaactacggggagtctactcaagctactaccgaaagctagggggaggagatggagcgaggaggaagaactgagagggacactaccgtgcgggacggggcgcagtgacgagaggccgacggcgcgggagtgatctctccggcctcgggccgaggaagaggaagaagagggcgcgcccggagtccccttccgcgtccacgaacgcaccggctcacccggcgcttggcaatggacggcggaggcgaggcagagcacgggagcggcggcaacggtgaggaggcgaatgggagaggaaaggaagggagggggaagacgggtttaaatgggcggcaatgtcggtttgagagaggggaaccgacatgggcggtcaagccggcgagctggcgctccggctagcgtcccaagcggcgacaggaggtgacgccggcgagaggggaaaaaggggagaaaaagaggaaaaggagggagagaaagggggctcgcccctttgccgattcgggaaaaggaggagggagcggggtgactcggcagggggagaggggctctctgcctccgccccttggaggctagcgcgcggagtggctggggccgggcgatgacgacggcgatgacggtgggatggtttggagcggcgcgacgacacgggtgacaggcgtgggctggcgcggcaggggggtgacggcggcggcgaccaggcggtcggccactcggcacgcgcgcgcgggaagcaacgggcggcgcgactgggcagcgggaccgggcgacgcggacggcgcagacaacgcggctcgggcgggaaaccacgcgggcgcgcgcgcgagcaacggcgcgcggggccggctttgcgagcggggagcttgcgcgagaggagggggcgctcggcgcggctctcgcacgcgcgagcagcgagcgggggggaggggaaacgcgccggggtggggagggagcgagagagagagagagagaaagagagagagagagagagcgggagagcgcccgggggggagagggagagatgggccggggaagaggggaagatgggccgagcgagattcggcccatcgacctcgggggaggcaaaatagacttttgcggaggaatttgatttggaaggatttggattcggaattgaactcgacgatagatcggggattgagatcttgagatggcacggacactagacaacaatcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttctcgttcccaggttgcctcatcttcagaatgattgctccattggactttgtagaacttgatggtcttccttcgagtctgacgttctgcctcttcaagaaccttgatcggtctttccttgtaggtcagattcttttccagctcgatattacccaggggaacttgctcttctggaactcgaagacatttctttagctgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcccttttcgaactcaaggtcacgcctccgattgtcagtgtaattcttatgacggttctgtgctgtcttcaaacgttctcgtatcagcttaacttgttcttctgctgacttgagtatgtcaggaccgaataccagtgcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccaaggcacacgcacgcagcatgtcttctaggatttggtttaccctttccgtctgaccatcggtctgtggatggtaggccgtactaaaatttagatcagttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggtgacggagcgtggggctcctcaccgggagaccgcgcaggcccccctttgccggttcggccggggaccctaggtgagactccaagctcccaatctgtatgtggaaggttcgcgagacaggaagcacagaagacgccggcgatgtatacaggttcgggccgcttagaagcgtaataccctactcctgtgttttggttgattcgtgtgtgaaggagctacaaagtatgagcctgcctctcccttgttctgggttcctaatctggaaaagtccagtcccaaaaaaaaaacctccctctctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgaccagtgtcagactggtcacaaatcggtcattcttgtccaccacgcgtcagcttagcaatctgcacgttggcccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcacctgtcgccacctaactcgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacacatcaccctcgggcccaacgtcccctgagggtgccaggccacgtgggcgattgtgtctgcctcaaacctctagtcatgatactcccgatcccatgtcaccgacagtaggggttgcagcagaccggctggcctctgatgctctgccttgactctttggcaaatgtcacacaaggctacgtattctgtgacatctcgcttcattccaacccaccaaaagtatgccttgatatcttggtacatcttcgtacttcctggatgaatggagtaagcggactcatgagcttcctttaggatgagatctcttaactccttcttggccggtacacagatgcgtggaccgcaccaaactgtgccttgatcgtctatggagaagttggtgtctttcttctcctgtattctttttattaattcttttatcccttcgtcgtctttctgagcctcccggatttgcgactctagggtaggctgtactgtcaagctagcagggacacctgactgtaccacggtcagtcttaacttctccaattctctgcacaggtgatcttggtcaggccgtatttgagctatattgcaataggccttgcgacttagcgcgtcagcgaccacgttggcttaaccaggatgatagtggattccaagatcgtaatccttgattagttccaaccatcttctctgcctcatatttaactcggtctgtgtgaagatatatttaagacttttgtgatcggtgtatacttcacatctgttcccgattaaataatgcctccagatcttaagagcatgaaccacggttgccaactcgagatcatgggtgggataattgacttcatgaggcctaagctgcctggatgcatatgccacaacctttcgttcttgcattaggacacatcctaagccttgtcttgatgcgtcacagaagatctcaaaatcttttcggatatctggcaaggtgagaactggtgcagtggtcaaccttttcttcatttcttgaaagctgtcttcacaggctgtagaccagtgaaatttcttttccttctttaacagctcggtcataggtctggctagcttagagaatccttcaatgaatcttcgataatatcccgctaagccaaggaagctgcggatctctgacacattcttgggcgggttccaagcaagtacagcttcaaccttgctgggatctacttcgacaccgttagaggagatcacgtgtccaagaaatgctactcggtccaaccagaattcccatttcgagaatttagcgaatagttgatgatctctgagcttttccattatcagcctcaggtgttcagcatgttcttcctcgttcttggagtatatcaggatgtcatcgatgaacaccacgacaaactggtctaggtattccatgaaaattttgttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctccgagccatcctttttcttaaccagaagcactggggctccccaaggggatgagctaggtcgcacataacctttactttccagttcttcgatttgtcttttaacttctgctaactcattagctgccattcggtatggcctttttgcaattggtgcagtccctggtgccagttctatggcgaactcaatctctcggtctggtggcatactcgttaattcttctggaaatacgtcgggatattcacagactatgggtaccgactccaaggaggtgacttgtagactggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattttaaggttaacttccgggcatatttgagttgcccttatattccttccaggggaatgtactatcattggtacacgtaaattttgggttttccaaccgtttcttttcacaaaagcttgtgatatgaaagaatgggaagctcctgaatcaaatagaactattgcgggtacggagttgacagagaacatacccatcacaacgtctggagcatcctgagcggtttcagcttgaatgtgattcacacgtcctcgaccaaagtggttggaagcacgagaaccttgtccacttgcctgagagctaggacgagactgagctgccgctggagtaggagttttggcgatgctgccattagcatgccctaagttggtgttggtaggattctgagggcactgtctagcatagtgacccatctggttgcaccggaaacactgaactactgacggtccctgtggtgagttgaaagaggtaacactgtttggcgcagtgttgccactaggggcacactgctgtggcggaggtgtcggacggttcatctgagggcgaggggcgtagcctggctggcggttagcctgagtgaccgactggtggtattgcatgggttgaccgtagcgagggcgaggtgtgcctcgggaagaatttccctgatggttagacttgcgtttcttgtattcttcggtagcctcttttctggcatcctcaagcagaagtgccttgttgatcatatgttgaaaagtggggaagtcatgagcaagcaactggagtctcattccaactgcgattcgtttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcaaactcatcccaagcaatgttagtgggttcaggatgtgcattgcagtaattctcccaccaatctgcagcaggtcctcttagctggtgagaggcgtagagcgtcttctcaacaggagtacactgcactaagttgagttttctatcaacatctttcaaccaatcgtcagcctcgacgggctcgacggtctgagagaactctggcggacgtgacctcagaaaatctgtcagcttggatctattgttgcccacgtgagggtggccatttccatgcgcattatgctgaaaactggctatggctgtggttagtccttgcaagatttgtgtctgaactgccattatgtgttgcatgttgttttccacatgaggtggggaagggaggcgttcttctccagaattgtgactggcagtgcggtgagagcggtgagactgttccatctctgcatcacgggaaactgcgcgatgcgagcggctgccgcggcggggttgctcaacttctgcgttacgggaagcagtacgatgcgaacggttgctgcggcgagactgctcattagccgactcatgattttcttctggctcaactctaccatcttcaaaaccaaagcgggctggtgcacgggctgcacggcgggggcggctagccatctaaactcccagaagagggcgggataagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcgtgtcgcgaccgagaaaattgccttttcccgaacgctagtgtattaatccccgtcccaggaaaagctggggtacaccatacaaacatgatataaaagacacatctttattatatcgataatatttacattattacaaaggcacttaaggcctgacaatcaaaaataaacagcagcggactagcgggcctacggctccatcttcacaagcgctcaactggggtataagccaggactccacctaagacttcttctccaaagcttctcttactgaagggggaaaagattgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctagagctacacagtattattaatcaaggtcgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttacaaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaaaccacctaatgttgtccaatttaatcagcgaagcatctacctaaattcatactagtggaaccatgaatagagtacccactagttggggttttgttttcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaacacataaaaagaaagcacagggttctttaggttatatcaaacattaagagacttgaacgggtcgattcggagctcgcatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccgcgtgtgtcaaccgaggcgagtggccaacaaacggagtccactagacaccacacgggctgcacacgtggaaaccacgcggctaccgagcgggcacactaacacggtcaccacacgcacaagcgaacgactaccgacaccggtacacgggtaccggggtcgacaaccgcacaacgagcacgggcgacaacgaaaggacgaggacggggcagcaagaggggagaccttaccaccacgcgacgaggcgtgggaacgacaacgacgaacaggcgcggcggagacagacggcgagggaacgacttcggcggcgatccttggacgacggcgagacgcggccggcacgaggcttgacgacgcggaggcgaggacgaagacgatgacgggggctgcagcgaccttgacgaaacaccgaggacggacgagaacagctcgacggagggacgaacgccccgacgaccgggaacgacgagaggacgacgacgacgacgaccggggccggcgaggagacgatgagggcagccgacgacggcgtggaccacgccgctgcgatgccgacgacggaggcggcgccgcgagacgacgagccgggtgaccgatgggacgtcgacgacgagaacgatcggagacgacgatgatggaccgcggaggggtttggatggaggggaagcgaggccaagggcgaccttgccgctgcgatgccggaggtggtggtgccgcggctgaccggtaaacaagcgaggaggaacgggcggccggaggactccggcgaggcgggtagaggggttggtggcgacacggcggcttccgggcgaaaccgaggggtggacgaggtggagggctacgtcaccgtgccgagggaggggacggcagcgccggctgacgcatgggcatggcgaaaggggcagccggaggagatgccgccgaggaggaaggagaagccggcgcgggcgacggtgttccggcgaaattcgggcgaggaggaggagatgccggggatgagggcggcgtcgcggagtcgagggaggtggtggcgacgtcgaccggcgctcaggcagggagatagaggcggctggaggcggccgacgcggatgaaagggaagggcgacggcgggaacgcagctccgggggtctccgcgggaaacggagggcaagccggggaaggggaggcagctgcgatgctggaggaggcgacggcgcgaccggacgacgctccggcgaggagggagagacggctggaggcggccggcggcacgggagagagaggaggacggcggggagagggctagggaccacgggagatcgcaggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggattaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccacgggccgaggggagagagggaggactttgggccagattatttttaggttttttttctttttaataaactctaataattgtttttgttgcttaataattatttccggtgctctgaaaattccacaaaaatttgagggctctttttagaccaaggagaatttaacaaaaattctccgtgccacatttgaatttttcttgtacgtattttaatgtttgccaatttcttttcgaattttaattaattctattattccttttagggaatgatttttatttcgggatgaatttatcaggacgtgacacggcggaacaaaagggcctatcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggagagtacactggtgagtacggcgcacgcgagctgggggagcgcgggccactaggagtgcgggcagagccgcgggagctgtgggaggacaggtggctggcgtggcagaggcggcctgagtcccaagagatagtgtcaactgaggtgacaccctccacggccaaacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacacagagagcgagcgacggcaacggtcggggcggcgccggctaactacggggagtctactcaagctactaccgaaagctagggggaggagatggagcgaggaggaagaacggagagggacactaccgtgcgggacggggcgcagtgacgagaggccgacggcgctggagtgatctctccggcctcgggccgaggaagaggaagaagagggcgcgcccggagtccccttccgcgtccacgaacgcaccggctctcccgacgcttggcgatggacggtagaggcgaggcagagcacgggagcggcggcaacggtgaggaggcgaatgggagaggaaaggaagggagggggaagacgggtttaaatgggcggcaatgtcggtttgagagaggggaaccgacatgggcggtcaagccggcgagctggcgctccggctagcgtcccaagcggcgacaggaggtgacgccggcgagaggggaaaaaggggagaaaaagaggaaaaggagggagagaaaggggg

SEQ ID NO: 58179 - DNA, 2972 bp, Oryza sativa
atgacttggctcactatgagtaacttttccagttgatggtggcagattgtaacatggaccgttcaatttaatgagagcccttagatttccatacacctattgcttttggagttttagtttgcactagatatgtccctcaacacatgttataatagttaaaactcctggtaccctaaaactaaggagaggatgtccaaaccagccatactcaaggtcattctaaaaccttgaaccacaatggaaggccttcggcaacatatagcaatccttgtcttcttttttttaacactaatgcattaggtgcctgcttctttccatctaaaagtttgcccactaccacccttctgggtctgtttataggttacaaattatgagaactacaaccctacaaagttcaaaccatgctgattgtataaatactatggtatcatggccataaattcttctgtttattccatctaaggctcaccttactctgtgtgtttaatgtaaacatgggtgcagacttacgacaccagcaagggacgcgaaggaaaggagaagatgagagatattgccttcaattggtagggtgacaacatatgctttgaactaataggctcacagaccaggaattacatatataaccggtgtcggatgttatggagtactgattgcactaccccttttaaattatatttacaaatttccaccttcacctttaatatctttcaaattgttttaccttttgcaactgcagagcacagagatttgtgtgggctttctacattattttggttgcttcttatgaacattcagtccatcaagcagaggtaaggtaatgaaacacaaagcactaactccaaagtccaaacagatatttttcaaaagcaataagaagaaagaaccaagtacaaaagaacagtaagataacaatgaagagattctgaggtagtcaccaaaggctactcttgcgatcaaggtatttgcaccactttttgtagttcttaaacaactttttcatcacttcattcagcgcgttatcatccaactgcaacgaaaattgctgataactcaggcttcagagaaaataaaagggaatatcaaaagggataaaaaatgtttatgtaaacatatgaaggaaagaaagtaagatttttaatctgttcaggctcagggtttgaatattttcagggaagaacagaacctttgattgtggatcagtctttggatttcgtcgtatgtgtacgttagcaagaagtaaaatcagatgctcacgctgattggaaacattgtctgtctgtatgtcaagaagtcgatgagacatcaaaaccccagataatgggtaggttaagagtcagaatcatagttatgaagaacaaataagcaacgaaaaatattcaaacaaagtgtggattgcctttcctgaaaaccaaacatagattgtagccagtccaagaggtcttcgttaaccttgtgttcataagttttgggccatggaagacctctagtattgcgaagagcaacagcggcagcttggatcttgaaagtgagaaagtatcagaaagtccttcactttgatagcattaagtcaactcaatagaatcgtaatataaaagaaacctcaggaaatttcatgactgcttgattgccactgtctggatcaagagggagtatattgaaagggagatatatctttgtcttctctttaactttatcagcggcttccaagatctaaagatagtaaaacagatgatctgattggtaaatactactacttggtagataagtaatatccatatgaacatgaatgatgattaaagttcagcaacagccacgggaaaaaaacaacttggtaggctatacctcatggtcaacttcaacagaatgctgttgagtgactgcctttaaaacctcaaatagaacattagcagtctggtatgccttggtaagttgagcactgcatgaataaagaaaaattggcaacaatgttgataagaagaagattatgaaatggcaatataacgcaccgatccacttggtcggagacattttgaagtgcttgaatatatttcttataatagtgttgatagaaggcctgtatttcccgtgcatcactcttgcgggcccttcctctcaaggtgggttcattctcctaatagaaaaaaaaacaacaggctattgagaatttgagatatatatccctgtgacatggttgggtttttaattcatacgaggcattggtgtggtcacctaaaatctttcaacattttctggacaaaattaactacatatttttttagaagctaagactaacctcctatgatgatataagatataactcttaatgagcacaatgaaagattcatttacacgatcatgtaaatgttgcaattattagcatgcataaaaatgttgaaacatagcactggctaaggggctatgtgtaaaggaaaaaggtagaggaaaggatataagcagaggcaagcagtcaatggcgccatcacaggacagttgtaggataaaacaaaaatggatgcaaacaactgactagagctagaagtacttgaaatgcataccctttcaagccgttgcaaaagagccgtcttgaattgccggacaccccggccacttgaagttggatctaacctgtgagccttttcaaatgcatagaatcgacctatccattattacagacatacaaattaatgtgatcaaacacattgtgaagcagaataagattagtattctttttttatggtaataagcaatgagtgaacaatgtttgtaagtggatcaccaagacgccagtgtttttctgtagctaacttctttgtacgtattgtggaagtgtcgagataggggtccccccaaaattcttatccaagaaagaagtctaagataatgatagcataaagcatttccatcaccaaggcgcaattaggcaagagagatgttcgtttgtgcattcaaatttttaaaacaaaacatta

SEQ ID NO: 58180 - DNA, 4884 bp, Oryza sativa
ccccatggccgacgagaagctggccgagatggcgctcgccgacccaaagcgcgtcaagaggtaaataatattcgatcactctcccatccatccatatcgtctcgcaaatgcaaatgattagaaaacgatcgatgattgcaatgtatattgagcgctacgacatgaggggatcgatcgactgatcgctgagagctttcttcctccggtgacagggtgctggcgaacaggcagtcggcggcgaggtccaaggagaggaagatgaggtacattgcggagctggagcagaaggtgcagatcctgcagtcggaggcgaccaatctgtccgcgcagctcacgatgatgcaggtaacacgcactgatcccttcgccttcccgctttctcgtgcaattgccgtctcatcgtcctgatcgccttttttcctgcgtgaaatccacacggttgtttacgttgtctgtgactgttttggcttttggcagcgcgactcggcggggctcgcgacgcagaacaacgagctcaagttcaggctgcatgccatggagcagcaggcgcagctgcgcgacggtacgtgcctcccctaaacctcctcgatcactcgctcctcccatgtttgtgctcgccaacgtcataagatactttagatgtgctcggcactatgatgaacagtcttgtgtaagttattgacgttgacatgcttgtttgtcctagtgcttgtcaactgttgccataatctcgtgtttttgcgcttggaggttggtagttagcttttctttatgcatatatttttctctcgggaagccggtggtcgttagtatgtactcctactactggtagggaggaggacatgccttagcaatcatccaagaacgaagatttgctattgtgcgtgccttttcccccaatcaaagataaaatatatagtatgccctatggcgtctctgaagtctgaatccgttagttgctagcatgttaggagcctgcagtcccgtgtaggagaagaatgttttggagtattcaatattctgcggtgacttctccagattgccaccctagttttcagggctttcacgtatcaaatgtttctccttggatgccatattgccatgtgattgccacatttccttctctcacaaggagtctttcgtttcaagaatctacactgatctaggatgtctactgccttttacatgatgacttcatccttaagggttaatctatctattaatgttatgagtagctgtatttttaccaagatgaattcatcctattgcaatatactgttaaacactgcaccatgaaagtatgccacgaatagagttcaggaattgttcacttgttagttctggttttgatgctcagttcctcactgcttcgccattatcttatgttcaacagcgctgaatgaggccctgacaaccgaagtccaacgcctaaaactcgccaccgctgagctcggcgattcttgctcgtccagcagtctagctcagcagatccaactcaatgctcagaatcagatgtttcaactgcagcagcagcaggctacgcagataccattctatcaactgcagcagtcacaacagaacggtgcagcgaagaacaatgaatcaaaagaatgattccagaggcattttgggctggttcatggaaagagaatattggtttagatgagcgcaattcgcatattcctaactcatttgttttaatgttgttaataatcaccttgcatttttctagtaggtggtggttggtgaacctccttttacctttctatgttcattgattctttggatgatacagttgtcatttttaagttaccaaactgatgaagttgtaggtgattgttattcttttgtactaatatctatgtcgagtattttgagtaccccggttcgttaagatacacttgtatttatcgacaaaaaggaatgtggggaacattacataaaattgccattgccaaccattcacaataaaaactagttatgccaggtcatacgaaaatgataaagagaaatttgaaatgaaatgaaaaaaaaatgcacattgaaaaaaatggtacaagctcatacccgagtgcagggtaaaatggttaagatatttacgaggaaaagtagctgccttatagcctatccaacagaatcttcaaccatggcctcctcactgtcgctatctgtatcattcgcctcactgccttcctcagtctccgcatcagacatcagatcatcttttccaacaccacttcctgggagttgctttctgaaatctggatcaacaatttcgatcatagcattaagaacacgatgatgatcggttattttactgatgacatgatcaatattactctggctcccagcagcctgtccatcagagttcactaaagcatcagctgctgagctccctctgacattttcatcctgctccccggcatggtctgtagtctcccccaagctcctaggagactcattctccccattgacagatggacctgtttccactgcccagctaccagcaacttctgaggccaacaaatcagctgtaccaatggttctggtctgggtatcctcgtgttttctctcagaacagttaacctcaagtttttcttcagaatagtgaccaatgccatctttgagggttaacgaggcttcctcatttccttgtggttgccctctatctttgcaaatcaagatggactcatcattctcttgtggttgcacttcatcatctagctgcatggtatcacctcccatttcactaaatctttgaagagctgaattgtgatcaccacagccaacattaccagcttggctttctgtctcgggaacttgctcagtatctgttggctctagctcaggagctgtagcagccagatcaccatgagaatcagacctgaatctctctgttgccatttctggactattgcactctacctcttgagtgtttgccccttcaactctggtaaaatcatcctgttgttcagtctccttggaatcatcacttgaactttgttcacttgcctgggtattctctgttgaagcaccagaagcttccattgtattttttgagtagtttactctcgtgcgggcatcgtcagcagttacagttgccagtggcactttattgagatcatcacccatgatactgttctcataattctcttcatcctccagagttctctgcattgctttaagctgttcctgctgttttgcaaacagagaagatatttcctctgtagttgaatagaaagcacgcagctgagtctccctgcagtaagcaacataggaaacaaaagaaaaggtaagctgatttgtagtttcacaaacttggggttcacctctatatgaaactcaaacaatgtttcttaccgtaaaataattctctctcttgctccttgatacctctgtttctcgattgatagatctctaattgtagcagctatttcaagctcaagagctgagacctttgcccatgcttcttcccgagcagcctgctaacagaagaacacagataatcagctagtaagtaaacaagagcaatcctctatgcatgcgaagaccagggtagattagcttatgtgatgaaaacatcagaggaacttgaaatctttttctaccttctcgtgttcaagttctttcttcacttttctcagatccatttccagtttatctgatttctgcgattgcaaggggggaggaagtgaagaaaagatgttacatacattcaatgaactacaaatgaaacaacttgggcttaatagctctaaacatgtttacgactgtaaccttctgattgttggcggatacaagctgttcatcctgaagttgagcttccagctctcttgcttttttctcagatgtgacaaggttctctcgagtatcttcctgaatgtgaaggtaaataattgtagaatggaaaaggaatgagtgttcaaataaacaacagcaaaaaagcataccagcttagatctcaatgtttccacaagcaaacggatttccttttctgattcctgaaaataaaagagaaaggtccacgcaatacattatttcccaattcctgatcattccctagaattggaaagaaaaggtaaaacctgaagcttgctaataacttctttctgttcccgttgttgtctaaggtgagcctcagcttgtctcttgatttcttcttgagcttctgcattcactttatgcagtgcagactttaagtcttctgcagccttatcacgctcctctcttcgcaagtctctctcctcacttagctgtgcctcaagctcacatatatttgatttctggctgaaaacgtttgaatgagtggagagtgatgttaaaattggacttcctatatgctgaaaaagcctaaatgtctatccagaagaacatctcacttttctccctggatcaactaaagtgctatataaaataatacttgggcatatctgtgcatgaatttcacgggaattttctaggaagcagtacgatccctccagaagttttatcaaaatctatcaaaatcctttattccaaacaaggagtattttacggtttgctgaatccatgtgccctctaagatatgggaccctcaagtaaaccagcaaaatgtcccagttcaacacaactatgctgtaagatactacaatacatatacctgtaatttgggaaacaaaagggtgaaatataccagtgtttttaaatgactttagtgatcacgactgaaaaatatatgcgacttttttctctttttcctaacgctaataacaccatatacggaaaactaaaagttatgagtattgccacaaagcattaatcaaaagaacagaaaaaataacctctgaattatctcatcagcctcagcacgtgattgcttatatgcgctaagcctctcatcgagat

SEQ ID NO: 58181 - DNA, 11354 bp, Oryza sativa
  unsure (1)..(11354): unsure at all n locations
cctgcagcccattaacagcattagtatgcttctgtcttggaatgatgaacctcgggctttgattccatcagacattacagctggttccaaatttcagttgtatagagttgttgaaatatactactcgtactcacctgcacctttgtctgtgaggggaactttcaacaaatctctcctgatcatgtgagcgagtctctacttgtactataaatctttgtataatacagtagcatcgtgtatgtgtgatctgattttctttataatggataaatatctggcccctatatccacttgtgatctgaatactgcagtatatattggtagtaaatcttgttgtaatttatgaactgtctttttcctggacgatcgattgattccaaaatcgtgggatttgagtaccagtatctgactcaagcgatctgaatgagtggtggtttagcgttagttgggagaaaattatcaagcacggagcaacagcgacccattgaaagttgtagctcaactagtaatcctggtggcttattggaggcctaggtggttaggacttgggagatcgcactcagacgagtatactcgtggcagttctgtctgtataaatcagaatcactggtctgtatgtgacgcactgtcattttctagtagaccaatggagcagaaacaacggacattgttgctagaacaccaaactagcatactagcattcacgcgtaaatcggctgaaaggatggatttcgcaatcagacggcaataccgtagtgggtcgtgatgatgatgagatattgagatccatccaacattctccaaaccacttaatcacctaagactagagtagtagactgaagaggcttaagctcagctaatgctcgagtcgtcagaaaagaaaatcaggagtgaacagaatgaaagcttggttgataatgcaggttggcgttggtccacccactcaactagaagtgacagcttcttagggtgaaaatccaccaggcccacccaataaggccaccagcccaatattattaggaataagttcactttagatccctcaattgccgagtctaaaatttatccctaaaccgcaaaaccagacgtgcccctcaacgttaaaaaccagtgcgaatttcagactagtacctggtattggaagctgagggacgcgctatatctgtattgcggctgaggatgaatttcagacttgacgacaaaggacttaatcggttgtgctggctgcagccagcaagccattcacagctgccgctctttcgtttggattggggctgactggctgcagttgctgcagccagcacttccgattagggccaaattgagggatccaaagtgaacttatccatattattatacccagccgcgcgcagcctatactaattgggccggaacggcccatccctctggaccacagtattgggccggaaagggatcgtggtgtatgcgtggcctatgaatattgggccggaacgggatcgtggggtatgtgaggcccatgtgagttcggctcgaacgtgtttgttgggccgagagtacggcaggttggaaaaccatggcaatgcgtcgctgctgacagcggttggtgagtctacttcaggggatcagcattccggaaccttcgaaaagagcgcctcaccttgttcgccgtcatcggatggctacttcctacctaagaattgagcttggaacgcaaatgctggtgcgctgatccatttcgccaatggaagcacgaaccgacaaggcggcaatacatgatgcggatgcatgctctcaagtctgaatctgatgaaccaatcaagttttcctagccatgttaatttggagagatctacatctactccaggtgactgacagacagatagcaagcagcaatatatactccagaacggtaaaatctatgggcaaagcagtgaaatcacgtgtatatttatgaccttactgtactttacttgcaaaatgtattgtagtagtagttctttaaaaacaacatgcagcctcgggattctacaggtaaagccccacttaaatcaactagctagtcgtcttcgaatcaggtctaccctcgtccctcgtccagtggttgttctgtagaagaaaccactgctttgtttctttacggcagacgtgatctgaaactggcaagaaacagtgccaacgcccgtccaacgataacgagatacacgcaacagaagcgtataaccaacaatttctggaatcattttggaaggatacccgacacagtaatggtctaccggttttcatccaaatggcagagcagaacgaacagtcgaaacacccgacccgacagaacggcaaaaaacgggcctgaatgccagcctgaaccggcaccgcgccaccgccacgtcgtcatcgtctcgattggcagctgccctctcacttccccaccaatgctagggcctgtttgttggaacttttacctgctacagtttttctcaaaatcagaaacttcccccaaacaatctagctttgatttgtataatctagaaaataaactataacccaaaacttaaaaaacctagcttctttaattctcataagctagctaccaacaacttctcggaatgcatgccctagatctcctgcgctgccatgccgcatcagcttagctagcgccttcacgtgcgcatgtgctcgctatattatccaaatcgcaaaaccatccaaggcgcgcggcctcaccaaccaccacgcaaacccattgttaattaattagcggcacactgtcacggcgcattatttgctagctccagtgacagctcactcctcttcttgctgctgagggcttagctagccagtccacctcgtcggtgtgtgtcggtgtagtctagcagctgcggcgggaggaggagttgccggccggagatggcagcggcggcgcagcggcttgtcgccgctgtcgtcgtcttggtggcctgcctggcgttgccggcggcgcgggggctgaacatcacggcgatgctgaacgggtacccggactacaagatgttcaacaagtacctgtcggagacgaaggtgtgcgacgagatcaacgcgagggagtcgatcacgctgctcgtcctcggcgacgggccaatgtcgacgctcgtcctcgacgccgaccagtcgctggcgggcatcaagaacgcgctccgcctccacgccatcctcgactacttcgacccgaagaagatccgtggcctccccgacgccgacacgatgaccgacacgctctaccaggccggtggggacgccgccggcaagatgggcaacgtcaagatctccaccctggacaccggcaagatcgccttcgcgtccgccaacccggggggaaagtacgaggccaccatggtcaaggccatcaagcagatgccgtacaagctctccatcatggagatctcggcgcccatcgagttcgacggcctgttcgacacgccgtcggcgaccaacctgacgaggctgctggagaaggccgggtgcaagcggttcgcgtcgctcatcaccagcaccggcgtgctcaagacgttcgaggatgccatggacaaggggctcaccctgttcgcgcccaacgacgacgcgttcgacgccaagggcgcccccgacgtcaagaagatgcccagcgccgacctcgtcacgctcctcaagtaccacgcgctgccgtcgtacaaccccaagccgacgctcaagacggtgtcgcgcgccatgcgcacgctggcgtccaccgcgtcggggaagtacaacatcacggtggacacgcggggcgacgccgtgacgctcaacacgggcgtcgacaagtcccgcgtggcggccaccgtcatcgacgacacgccggtgtgcgtgctcacggtggacaacctcctcatgccggtcgagctcttcggcgacgcgccggcggcggccccgagcccggacgacgcggcgcccgccccgtcgccgtcggtcgcggacgcgtctccgccggcgccgccgccggccgacgcgccgtcgaagccggcggatcacaaggaaatgaaggcgtcgtccgccgtcgcgttgcggtcagtagtgctcggcgcattagccgcggccgtgtgttccttcgtgctgctttaagcacaagtttttttttccctttcttccatgtccagtgccggtgattgtgattgcacgagctgcattgccaattattcctctgtataatgcgagcaaactgtgtacattttgttctaattctgatatccttttctccgaatcgtctgcgccatttcggtgcggtgaatttggaagaattcatgtcgcgttgagctgtacaactgtagatcatgtgagttcttgtcctttgagcgcgtcgtcatgcaggcccaccacagcaaatgcgggtgtgttgatgtgatcttgaaaaaacagattcgggcgagagagctagtgcggctgccgctgcctccttgtgctggcattggcagctcctacggatttcgatcaattcgccgtttcaggaccaccggtgccagtaatgcccgttggccgtgggttatttgataactctatctagtctttaaatatttttagacaaaaataatagaaatttaggtcatcctattttgaacgcgattctcaaatttaatagactaaaaaattaaagtcccttaccacctaggacaaccacaatgcagaaatacaaggggtattaaggggctgtttggttgagcgccaacctttgctacagttgtgacaattaaatttagtgtttggttcatgccacaggtgagttataccacttttttttttagcaagctagcccacttgtcattgagtaatttttttaccataacttgccacaattgtggcaaataaattcttagccatataatgtgccaaatattttgtggtaaactatgaaagttatgaaagtcatccaaactatggaagcctctaaagtggtccttatacattgtaggagtagttcatatatatataatgcctagccataagaataaaataacaatactttcttttctctctcacataacatacaattgagtgggaccagtaagatctatgctaatgcctcatcttatcatagcatattgtagcaactaccataattaatatcaggtcccatcttattacccaagtagacattatacattaagcatgccctaagggcatcagcatcagcaatgtttattcccaaaccaagcaataagggtgggcccgttgtcagggaaaatatctagcaatgtgtgtatgtaacagagggggggaggaataagattggtccaccttcaaccaacctatcacaaagccttgttctgacttataaaagtgaggtgggacccatcatattcccttactaccggcaataaacttgtaacctggtagtaactatttactactgtcacaatgtttattacttgataacaaacccctatttaatgcttattacctgctctagcactacattgtggatgcagttgtgagcactgtgtagttaatccacggaagagtaaattacacttctagggctcgaacttgcatggcagagaaaggagtacaataatttggaaacgctttttctgctcaacttgttcatgcgaaccaagaattcaattgaaatgcgggatgcacgggtatagccgttcagcgatattagtacagatttaactatttatctgtggagaataatacaaatttatacacatgaactccataaaagtaattaagaactaatgtcctgaaccctgatcattgctaaaggtcgtataaacaaatacggtatttacacacggaattgacatgctggcgtttcttacacactacactatccaattatacatcttatgttacaagtaagaggatatatttcactgtttgagcgaagttgtaactacaatagatacaatatgccctgtggaatatttacaacatacatacgccaaaatacttaaatcttgaagaccacaagcacaaaatgggtagagaagatcagtccttgttgcgagaggaccgctcccgctccttcttctgaccaccaagaatccgagagatttgcagtcctctactgaacgcttgattaaatagcatccgtgtctgaaactcggacacaaagggaaaccatgccaaaatagtaattggtgtaaagagaagaactcccataattatctcgtatgcccgagcaagggcacgaacagatccccatagccctgctcgccgagcaagaggcttgcaagcttgtgcaatctgaaagagattgagcaacaatgagaaatcaactaaagcataaatgaagttaatgagcagaacaagtaggagaaagacaaaccagcaatattccccatccggaaggtaagaatgccagaaagcacacaaatatatctcgtaaggtcatatgaagtattgctatcagtacaatcaagatggcgatgaacgaaacaaatatcataaacttaatcagacggaaaaatagctgaaaatccgcactaaatctccgccttccgacagatacagtctgaaaacagtataaacaatttaggtaagcaaaattatagataagatgctatggacagcaaatagtgttgttaacgtggccaccaacccgccaacagttgtatgatcctttttttttcttgagaaattaattctcaccttcataacaagcaataccaccaaaatcacgagccacgaaattaaatatacctggaaagaacaaagtagcaaaaaatgttacaaccaccccatcacttgttcaataaaaatgtagctctaacgatctttcaaaaaatgcagctttaacagaacaataaaattaacatggagggcataccaatatacttttgtcgcctgtgatatttaagtggtaaacaaggccatactggtatatgaaaaacctcagggacaaaattatctcaacaaaaagtccaattgtcccagaatatttcaaatgctctagctcgatctcccaccaggattcccaactcttgtctggtgacaccccaatgccaccacgattgctgatccacttattccaatcagaccaatcatccacaattttcgtccactcaaatcccgatggattgaacaggaagggtgcaaaaagccatgtcaacactaggaaccacatagagaatgtaacaaaaatataggcaatggttgagcggtaagattgaccaaatagttggtaaatgatgagcagaatcaacaactcaatgcctttaacaaagtgactgcgagaataaagcctgtaattctctgcaaacttagcatgaaagacaacaaagcccctaccagtagctctgtactgagcacctccatggagcaacattcgtccatagtagtgagtcttagtgccaagtgaaaacgtaaagaacacagctgccaattgcaagttcatcatgataaattcacttagtgcttgaccaaatcctttttcaaggccaatttccatcatcatgggcagggccatcagaaaacctagctgaaccagagattgtgaggcaagagcaacctgaagggggtggttatgaatgtatctcctttgtgttaaaagcccttcttcaagtccactgagagcaagataaaggcgtccatacagaaatacataaactgtgacaactgtcagctgtagaaaaagtgaaaagtattaaaaacatagttaactgtgctggcgtactcaaaacaattgcaaatacaagttattttagcttagggcattaggaattaaggcctcaatcaacaagggataataggaagatgtgagaccaatgtggctcagttgtacagtgaccaatcttcagggagtggtcgacgcaaagcagacataccagagtactgaaataaaatcccacagtagtgaagtagcatgaaagcattctgaagaaatcgaagcggtgtccaagccggtagatatcacggctaagagtctgctctccatttccattggccaccttagcctcaaacttagagatctggtttaaccctacatctcttcctttaccaacttgcacatattcatgatgtgttatatttcctccacggagagttgaattatagcctgtaacataaaagacaagaggagcattaccccagttcctgaatatccagttacatctggaaagaaattaacatacagggcattcgtattgaagcaatggagatatataattactgccaaagaccatgataattgatcttagccacttcattaatcagcaaattgaaactttcaggaaacaaacctgcaaaaatatcttcgctcaagttgatactccttgatgccttactgacaccacctcttgttagatgaaaaatcctatcaaatacgtcaggatggccatagtggaatcgaaccctagaataaagaaagtaatagctttagatgcaatccaaaaagggaaattctgtacgttttattataaaattcttatgtagaactagttatcggaaagtgcactataaaatggcttgctcaatatgtttataagctagcaaatgacatggcttagttcatcacatgcaatttcagatttagagaatataatatatgatcacttagcctttttcttgtgattgatgaaaataatgtattatgtatccattcaaatgtatagtaacacacatgtgaggaggaaataatcagataggagaagaaatctcacttcagnaagggnggnntntntgncannagcagccgttgcccaatagtcacaaaactatgctcctgattggacataaaccatgcgagagaagagacactgcataattgaagagaaaggtgcatgaatgaattactaacagaacctgaaaactcaattgagcaacagaacaaagaaatagcagaatgtgaaaactagattgagcaactcttatcaacctgccagtaaaaatatgttccctaactccaagtatagatgggcgccgaactccatgttctgtaaggaactcttgaagcaaatttctcattttaagtgcttcttccatatagttatcctacaaaattaaaggtgtgcacaagtaaatatgagtttgaatggaagcataagtgctgcacctcctttggagaaaatgacagcataaagtacgattctacaaacctggttcatgtctatggtttgcaggccttcaccacgggtgaagattattgcatgattttgattttcaggctttccttctcccaacattgcaggtcctggaagttttatccggtagataaccttgaaaacaaaaaaatgcaaatgttgcagcttcacaggatcacagaaagaactttcacacttgatccacttctataaaagaagcccataacttccagcatttatcagtaaaagaagtttcaagaacagcagttgtgcaggaggttcctaaaagtgtgtacacgtccacttgaacctttaaagttaacttcttgagcatctatcagttagagagagtggaaaggaattgtggcactgctaagcaagtcccgaaggaactcaggacacacttatcactctcattgcctgggaattatgaaaccatcggtgtgattatgttttgaagttttcaataggacagcagcattcatgtggtcctgagatccatttctcatgaacatgaaggctttcgttggtgcttggctgggcaaaaggacttgcgaatttgcaatactagctggccattccaggccattactacttggtggcttggtcgttcatgagtggtgtgtgctgcgtgtgtaaatatgtttagtgtgtgtgagttggtttttgggtcagaacgtccttcttgacctttttgtactgtgttttctccttattgaaatgacatgcagctctcctgcgtggttgaataaaagaagagagagtgaaaaaatctcactgcaaaattagattgttgaggatacctcttcaaatctaaatagtgttgtttggtctatggtttgtatcacttgttttagaattaggctgggaatcctttgatccttctattaatagtgtttttgttttgtgcctaacatgatttgccaaaatttatgccccactacctaatcaggtagaagtacggttacctgataagattttttttgacaaggaattacctgatcaagattttgaactggatctgtagattcagaatccttagttagagcaacctttaccaaagttgagtaataagctggctccattttcttttcttccactctatcttcgacctgatcgatatatgctacacgaagagaagggtacctgcaagaaatttatcgctaacaattagaacttgagacagaaggaatgacctacattatccaatcatggaaaacactgtactatcatgtctacaattgtgcaaattctgcagcaaagctttggaaaaaaatccattggttgatgtgtgtgaaagagtgtgatataactgcaaaacattaaatatcatgatcaaacatgatagcatcagggagaaatgaaatataaatttaaataccaacaattaaacagtgtattggcattcttctttcatatctctctctatttcttccaatacaatccaatcatgcaatttttgtggtcaaaataatatcttctatatgcccagtagtattgtcagctatttggaaacttgcacacgaagttcatacgagttagattgtatctctagtgtacacctaatgtggctccaaaatttaaatccagaatgatatgcagcattgaatggattacttatagtattataaatattgaaatcactacagctactacaatatgatgagtacttaactaatctctacatctacagtattcaggtaaatgcaatatccttatttacgttctcatcagctgtaatatgtcttgggcattaggaagagcagcacgcttgtcatttccatattgctggcatgataccacataggtaaacttcatatcagccactgcttcacattgcgcaaacaaggaccgctgtaacttccattgttcatcagttgactcaactgctttatacccttccatgagatctgcagagtggggaaaaatgaaagagtgctatgagaacgaaatagataagaatcatgctgcaaccataaacccatgcactagcaacggtttgctgctaattgcatcacaatggtattgtacccccactcttaacacacatatccaagatcatgatgtgagcaagagccctgcacagacatgtgtattaccttcatgtttggccatatctagaaatgcttcaagaaccaaagcttttcggtagtacatcattcccctaactgtttcagatcaatcacgcataaatttagaaactatcaagaggtacaaatttggaaacttttttttagaggaaagatcattttttgatgcagactttgtaagaaactaataaaggttaagggctgcaggaat

SEQ ID NO: 58182 - DNA, 40347 bp, Oryza sativa
  unsure (1)..(40347): unsure at all n locations
gcaggtcgactctagaggatccccaccgatgccgatgccgatgcaccaactgccaccgccgtacatgttcaacgccgggtacatgaaccagtaccggccgncgtcgccgccgccgccggcctacccgtacgcgccgccacagtactactacgcgagggacatgagcatggaggagaaccccaacccgtgtgccatttgctgatcgaatggtattcttgcattgcatctgatctgtagcaactagcaagtagccctacgtacattttctcgaacatgatgtgtatactgttttttttttttttttttttttttgagaaccgatgtgtatactgcatagtagtgtatctcgtgtttgaattggagggtagaagaatttgccggcaactttgaatttctgacgagaagggcggtatcgagtcaaaccattgcatggaagaaccatactaattcagatgcctgttgactgttgcccgtggtattaatggagaaattagccatctagagacactaatttcagccatctgctttcatttacttcgacaagaaaataagaacgaggaaatgaaagaaggtatagtaatgtgctgcaactaaagctcagctaggagcctaggacccatcagcaaaacagtcctaagcttttcgtttaggaagaaacagccactcgtaagcctgaaaattttagtgtcctttcaattttctagtgtatgtatctccacaaactttttcaactataaataaactgaagattagtcggcgagttctttattgcgcactggttttaggatcacaacaatccatagttaggaaaaggtttaagtctcaaccaaaagtttgatctgcgtatgcattttctcattaaaaataccgcacaccatgaccatagattatactagcactgaggactgaggaggcaaagaaagacggcagaatcaccggggcttcaaaaggtgggtagattttcatttccaacatgacgaaaaaactagcagaagaatattggcagcagctgtggttgtgatgtcccaattcccatttgcatttgcagatccattttgcatcctataataatcaaacaaacggggagtgaatcgcttgtcaatttttgcggtttgggtgagtcggatgatcctgactttctcgtcacccctgacgacagcattggcagctacctcttccaacgctgaaggactagagaaaggagctcaaccgttcagccaaaggcgacgcatctttttcgttttcgatgaaacagagccttcgtactccagatatatcacgaaacaattgttgttaattatagattgatgcagatgtgatcatgtgatgattaaaaatagtgattttgtgaggtcatgttcagcttccgatcatcaactcgcaaatatattagagcagaaaatacggaaatgaagctacgtgtgtgctgtggtcggtgaagatggcgatggaagaaaatcagaaataatgccattgaaaatttacctggctgcctgctgcggtttttatcatccagcctcacctgacccgcctctttcgttgtcgcagagggtgaaaatgaaatcgctccactcggcgacagaattttcttggacaaaactacatggacagttacctcatgatatcctagaaaccatcgtccgtataggagcagacattgacagataagtaaatttatcgccgtgtttagttccaaaatattttttcaaacttccaacttttccattacatcgaaattttcctacacacataaacttctaacttttccgtcacatcgtctcaatttcaaccaaacttctaatttcggcgtgaactaggcgtgaactaaacacacccatctttgttttctccagcacgagtctatgtcatatgactctgcatttttgtactccctgcaaaaggaaaaaagaagtcggatgaatgatcgcaacagcaaacaaaagcagccactgttttctggtttaaatcttgtaaccatcggcgcctgtatttgagctttgcggttgctatcatcgcactcaagcaaaagccgtatcaaatggatcagcctcgtaatacaactgaaatacaattagcagctgataaaagacaacttatcacacgatgaactactgtattaaacaaatgaactgaaaagattgcaaatagaaattaaattttgatgcttcagttcccatctgctaatgagttggagaacaaggaaacacaggtagtgcagctaactccagggcgatcgcctgtagcttccgtgcagcaacgccggtggacggctgacggagctccggcgaccggcggcgtggcagggagagccgcgagcagatcaaatcaaactctctcctccatccgggccgtattaactcatgggctggtgagaccaaacccgactagaatcgcattggtaccgatccggcccaagaggatgtgatggttcataataaatagcatgcaaaggtgattactattctttcttttatccggccaatcagattgcatcatgattgaatacatacacccatagctcaggtgtgaagccattacagtttcacaaaagaaagaactaacaaagttacactgccattctgctgctaggtttctcaagaacagagcacagcttagtgttacatagcctcccaatttcacattttgatcttattatatacttttcagcactaaaagaaaaggcacacaaccctactggtcaccaaagcatgtaggacacctatttgacatcccaactgcaaatacaaggtgcatctccgggagggccttatacatgcatgtgagcatgtctacagttgcgctaagggtaaaaagaaaaaaaaaagcgctcccttttgcaaggattggcacaacaagatgtgaccccacagaaaattcatcaatgtgcacaagaccaggaggacgatatcctttggtatcacctggagaaatggtgcaaacgctacaaagggggaactacatccaggagcattggatagttggaatactaaagatcacctcttctttgctgcttttgcgtcagattcagatttccacactatgtcttttaactctgacgagaaattgttgtagaactgcatgcaatttgatagaaatgacgttaatcgttctgaaatcatcaagaaacaactagatgctgggtactatgaaatgattttttttttcaatgacccactatgaaatgatagaatatacaaagtttgataacatacattgtgaaactccagcgtgtcccctccagttttacgaagctcaaccatgtggagtgatggagcaacctcgaaaacctgtgagatagcatgtgaataagttcttttattaaagcaaaatttactgaagcattgcacagacttaacaggatacatgtcaatttaatttccaatacctccgttgctacagataaatagccttttcttccagtcttatcaccttttaacttcatctggagcccaacaaaaaagaacaaatccaagttacttctgaatggcgaacatactgatgcaaattctcaaggaaactaacagaaacccacataaagcaaactagtcaatacatagccgtctaaaatgctacaaaccttataattttgtttccgcacattgaaaccaagaggtccacaagcttcctctattttagacatgatctcctgtggtgtacattgagatgtgaaggaagtttcccgcttcaccattccctatatatattaggtagactcagactatttagtaaacgactaaggagtacaactaataggatgataaattgatcaaaacataattgttctgtcggacttagcacataaagaaaagaggaaaacattagcaaaattatattaaccgatacaagcttccagaaagaagcactccaatctatctagcacataacatattctcaacatggaattataatattggactctatcaaaacctaccatcatttccttctcaaataaatttccaaggttgaatccctgtgaccttgaaattagagcaaatgcattcatggattcaggcttttctctcttctctgccacgagattctcctgaaaggttaaacaaacaaacgtaacaaacaaagaagtggttttaactcaggttacaaatcgtatttttgggaaaggatgcaggttacagataaatgttcagctagcattacctctgaacaatcgaatgcagcatcaacatcatcaaggctcacatcttcaccttgctcaaaaagtggtggtttgtaatcctttttgaaccaatcatcttccaaaatttgtgcaattgttattctctgcaaagaatatagctcattgttttctgacttctctcaaattgccatcataaaaggcttcaaagaggatatacaatgaaactcattggactagcagcagtcagctggtcaaactggttagctgaagatatatgtccttaattgtcacttactgtgcagggattaggatcaagtatgcgcttaatgaacttcttcgcacctgaagaaaaccaatgtggacaagaaacttttgccttgcagatctgtgaagagaacatcaaaagtctatcaagtttaccaatgaaattcacaagaaacattagaatgcgtgcatgttacacatacttaccagtttgtaaagggtcattaggttggggtcatcgaaaggtaaatatccagccatgaggacaaataagattatgccgcaggaccatacatcagcagccataccatcataacctttatcagcaagcacctgagggaacagtatgaatatatgattcttacatctttttggagaaaatacacgagtttaatcaaaggcaacatgaatcacctcaggtgcaacataatttggtgttccgcaagcagtatgcagaagtccatcctcctaaataaaacaatcaaaatagtttaccaaagttacttctttcaactttcttgtcaccaaaacaaataattatgcgtccgaagttcatttgaggtaatagtgcaagttaaggaacaagtcaattaaaccagaaaaatgctagaaaacccaaacacatcacattaggataaagaaactggttaattttttaacaactacaaaaacatacttctgggtactagctagatatcatacttttgtttgtggagcaaacgcactaaggccaaaatctgaaactttaagagctccatgtgaatcaagaagcagattctctggctgcaaatggcacataaaaaatatgaatgagaatacatccatcccagtggagattacccagaaaggaggtaagcaggataattcaacaaaccttcagatctctatggtacactcctctgctgtggcaataatctactgcatttataagttgatggaagtatcttcttgcttcatcttctcctagtctcccagaattgacctagttgataataacatgatgataaatgggtcaacttgtatggtccaagaactgcggattagtcagtcagtatcaaaacagtcaaatgtgccggttcaacaagctactcttacagcatgtaaaagcaatttgtacataaacaaaaataagaatcgtgatatctggcacagaaagttcatgggccttacaatcttatcaaaaagctcgcctccatcaacatattcaagaaccatgtatatctttgatttgctagccatgacctgtcaaacacacattgaatgtaaaattctcattgaatgagatgagataaaaaaaaaaagaagggtatgagtggtaatgacgctattgttcctgcaaagatagcaaagtacctcatgcaactggaccacatttggatgttttattagcttcattgtggaaatctcccgtttgatctgatagaagtggaatatgaggttatcattcacaatcgaaagctcaagctggaaaacagaacagctcgagcagggacatttaattgtgccaacacatcatatggaaaatcacatatttaaccaaaaaaaatactagtttttccaccaaacaatgcatcaaccaatgagtgatctagcacggaatgtacaatacccgagtttccccccagtcagactgaatttataactccccgagaaaaaaaaatgaatctagaacaactcttgccactcctacgaacaccaaagctagcacagctttttgctaggcagaaagcatttgattaagacagggttggcatcaccgcatcggagatattgttatagttacatggcccagcttgataatctgttgttacatttccgattcaaacttgatacaattccatctaatttcctttagatcagagcagatttagcccgctggacaggcggacacatgacctttcttcaatcacaaacaatccaaacagacagaatcttgacaatggtagagacgtagtaagcgcatattctcgtttaatgtttattaatccccatgaaaatccatcttttataataatctagcatctatctagaataatttaggattcttaattcgatcccctccgagaaaagatccaacttgttattacctgatgtctaaaaaaagagataaatattcaattttgaggatgattaaggcggcggacctgctcgaccatcttgtggcgaagcacatggttgcggtcgagcaccttgatggcgagggtgtcgccggtgcgcgtgtcgcgggcgaccttgaccttggcgaagctcccctccccgatcgtcttgccgagctcgtagcgccccaccctcgtcgtcctcctcgccggccccgcccccgcccccgcccccgccgcctccgcctccgcctccgccatcaatccctcccgcagatcaatcctccaccgcgcgcctcgccgccttccgatgatgggatcgaggagtgcgcgcgttggtaggtcgcacgcaggctggatggcttgggcgccccgtgcgcgcgcctcaaataaggcggagatgcgttggtggcaggtgtggtgtggggtccggtcgggaaccgcgtgggacgagacgtaggcggcgcgcggcgtgcggcacggatgcgtgcgtgcgtgcgcgcgctatcgttttggccgtgtgcaacgcgacgcgattcacagttttcacaggcagtggcccgaactctatcccaatcccaccaccaccccggcaaaaaaaacgattaatcaaactcgaaagcaacacgcgtacgtaacgagcacgcgcgaacgcggcatttaaccgtggctcctcctcggatggataaatccaaatgtggggcgagattttacgtgttgccacttggagatcgctcctttcggttttctttacgctggagtagggaaaatctcgccgtcgtccaccaccgtggccacagcgacaggcaacgagctagtagtaaccctgaacatgcgtgctttgcaccttcctcgaaggagcacccgtacggtgccgtactctcaatcattcctccgttgaaaacgacgcgctgatccatccgtgctccacacgtcctcccctgaacaaactctggctctcctctgaacaattcaccgcgaccgcgacgacgacaaaaacgaacgtgtgtgatcttgctactgtatgccgtttgctgtgttgtttttccagcaatcatgcacgcaattaaccttgcctgatgtggtcgcggtcggaagcggtgcgccacgaatcagcaagcggctagcaatagcaatagcaatagcagtaggccagtagcagcgtgaatgcatgattgatgccgcgatggggccgagagccttatcctgcggcgtcacgcgggggcaccacaccaccactagcgcctcgtgccatgtcccgttcgtcgtcgctgcctgcactgcacaccacattctctcaaatctttttcctcgccgccatcaaggcattaccacgacagggggcgtgaccgatcgacctgtgtgtgattgctgatttgaaatcgtaaccgtcacattacatttggagagaattgtgattgcaactcttgtgttagtggttgatactgcagcagctttcgtgactttggaagtagacggcgagattattgtgacggggacagcactgttgttctggagtgagagttccacgtgcgactttgtttgcgttgtcagcttgtgggatttcgattccaggaggatacgtacttcgatgagctccatggccggtgatttttgtcgagttatacttgatggttgtcgcagaaacactcctaaccgcgagttagaagaaagtagaatcgtgctagatagaaaatgcttagttttctattttaagaaggctatgctaagagatttctgaaaagaaaaattaaaaccgcgattttatacattttgacgtagttcgtagatattcagctcccaacgtggcaggttagcagcagaagaaatgtcataaacccaaaaccctctgtttgggagcccataatctggcgagaaacctggcccaattctttcaggcccagttgacaaacaggccctgaaaccggactctctctctctctctctctctctctctctctctctcgctctcgccttacaaaaacaacggtgggctggcccatgatgctctctgtcgacgagtgaaagaagcccagcccatgagaagaaaaggatcgtcgtctccagaccatacgatacatgcgcgcatgattcatcgccccgacgtggtcaactaccccgaatgtctccatcaacatgtggtacaataagggcacccgcaataattatctatagattttctataaaagatacatgtcagcatattttcctacttgaaagagattaaatggagagagagagcaaagatatctactaatctggagatagtctatagagaaaaacgagacaatggattagagagctatagatacccatatagacatacaattaaagtggtttactattaatctagtctattactgatatgtatatattttatagatagcacgttactttactattgtgggtgctctttgggaagtctcaagctagggaagtgaagccgaagggagaggccaggccaggtcggccgtgtcaccggacggccgctttccgagttgacgctccaccgaatggcaccgtcccaggacacgccatgcccccgcccgtgatataatcgagctgaattgccacagctatcgtgagtgtgagtgcaccgctgccgcagcggcgtcgtcgtcggaactcgaaacacagcaacggcttggccggtttcccgtttggtgcccagaggtaaccgtacgtcggaactcgcaactcgcaaggcggcttttgcatgcaactagcgtgcagaattcgtgtagaatctggcccgctgcgtacgctgccgccgctgtcctcgtcccaagaaagaggaggaagaaagcttaggccagaataatgtgatgcgaacacacatcatcagtatttgtactggagcagtagtagtagtagtagtaatagtacagtgaagtactggtccactatagatactcccgtccccatcaaccaggcgcaaagcttcggccgcctgaacagtgaacacgacgagctcgatcctaagatagattcttcagcgtctgttcggttgcagtcttgcagatgggagagcctcaacttttgactaggtttttattcaccgagaatgagatgcgaattctaaaacgtgtagacgccaccaaaccgcactatctagttaagtccatgccccatgcatatgtggctttgtgcccatcgatccgttcgccattatcgcagtttgcaacgtaactggaacagaccaacatatatattactagctagcttccgtccaaatctccacccataatctgccagagccccgagacaaatgttagcgtgatacacacacatgagcgacgcgcgtgctacatgcccagtctcattgccagtcagccttgcattattgaaggcgacgtcgattgccaagtcgcgacttgtgaggaataattgggactttggccgagttggcaccaccatcagattcaggccttcgtgctccaactgccaagtactagtcgctgcggtcactctgtgtttccaagctgtggcagtgaccgcgtaggaaagaaaacaacactttcttttctcgtgcctatgtgtggactatgcggcgatagtagtaaaggagccatcatttttgtgtgactatgacaaatcgctgtcgggctgagctgcatagctctctctcaaaattcgatccggagctgtcaatgttaactcgctgaataaaaaaccttgacaacgagaatttcttcccacgtacttgatcgactagaatataattaagtgccaaacttatctgcaagatcaatcgaagcatctgaaatctgcaggtttgtactagcaagaacttttctttagaatttggatcccattctgatcacattccgatcatcttaggaaaaacgacgataagaaagaacaccgaagaagaataataagactaagaaaatgtacactcgacggacggacgacagatcgaagacaacccagtcatctctcggcagcgaagggcggcgggacctggtcctggacggcgcggaggctgccgaggcggcggcacgcaccggaggcgaagagggagagccaggcgacgagcggggtgccgaggaggacgaggccgacgggcaccatccacagctgctcatgcgccgggtggaacgccaccgcccaccacaccagcacggccgcgcccgccacccccgtcgccgccacgcccgccgccacggcgaggcacgaccacgtcaacctcattctctcccccgccgccgccgcagctcgctgccgtcctcctcctcctcccgcctccacgtccaccgcctcgccgactggcttcctctcgtgctgcgccattgcgagctagctggtggtcgtctcgtggcacgctgctgctgccgctgccgtgcggcgaggtgaatatactacgttggggaggggggcctgaggcgggggcatgcgggcggggttatctggtgatggctgctgctttggcccacgccacagccacagcccccaggcttccatttctactgcagacgcgacgcgacaccaccgcttatcgctttccacgccaggatcaaaggggctttgatgggtttcttgccacaaaaaaaaattaaagatcaccaaaatttactgctgtcgcattttgtaaggtaataaatcagacatcttgtagtaagaatttcaacattttctaccccgaaaatcaagggcttcattggtttctcgttaggaaaaacaatataccatatttcggttgcgtaataaatcaaatatactatcttctaaacatatatgaaccttaccaaataggagtttagtagattctgagtatttactcttgagatttccaaaattcagagcaaataagatctctggtacactttttttttaccatgtatcaataaaccaaaatttggtattcctaaagttttttttcaacagactaatcatgtcctcactttaaccccgtccccagctcggttactccgggcgcaatctgcatccagctcagctcaccccggtcgattccgcggtgagctgtggcttggtacttactggccacgaagctggcttgttcgcttctgtgagagggattcaagaggtgttcgtttcccggccggccgttgcactgctcgcatacatccagcttcagctggaaagtttgtcgtatcgtgccggacgcacaacgtgtagtcgaagcaacacgcagtgtctcgtttggaacgtataaaaatttctgaatgaaacgtttccaatcaatcctgtgttactcctaatttccataatttcgggtttactattcccatttcagatcgttgttcttccatttccatctaggatagactgcccgtttcttcaggatcagcaaattagataagcgaatacacaatgtagaacgactctgtaattgtcactatcccccagctatgggatgcttcaagtagtgtactactccagtcttccagagagtgggacaaaaaacaaacctgaccctgcaaagggtcccttggtcgactcatcctcagaatcaagatagccaaactcttgtctctgcccagcgtactacacccataaagtccatcgattcatcgatcgatcgtctcggatggtcctactccgtttgtctgaagaatatttttcagcaggagtttgtactagtcaacagaaatggtttacttgccatgcagattgcatccattcaggaggaacccaccctaccccaataaaagatgctcaaatgggacgcatggcatgtgcatgtgctcctctttctttctttctttccggatgctgcaacaggcaactgcaatgattcttttttttatttcaagaaaagcctcagacatgtttggaatgcaaatattttttactgatgaggatgacaattcaatccctatagattcaagttttcatcacttgatcggctgatagcacgaccacgcacgatctccttcgatatactgaattactgattgcgttgctcgctagcaggacagagcaaactgtaaggtcctgacaagtgataacacaggttcagccgttcaggtatcagtatcaccaaacaaggtagtagtatcagttaacagtccagactggcgtactaagaaggttctcttagaaacgaagggacagttaaacactgatgaaactataccgcgggtatcaaaagcaaattatgctgtcccttggaggggtcagcagatgggaagctaatgttgatggagcatccgacataggattgtcatttcagaggaacattatctgctgtgcttcatgaacagtggaaagaaccttatcttttttcactcacactgcatttcagaggatcatgatctacagtgcttcaggaacagctgaaaatctcctcttgccgtaaaaaaaatcaaagtcagagctcgggcaatgaaattatgaaaatattagagggaagaatttctgctgtgactatactgctaatgagaaaagagatactcctttcagatatggcgcttccacttcctgattgttgtcatcttaaagtcaatataaaaagcaattcttagatcatgcattcacttttaaaacaatcttgtattgatgtctcaatagatgagctcaagttatttactaattacaaaaatatgaactaaagttgcaaaacataattgacacaagtttttacaaaagagtcaagttatggtcaaacataccacaagcttatagaagtacaaactgacaatgtgtgtcgtagctaataaaattttggccttaaaacttactctagtcagagttcagtttcttctcgatgcttgatttgcttaggataaaaacaccaacaatgataagactagcacctacaaaccactgtatgaacatacatcaaattcaaaagctgagtgcagttcagttacaattttgtatacatgtaaactcaaaagtggggaaagtgatgtatcagtattctacagtctgagatacacctgataatgcagtggcaaagggtgtgtggtttcaaccctgaggtcccgtgttcaatccccaacacgctcacatttcttcttgaaactgtttggagggacatctctccctccaaatgtctttttttattattattatattttacagactgtacataaattcagctgtacagatatagtaggcaagtgatatgttattattgttgtatttatgacagggtttggcttgtatttaactggtatacaagggggcaagtcattgctcatgatataaagcacaagaccatctatttctctatctgaaaaacggcatctattttagcataacaacctaaagatccagtgtgttttctttcctatcaaccaactgcatgcatctctcaagaattttttcatacaacagtaaattataagataatctttgtatgctatgtgacttttcaagcgagtaatatgaatccagataaagtggcctagcttaataactagatttaatcctatttataataaataaacctactcatactactaagaagcaatgtgacagatcaacctaggatactcttcccatgtttgaaagggaagaaaaagcccaatctaacagaggacataagctaacacaaataaatttgaaaatttttagctatttgatctgcatgaataactagcttgatgtgcacgcactacacagaagggagaattctcatattaccttagaaggcagtggctcctcgaacagaaagtaccctgcaagacctgatgaaatgaagttggcagcaaaattggtgacggttgcttggagggatgacagtgctttgaggctgttcacatagcagccccacattgtcacattgaaaagtatcaccatgctgtatttcagaagctgtagaaggcaataataaagtcaagtctcaagtaacaaaatagcaggcagcactagactacaagtacactggtaggaggaactaatccggagtacaggttaaaccggtatcatttgatttgaggtattttcacaatctgatcctaaactaattgaaccacacatgatagttaacttttgatcagcaatttccacattatcccagttatacttctagcactaagtcattagctgaagggatcacacatctaacctcgaattatctgatgaatccgcaacttcggatccaagtaagtgactgtttcatgcccatgaacttggtaaaatcatttaatcgaaccagcatgaacaaattaaacccgaacaaaggctgaagcggcctattaaggttacagcggcagccttccaagcaaggtatgaacagaaaacagaatgttcagatcggagggaggtagagagagagctagtagagtaccggaggcgcgaagaacttggcggagatggcggcgagcgcggcgttgaggcccgccgcgagcgcccacccgtagccgcctccgcgtgccatcggagctggagctcaccggaggcggagatccactccacaactctgtagcagtcctctcatggtggagaaaactgaagacggaggggagaactgggccaacgagcctgggtttcgctaaatgggccttagttgcgaggaaggactgatgaggcccacataaaaaacggactacgtgggctttgctgggcctaaatgatgtacagtacaagaccgggaggtagagggattggggaagagaagcggcggcctgatcaggcgtcgtctcgccgactcgcggtgccgccgccgccgccgcggccaatcggccatcggagcgcactccggcggtcgcaccaatcctctcgtttccatgagggccggcgccggcaccgggcgtcaccgccaccaccggccgatcgattggcgttggcgcgcaccgccgccctagttgtactggtttgggcgtgtggcgagcggcgagttacgatccgtgggtggattttcagaagctgatccgatcaaccggagcaattcagcaggtacacccttgaatccttgatttctgcagtttttttttagaataggaatttctgcattattttgatcagactagttagtgataatatatattagaccaacatgaacagagattttagactgagttcattatcccggtataataattgattaatgggtagtaagcacgcactacggtataattaattagttgttgatcccttctacctatcacgagagaataggcctcctatttggaagatcatctgttgtcgtatataataatcttacggtagggatgcaagcgggttttttttaagcccgcttatatatctctcttctagtttattttttcttctaaattttatactatcgtgtaagaaatgaactagtaaacgggtttttatacgggtaacgggactaactactggcatccctacttacggcttcgtcgtttggcaacaactgggaacaagactgaattaaggtctagggatttgtggtgattgagtgagaccgcactaataacaacataggagtatattgatttagcgaatattttgcttcagatctactacctagagcctgtcactattctatgcaaatcacatctgtattctcaggtagtcacaaatattctcttctatcaaacacgccaaatttgcataaagccataacacgtactccattcacctccccttttagtaactgtcaataggactatttatcttcaaaactttgatcactcgtcttttttaaaaaaatatatataaaaatattttagtaaattgtagtgtattgtgttagtaaatttgtatatcgaattgatacgtggatttatgatgtatgtgtggatttgtggtggatttgtgatgtatgtctggatttgtggtggatttgtgatgtatgtgtgaatttgtgatgtcaatgttcgattttgtgatgttgatctatgtgattttggtgtaaaatcaatatgcaaagaacaatgaaaaagaaaaaaaaaaagaggagaatagggattagagagcctggcgctaccctcttttgttccagttggtaaccgggaataaagatcaatctttactcttggttattttaacatctttagtcttgaattcgtggtccagttgcaaaaccaggactttagagggttaccaaccgggagtgatgcccctttctccagcagtgctataagaatctatatatataatacaactttgttttggaatctatgattatgtatatagcctgatcaatcgcacagccctcttgactagtgatcacaatctaaatttcctagagttttttcttgataatatttgtacaagttcaacgagttactagctagtgtgctgagtcagagtagcattttgttctgcacgcgcacctcttgctttagtcgtttctagcaagttatgctgacttcaaatattatgtcattaattactgtagagagtacagtgtactatatatgccacccagctgggagtcaaagacatttacaaagtgccaatgtaggatcacatcaactgggaaaaaaaaagcacattgcaatgccatgcatcttatgactctgcacaggggacagatcgattaaaggttacaatcacatttgggaacataaaaagaagcagaagaaaaaaaaagagaacaatttataaaaatttcagctataaccatatatcccatccggttgatgtgatgaacacatcgtgctgtgaatgctttgtccctcatttgtcaaacacacagattccgaggtcgccgtcgacgccgctcgcgccggcgccggagccgagcaaccccgtccacctgtcgacctcgtctctctcgtcgctgttgagaaacagcaatgctgccatgtcgtcatcgccgtggtccagcggcgagctcacaccggcgactgccgccgccgcggcttccgccgttgcctccatgctgccacactccccggggctaagctgcgacgcgacgaacttgtcgagcgctctccagtccgtggtcgtcgccaccttgtcgccggcggcgcgggctttcttggccctcctaccgccattatcgcccttgcagtcgtcgtcctcgccggcggtggccagctggctcgggttgggctggagcggcgccgcagccgcggaggggctctcgagctgcggcagctcggcgaggtggctggagtagtggaggagggctgtggcggcgccgtccagctccgcctcctgcttgaaccgcccgctcctgtgctgccgcctcatctgcgcgtacgccgcgctcggatcggcgaacgccgccgccgccgcggcgctcatgatgttgcgctcgtgcaaggagtagtcccacgtctccaccatgctcctcgccggatacgccgtcctcttcttgaatgctcggcacaccacccatccttcttcctgtagtacacacatgcaaataaagttagatacttaggtggtgtttgagtctcccgaagattaagattaaatatttcatgtaaaacgttgtggtaataacgtataattaattaagttttaattattataaacttgaaaaatagattaatccgatattttagaacaactttcatatagaaagttttcacaagaaacacaccgtttagcagtttgaaaagcgtagcacaaaaattcaaaatttaatccattgttttaagaggaaacgaacgggggggatgtgagctgcattttgcaaggttgacattgacaccaaagtatttgccaatcattcgtaaagttagctagcttcccactgtgtgatagtggaacaatacgagctgataacttttttagttttgtggtgacatgtttgccaagcagcatgcaatggttttgatgagtactagcacaagttgcatacagcttgtaaacaatatatggcgcatgttaggacgttcacaccaggggaaaccctaactaggccatgcatgcgcatgcaattgtctagggaaaaaaggttttggtgttagtggtaaggtcaggatggcatcaacactggatgcaggctacctttatttgggagagaatagaagactttggaaggctcacaaaaagggaggccaatgcaagacttatctttcaagaacaaaaagagttgtggtgctgcttagtgctactgatatattcctatctatatggtccattactagtggtacatgaattagacatgcttgcacgcatgtatatcggcggcagatctctgtgcgtgctactttagaaatctctgggcaccattagaccttaacctctaataaggcctaagctggtatactgcattttatcttcagttgcaagttgcaacacacatatataagtatataattcagatatattttctcagatatataagtatgcaatgtggtcactaacaaccttaaaaaatattttcttttttttttgataaacccagcctatacatccaaccggatatatacaactttttaaaattaggaacttagcctatcaagcatggaaccagtttgctagtttatgtagagctagctagcatgcagagaaaattaagaaaccaattagctagtgaaatcggtatatgtatatacctgtggcggcgcgttctcgtcggtctcgaggcggtactcgtgcatgatccagtcggtcttctggccattaggcgccctgcccttatagaagacgagtgtcttcctcatgccgatgagcctgctcttgtcgtgcaccgccttgtccctccccgtcgccttccagaaccccgccattgtcgccctgttcgtcctcgtccccgtcgggtacttcctgtccttgtagctgaagaagtaccactcgctttgctcatcgtacccgatcccacaatgttcttcatcaatcaacaaaccaggcaacacaattaggataaataatgccacaatgatcatctctgaaactcaaattaatcatacgatctctagttgtaccttggagatcccagggttcgatgcggtagagatcgatgtcgcggatgacgtcgaggtcgatcttctgggaggcgaccttcttgcggaggtagtagccgacgagctcctcgtcggtggggtggaacctgaacccaggagggacgcatgattccatggcgtccatatgatcaccaacctgtgcctgcactgcaattgcatgcaccgtgcatcagattcagcaacaccgtcttctaaatatccatccacacccaatgcatgcatgcatcaaatgatatagctcgcgagtggcactagtagtaaagaacacatgcaagtgctcgaatcattcggtgcaagcaggctggctatcttgcgattttttataggacacacaaatgcaaaagctatctgcacagaagggctagtagcattggtttggtctggatactgaatgactagctacagactgactgacaaggagtatactactacagtagtgtgtatgggtttcagtgctttggtaaaatttaatccagccatgttgggtttgcactatggactttctaggataaaaaggcaaagtacggcagagcctgggcaagaggccagcagggacaaatgtaggaaagctacaggcctgcgaatgatactgtcgactggtgatatctcagaggcatgtgggctatagtcagcaacgaattatagctgttgcagcagcagaaaaatggtctgctatataagagcaaggtcaatagtgtagccagctactagctccaataacatccatgtcattttatagccaataccaaaactaactagtacaataggttggctattatatcaacatgatctcattattcaaacaataaactttacatgtgcatgatcagaaacgccctcaactctgtggcttatatggccatttgtattatgtaataaatatgggttatctactactctacttgaaaaattaacgaataacaacacacttgataattcacatagtatatcacaacccactgctgcccaactgcataatctatacatgaaaaaaggagaagaacaaaagggaaaataaaaggagctataggaagagattagaacggactagatgcaacagatgagacgaagaatcggtagaacaaacatagacgacaagcattcaacagacagtgggagaagaaaagaaaagaattagaccaagccaattcaaatcaagaagttgcttattgctttgggtgccagttgcatgcccgcaccaagcgcctctcaatcctcctctcgctttctttgtcgctgagaactgggattactaactttttgggcgcactggagctttcacggcggagtttcacgtcgcgggagaaaattccggcgagacaggggtgagcggaggcggcgtgaagcggagcaaaatgcatcgggcggatcggaagaggcacaacagaaacaaaacgatacacgggatcggcggggtggttgcgggacccacaaatgcatgcgtatctgtgtatcgctcggcgctacatctagcgcccgctttgttccctctctccagttatctctcttccacgtgagaataatctgagttggaatattttggagcctgctgattagatttattgtaccttctctgattagtttgttcagagttcagtaatttgtttagagtaataaaattaggggccttaatttgtagcaacaattagtgtgacttttatactagagagtgctgcatatatgtttttgaagtgcatgtgtgcgctagatacacgctagtatagctagtacttaagaacctcaatatgcatgattttctactcattctgatcatacagctctcatgaaaatggattcatgcatggctcaatgcaaagcactgtacgcagagcttgccaggcctttattttgtacatatactgtacatagcttagatatacgtacgtactgtatatagcttagagcatcaagtatatatgcaatgcaatatatctgcaattaattctagaattgaatatatcttaatattagcagctttttatctagttcgcaaactaagggcccctttgaatcaaaggaatgaaaaaacggaggaataggaaaaacatatgattctgacaggaatgtaagtgtaaaacagaggattgcaaaccacaggaaaaacataggaatgaccgtttgattggaccacaggaaaaacacaggaatttgaggagagataaagactcgaaggatttcttccatgaggttctacctcttgttaaaattcctccaaaacttgtatgggaagaggcattccataggaatttcataggattccatagtgttcattcctttgattcaaaggtctttgtaggaaaaattcctataggaataaaatcctctaaaattcctatgaatttcctttgaatcaaacggggcctaatgccctctttgtttgggcttgggcttattggcttagacttttaagtcagcttattggcttatatgatttataagccggtggatttaatgttctaagtttaatggtggagtcatgcatctatctcacataagccaaaaaaacttctccaacctagattttggcttaatagtgttagagtggcttatggcttcaaaaaagccaaacgaaaaagctgattgtttgtttaggcttatattttttgacttataagttggcttataagcctaaataaaaagggtataaaacatatggcatttatacatggtgcgtggatgctggggctaagcttaaaacacaacaaccaaaacgagaaagctgcatcgctagcatttgccgggcggatgagcacgcgcctgcatgccgtggggcatgtaaaaaaatttgacaaattaaaggtggggctgggagcaaaagatggagagaataaaaacgtgaggagaggaagctagctagccaatgccggggatcggagggccctttcagcgatcaggcctgcaaattaaaggagaagaagaggctaaaaaagcgccactaacactcactcgatcactcactgctccgtgaaagctatagccatggcatgcacagagagaatggaaagctaacacagcagcagccagcaggggcacacgactatcggttttcttgcacggcctctgaccgttctgtctgtttgtcgaggaattccatggcacagcagggaccctagcttagctctggccttgcattgtgcattgtgggcgagctgcctactgatcctagctactagtagatgcgctcacatttgctgagatactgcttgcgaagttgcaacgctatagtgcatgccgatcgtactactggacggggagtgtcctgtgcagtggaggagtacagtacagctcgtagggcatgcatggatggtagctcttctgtagggtggacacagaaggtccaggggtagatcacaatcattttgtgtttcccctttggtttttagtattgtgatgcatggttgttgctagttatatagtacttccttcgtcacatattaagttaatttagtatgggatgtgtcacattctagtattatgaatgaacaaatttttgtctagatttatcatactataatatacaacatctcatactaggaaatactctttctatgttttatgtctcaccaaagaaaatgagctgataagcctaaatgtgagggagtggattttgaactgttgagaggacatcacctcgttgtttgcatatcatctaaataaatatgaaaattttgagaaaatagataatatatgatatatcactccacaaacatacaagttaaaatccaatttctacatgttgcaaaagaaaattaaactatagctagttaacatatattcatagccaatttttcttttgcgacatgtagaagttaaatttgacattccatgtgtcgtagagtgatatatcacattaatctatcttgttattttttttataaaaaaattataaccattagatgacatgcaaataataagggaatgtcccctcgagagcttgcaagagaaatgacaaattgagatcttgctcaatgcaacgaatttgaataacaggacataatgcatgattaattaatttataatatatatataagtatacaccattcattaatgtgctaatgaattgttaatttgtaaatccagtcctttcatgtgagatctaccctttttaattaggataaaattacagaccgcctataagtcccgatgtcgggtatatacctcatggcaatgaaaaaggaatgttgattttttattgatggatcagtcactacactaaagtattaatcctctagggttgttattatgtaaggatgtcaactaagatggtgcacgcatgctaccttgctaacattgtcacagacctcctatggtagtatatactataccaggttgggtcagaatggatagaaaggggatggtggtcctagatcgatatgtacagtgaccttcgtatccgtgtttaatgattcaagaatgagacaaatgatttaccaagattaattatcctaagtattgcacatatagcctcatgttcccaaaaatgagcattattttagttatggcgatgcatgatatatctacattccacacttgtgagcagcttattgatcaagtgtgtaatgtattagatatatcatgcatcgccataactaaaataatggtcacttgtaaaaaaaattcaaaaaaaaacattccacacttgtgtttttatatggtagtagaaattggaacaaaataagttatggaagatttccatgtagaccaaactagtacagtgctggtatagtttacatggcaaaaggctacattaatttatatttgtttttcttcaaattaatcagactttggaaatttgcttgcattccgaccatttttccaattccagcctctgcatgcaaacctcatctagcttggtgcaacaaaactactatgcgtggactgtatagcacttattagcttactcatataaggttgtttcgtgtaaaagaagtgttgtcacgccgtctattaattattgtacgacgacatatataagtggatataatttagttcaacatatatatacttcacagtgtgtaaaagtacatactatagctacagtagtatatagtgatctgaaccgaccatcttgagagtgctcgtttaatttttatagcaccatataccaccatatccaaaaatacattggccaatctaaaaggcaatttcggtctatttgagtgtatgattcagatctttctttgggggtaaaatggaacaaaaagaaagaagaaaaaatgggttatgtatatgaccactgcgctttctcgaaaaggaaaagaggtagatcaattactatgatcatatagggggtcaatcagaaggatgcaatgtctctgtgcggtgtgacagtgttgtagttacatgtgaatgaacacatttatttgtgtcacatttattttttacagtccttaaggtaccacttttctcttgtaaaatttgataccttgagaactgtaaaattgctctatatacaaaacatatactaccgacacagagaattgtttgttttatgatttttattataaaaatattatgttgaagtagcaaatgtaattcaaaatatataactttacacacatactactatgtatgtagagcatgcaataaacagcttgatttttaatcaatatacatcatatcacatcagatgcatatgataccaataccagtatgaagaatttttttaagcatctgattatgatcaataaagatcaacgaagaaaagaggggaatgtaaaagaaaaaaaactgaaaaggttgcaaataaacagggcatatatatagccacatctttttccataacagaaatgaagaagtttctgcatcgagatgtatttggccacattcatagctacatcttgttcgactattttcagttcaagctagcaaagaggagaagagaagtgctagaattttttttcgaagaacaagcagctaaggatttttgcctaatagagaggagctagattgaacaaaattaaagaacagatcaagatgatcaaaccagcacagatcacagatcgatgaacacaccaacatatatagctaataactgatcgatcaaccagtactgaaactcacctcagatcaagcgacagcttcagttatctcgatctatacagattaggcgatcgaattcaagaaactctcttctccaaggagaagcacaaactcgtctgtatgttctcttctctagctgttggcaagaagctggcctgcgtgtgtggaagaataaatagcattggagaggaggagatggagtttgcattggagaagaaaagaggggtcgagaaggtggcgggtataaaaaagggtcggggtcgctctcctttccgtcgcgcgtgggtgaggggaatgaaggcccttgggccccacatatgggcccaccagctgacgtcacgtcgtcctcttcctcctgctgctagctgctactcctctttccctttcctctcccggcactgaacagtacagaagaagctctagcattcgagcatctatgtctaacctttgcatgtagctgatgatatatgtgcctattgatcaatcttgtagcggccagaacttagccatgatccagctagggcctttgcatataccggctcttagagtaattcatacgtagaagcaggtgcaaaggtatctgcacctagctagtaactcatgcatatatcacttaatttaagagagactaaacctagatctctcaatggattcggcggcatgccattccagtgctagatggcatacataagctactagctatatttgatatatattctgatcaagaaactagaacagaagaacatatataagttagttatgcatctcgtcctctctaatttggagaaacgaggcatgattaacttttaaatgcatgctttagtttctggtgcaatcaagtgcatgttaattcttgccaatggtaccacaatgtgctttcagctgtttataggaccatgttgccccagttgacagatgaacaaattgctcagtagaatgagctgctgcttgttgcaggtcccgtacacagttgtccaggtatcatgcatgatcagtccattctatcattgcagtagatttctggggcgaacgggtttccctactttcaaattgtgattgatgcgatatgtttaattgaacaaaatgatgttaactgtacagttttgatctgatatgtaagtagcaatcactagctggctagctagtagcagttaatttgattttgatcactcaacacagaagccagtaaaaatcaccgatctctagctagctagcttatcaaatgcagatcgatatatgcaatacagacatgtcctttcttaatttgactattattattcatgtcctacctagaattttgtgttctcagatcagagagcaatatgcaccaaggctgatgagggactaattgcgtctgttagccttagccattagcattaaatcaattatattccagaagcatgatcagtgggaattatgatgtcgataacacaggggcgtaggcatgcattacacaaaacatgttgtgctaagtatgatgccacctaccactgttaggagccacagggaaacaacaaatccttgcgtgataagattggatcaaatttgggaaccctcgcatcattccggttctcattgctggctagctgctgatcaactcatgatcaaagaaaagctatttacaatgatgcaatgaaagtgaaacaattttagatttatttattaacaaattgtgatctgtatttaattaagccaaaataatttcttcaattcattacctcagaaagttaaaagttttgccaatatgaacaatggcataactttctacatgctgtgcagagctttacaacaccagaatccaactctaactaacggtatcatgagcaaagtcaaggaaatctacggagtagctagtgtgctataattgttgatgattattacaaatgtgttctaattcaactgggtgaccacagagacaaagcaagcattggtcaaattttggattaaggtagtgtatctatattcgatctttctttttcgtcaagcaaagaaagcgaaaaagttgtgcttttttccttcaataataaaacctacatactacaccccattctagtccccattctaatcttctggatgcaccatcttttgaaattttcaattgtaaattaatcaagtggtaaactcactcaatcttcttcgtcacactgagtttgtctgttttcccccataatataaatacttagtattaattagacctagtactccattttcaactgcaacaacgtactttaattagattaattaattgccttccctgaaaagtatatatacatgtttgtagtacttgatgaacaagtgatcagggaacaaaaagctagaaatatatggagtccagctacagcataacatacatgtttgttctcttttttttccaataaatatagcagacactggtgtactggaacaaaacaatgatacacttttggtttttggaccatatgaatgtcgtaacacagaactttcaaaacctaataaggataggtagtgtgagagatggaaaaagattatggacacaggggcccagcagccctgcaaattgcttgggtttgcatcatgttcttgcggccgggtgactataataatgccggccccttcatctatctatagctagctactatagacatgcattagtttctcatgaacttttgtttcctcatcacaaatgttttggtagagagagatggagaggtcaaatgggaggaattaattcaggtaggacatagcaggcgagcagctgctaatgatcatgtaacctcaaaacaatctcacgcggcgctaatcccgatgggagctgctctccacgctggagcacgacattcccctgcacttttgctccccggacgacacgtcgtctgcagatcactctgggattaaaccctaattaattcagtgggtgtgccctgggttacccatgttcttgctgcagggttagagtggcgcagcattagggaacaggggccagtaggatattatgtatagacgggttcacttttcttgtctctgcaagctgtttctgttcttggttgacatgttgataaatttaagatatttcttggtctacacgagcactttaaccttactgtctagttagtagttcattatattaagaatgtacattgccattagcctgcgctgaagagtgattagcagcttaattagcatatacctgaagggaaggcaggtttaatgtgtggaacagagttccaaattgatcatctagatagaggacatgttctggtttctggtcagcttctaattaataaccttgctaatgttctatctcccggcctctagctatggaatatacgtactaattcttcaattcatcatgtgcttgacagttgacaccgtatgcagcagcattgaagctagctagctgatcaccacatatttcttaaagcgatgcgcttttcatctggcattgcacacatatttgcacattactactatacacttcagcagctgcatgcgatcgaaacatacaggaacaacagactgatcaatcgatcggaaagctgtaacggcacgccatgtttctttcttttctttcttggttaaggctggctgatgacttgtcctttcttcccccaccaagcatgtaacagcatctccccaaaagtgcacttaacaataacaggataagcttagcagctgttacgcctcacccgtacataagcataaactacaatcgtgtggccaataactgggcgtccagggtatatactaatcatgctactcccgatgatgcatctagaactagctagctagctcccaatatattcatctacttttaggcccacacattgcagtactgaatccatgtgtctgaaactatgtactcctagcagtagcagtatatagcagtagcactagtaatgtagtataaaacagggtacatatatacgtagcaacatcaagcaaaatacagacgtgttggtaggacaagaaaaggaggtcaagttgcatattgcctggggccggacaccgatggacaatggtgaccctacctgaaacgatgcaactcgtcgagaggtccagacatatggaaaacgtctgaactcgacacgtacctagctgcagctgactgatgctgccttggctaatggtatggtcgatgatccaaaggctttacgtacaagatacactagatgcaaagtacacatacacgtcgtttttgtactcgacgtcgttttaggctacgaggatttccacttgtaagcacgaaggtacgtccatgagagtaacctctgacaggttattttacatgtggcaggcttggagcagttgctagctactccagcttgcacaaatgtgttcagacgtcgagttgcaggcagtgtgaatgtgccatttgtatgatcagcatgttgatgtgtagatgcagccatgcatgcagatattgcgaaagcagaatgaaagttagctatcttgccacaaatcgagtgaatacagtgttttgtttgcctttcgtctattcctcagaacgctaaaaagcgctgagattttttcccatggaaaggttgttcttttcacagtacagtacaccggcaggcacatattgttgcctctagaaactcgccattgtggcccaggccagccggcgatgcagaaaagtcaaaagttgttcagaactgtactttatctgtgatgtgacgggcacaatacatggatgctgtgttcaagatcatatctgctgttagcctgttactataagatcatatcagaccgagcaggaatgcaggatattaaggagtatgcataaaaagttatttttcatacttaactttcattggttggtcggcaccatgcgtatctttgaaatgctgtaactaactcttcttaccttggttaattaatcgttttacttaaccggatggcgactgaccaaaatatcctgcagccccagagtaacgggctaaacgtcgctatcaaagttaacccctctgcttcactttgcatcattagttacctaagcatatgataacatttacaaagtcccatttaaactcggatagtgtgtcggcgtccacggccgccccggcaggtaacattatattggtttctggatgggaaaaaagacagacggtccccatatacaattcaaactcgatcgaaagtcatacatataatgttacatgcgtgcatgcaccaatgcagatcactggccggacgtactgtaagtttggactgtaacagcatgcagctggtatccaaccacgcggggcaataaccaatggaacggtggtaagtggggcggtgcatgcatagtgcggatggggacggcacggctcgtcgcccatgcaccgcgtgcgctcctcgctcggtcgatcggtcggtccgaaagattagcccgggcggcgcccatccgcccgcccaatcatgagcacctcgcgggtcgcggcatcatttgctcgagatatatatcgctacgtacgtacacggccggatcggtgcgcgcgagcccgacgccgggtagccccggcccccaccccgcgcgcgtacgtacgtaggccccgcctcgcaccaccaccgctcgtacgcgcgttgcgccgtccgcgcctcggcggctctcgtatatccacaccaccccgcgcgtttcgcgtgccggccaacgccgacgcgcacgtacaccaccaccagcgtgcgcgcgtatctcgcttgttttccgcacgacgcaaccgcgcccgcgcagggggtgggctatagctgcaggttacgcgcgaggccggcgccggcgtgacctctcccttttgcggttttgccgagaattgagcaggcaggcatgccgcgcattgtactacaggttctatctgtgcgacgggatggagaccttttggatcgtttggtgaggaaagatacggcaagttggctagcgagaatacatgtgtgagatccttggcgtaagcggcaaaaaggctatagcatgcttgtttgctcccttagtgcatgcataaaaagcctagctgctgtgacagtaacacacacacacacacatacaaattgttctcttctgtgttgtactgctagctagttagctacatatgctcgcgctttcatcctctctagctgcttcaagaaaaagcctatttacctttgatgtaagagtgatgacgtgctaaaaatgctactgatccggtgacccgactgactaagaaagctaagcttgattttttttttctggactctcactttcactggcggcacaagtgtgattgatttggcggcacgcttataattttgaagcggtgtgacatggatgtatatacatgagccgacttatatgcatgcctgatgtagtatatctcagatcgatcggctagctagtgcgaggagaggtgaacggcaagggatcatcagaaggatcgatatcgtaggttgttacgagttactattgaattgctcctacgtggacagaggctgcagccatatatggaggttggtaaagggaaagtgactgcacaacacgttggctactgagaaaagggcagctgatgtaggatagatagatatatagatagagggatagatacttgttgcacactactcttaccgcttttgatacatgtgatgtgagcatcaagcttgtttctttcttttcttttcttcttcccttcatcctttctcttccctgtacatgctgtccctgcatgcatggcttgtcgatgcttccttgctatcattgctcgccggcctccattcccgttccattccagggtatggagtgccatggttgtgatctcaaaagctagttggcgtgagcatggcattgtccggacaagcatgcatgagagtagttaagtaaattgaatcaacttcgattgttaacttgatagcttccctgctgtgtggccaaaaaatctaccatgttgttcgcttctggaacggaatcattcaggaaactggcagcccctcggtgtgcgtgaggcatcgatggatttcgtggactaataaccagcggaatgatcgcgcgctacctctatcaaatcgatcgtctctcatgacgacgagcaaagaaacgacatgatacggcacagaaaagctcgcaaaccgtagcagcagctcgcaaagctcataagtacaagatcctctctgatctggcctaatggcagacagacaagtggaccattcatcacatagacgatcgagagcaacaattagctagtgacagttcagtggtaagatatgtagttactaaaacttacaaggtgcgactgcatgcaattgcatgcctctgcaagtctgcagcactgaatgcagtgggtggccggccgggcggtgcctttgatctcactgagtcactgccaaattcagctggctagctggacaccgcgcgcacacgggcggttgccgattgatgctcctcctccgcgtcggagacgtacattacatcatttcggcgcagtggaggaggtggggagcacaccgcgcacggaggccgggccgggcggccgatctacatgattcacaccttgcgagctagttctcaactcatgcgagcaatcttttcctgcaaagttaccatccattctttttatctttctagtttcgtatatctatgatctccattcacacaacaatatatggctgtggtgaaaaggctctgttaaaaagcggcatccattgcagcccactcgatcctgggtgctcttgcgatcgatccatagcagcctcctctggtagctagctagctttcgtctctctgactcttctatcctgtaattgtgcccattgtgcattattctgcattgacgtatgcttgcctttcgctatagtcttttcctgctcttctcttcaagatagctagctagtcttcagtgattgtactgttcctttcttgaaaaagaaacgcatatacagtctgaggataagatattgagatgcatgcacacaaatgcaataaagaagagatgtagaaactctgaagaaagaaaaaaaatagagagagagatgttacgggtagcagcttccgttctcccttgaaagttcaaacggaggacaaagaggccaaattgctgagttggctgtttaaattgggcttaagttccccctcggcccaaagtagggcttcagttgttttcttattgggctagtgtagactgtaggcttgacctgtttctgatttctgaagcccatgtattctttcttgtttacattttttttccggagtcgttagaaatatggcgccatatgctacagtcgattttttttcagccacttacatagtagttatatctcatttacaccccacttacatatataattagtatgtattttttgaatttacatatgtaattttagtacttacatatgtaattttgagacttacattgtaaatacactatgaacttacaatgtaaatacatgccgattattttttgatgaaaaatatggcaccataaatatagctacacccttttttttatagctcgaacaaacaaatctggagacactgccaaagtgctagaaaaatatcaatcgaacatatgttggcgctatgtatcttaggaattgtttagttaggtaaaatttttaggtttgattgtcacatcggatattcggacaatatagactaataacaaataaattatagactccccatgaaattgcgagacgaatttattaagtctaattaatccgtcattagcaaatatttactgtagcaccacagtatcaaatcatggcataattaagcttaaaagatttgtctcgcaatttacacgtaaactgtgtaattggtttttatttttatcaacatctaatactctatgtatgtgtctaaatattcgatgtgatggatgaaaaatttttattttagcaactaaacaaagcctttgtgctacatggctgaatattaagtctttcgaagtggtcatacaaaaattctcgtttgagctgtgctgcaagaaactctgcatctatcgccctgacacgcgcttcattacgatgaggttggcaagcctgcaggacatcctcgtctagtcgtttgcacatgatgtagcctgtagcctgtagccatacaagagagcacgaccaaattactggagtatggtacgttgctgcaccgcgtactgttgggaatggaaggcgactaatcaacctcagaggccacatcccatgtggtcctcttcttgaagacgtcttttaccctctactggaacggcagcagtaaatcgcattgcctcccagtagtcaatggccatcgatcacgagcaagcaaggcattgatacgcgcgtacgtacagtcagtcctacacacatccgtagtggtatatactccctccgtaccaaaaaaaaagacaaactctatttttcgtgcctaatatttgaccgtccgtcttatttaaaaaaattatgaaaaaaattaaaaagacaaatcacgcataaaatattaatcatgttttatcatctaacaataataaatatatgaattataaaaaaaattatataagacggacaattaaaattggacacggaaatctagggtttgtcttttttttgagacggagagagtatggtacagtggttcatgccatgtcaatgccggcctcacgaggacggctagctcgccgtgtcgaccgcgccaccgcgaacggggcgtcacggcctgaaactgcaagtgtgttccttattctcggttagaattcagaaattactgtatttcctctgaaacctctgcaggtgtacgtacgtcgtcgcgcttggtcggtgacatgaataactagtccagtacgtagtccgtacgtacatgtacgcggatgatccccgtgctgcgtggtccgggtgcagcacgtcatctccggcccagccagcctacgctcgtgacaagtgttgctcgatcgttcgttgcaattgaccttggagctagccggtcgggccatggcttcgcttaagaacgaccgtcaatgtctctgcaaattaagcccaaatccagtgcaggatcagtgcggagacaaaaccgatggcgatataaccgaatcggccgatcgatccattccatgtgtcgcgctcgaccatcgctacgccttcacgacagcccggcgcggcaggcacgtcgtcttgcggatcgaacaaaagtgggcgatgtgttcggcaccaccggccgccgcccgcgcgtcccgtggagaatccgaatagaataatccactactactagcagtgttacatttcgcctcacagaggctcacagcttccacgggagaaggcgtcacggggagctacgcccggacgccccccatcgtcgtggcgagcgcgagtcgcttgctcgatactcatcgctcggtgtggcagggcagcaacggcagcgcgcgcacggggggggtccacacggtttcctccgcaaaaaagccgctttctctcggtcgtcgtcgcttttccaaccgtgaaatctcccttcttccacaccggcctttggaggcttggagctactagcttttttgttcgtgcagccatgtggcggcagtgcgcttgcctgcctgcctgcgctgcggctgcgcaatgctctgcacttgaccagatcgtgatgtagtagtagtatgatgtaagggcattaccaatgtatatgttaaaagtggtttatatagatgggacccatataaataaactttaactatagcaatctcacaatgtatatggatacaatgtaacattaggagaagagagagaagtagagatatataatattatttatgtcatataggtagtgtatatgcatatggatatcttttgctattttctttatatggactagttgcccagtgttactaaatggctaaatggaatagtttattccctatggactacttttgtagcacattgtggatgccctaactgttgtagattaatcgcgactaacaaaatacctgtcttgccttgaccgtgtgcttccgataatccgatgcacgtgatgtgtcgctaaagcggctcactggctcaggatgcaccgtgcgtgttactaccaccgactgcaaatacacgcggatcgacagctcagtgtggtggtggcttcagcttggcggccaagaaacttcaaaaccatattatggcatccttccaaaattttagaagggaagaagaggagctatgatatagacagtgcgagccggctaccatgtacacttgataattggacaccttcacagttcacacaatgccaccatcatatcaccataagctttattaagggatactagtcgaccctgccttatgcgcctagaaacttaagcacgctgcatgtacgaatgactaattaagtgtgtgaatgtacattggcgaatctagagatcttttagaacatgaacaaacatatatgtccaaaggattatatggatgccattgaacatcagcgatggaagctattacattgatgtgacttgtcaatgagttcggacggttgcccgaaggtaaccactagccaggtcttggatccgctcccaaaaatatacaattaattatttctttaattaattaaatgtggaaacaaaactagctaggcattatgcagttggtcacaaaacgacatgtttttttagctggaagagtacattttactgctagcttgaagtgcacgagctcgggcggtcgtccggggtcaccaggtcttggatccgccccccaaaaaaatacaattaactatttctttaaatgtaaaaacatatgtgtgtgaaaaaggttaaaaactagctagacattatgcagctggctacaaaacgacatgttttttttcttggaagagtacattttactgccagctgagaaatagtgtgaagcttaactctaggtgcacaaattcggacagtgccactcatggtcggcaggccttggatcctcccccaggaacatacaattaacttttttttgtttaaatatgaaaaaaatatatgtgtggaaaggtttagaactagacatcatccagctggcaatagaacgacatgtttttttttacatcatcgagttggcaacagattgacatgtttttgtgactggaagagtacatttttactgtcagctttgaaatactatgaagcttaacgctaggtgcacgaattcggatggcctcccgtagtcgctaggccttggatcatctcacaggatatacaattaactattttatttaaaagagaaaacatatatgtgtgaaaatgttcagaactagacatcatgcagctaacaacagaaacgacatgtttttaatttgtcataggaagagtacattttacttccagcttagaaatagtatgaagtttaactctaagtgcatatatatgaacggtcacccgtggtcaccaggccttggatcctccccgggaatatacagttaactattttgtttaaatgtgaaaacatatgtgtgtgaaaaaggttaactagatcaccatgcagctagcaacagaacaacatgttattgtgaccggaaaagtacattttattgccagcttagaaatagtatggaccttaactctaggtgcacgagctcggacggtcgcccagggtcactaggccttggatccactcctaggaatacacaattaactatttctttcaatgtaaaaagcatgtgtgtcaaaaggtttagaactagacatcatgaagctggcaacaaaatggtatgcttttaactagaagaatacattttactagcatagaaaatggtatgaaagcttaactcaaggtacacgaatttggatggccactcggccttggatcctccccaggaataaacaattgactattttgtttaaatgtgaaaacatatatgtgtgaaaaggtttagaactaaacatcatacagcttgtaacacatcacgacatgtttttatgactggaagaatacattttattgccagcttcgaaacagtataaagctttaactctaggtgcagcaggtatgaaagcatactatttattttactagaaaaaaatgtaaacatgtaaatatccaactttgcagcggaatatgatcctccgacgtaaattaacatgtgacaattgccacatgaccccacttgtcagccacaaagttatggttatgttatgccagaggatctgattcggcatgcggatccttgggctggttggtttgcatgatattttcgtagcaaaaactagttgtagttgagtccatggctctaaaattctcctaaggtccgccattgatctccccatgcaagagggaggcatgtctcagagaggcctgtagcgactagcgaatgagcaggggtccaacaggccaacaggaagctcgtaccaagacttgcaggcagaaacctacatgaatgaatgccttgattgcgtgccgggcagtctccccacattcgcagcagcatgcagctgacaccgatcgaacagggcgcacgtacgtacgtccgaggttggccagtggaaagtgcgctgcgctgcgacgggtggcaacggaacgcaacgcgccccatatgcatcgcatccgtttcgtcgcttccgccttgccggtggctgccaaaattgccatcccctggccagtaaatcagcaaggggcagtggcgcagtgtgcaagctggcctgggtgtaagacggtacaaaagtggtgcgtagcgcatgtgaaactgatggtgaaacacatgtgacgcgagacgagacttgaggcggggagagggctatcaggcaaccccaccgcaccaccggaaccaccacctcacaaacaccgtcaccaaacgccgacttaatacccttaaaagcgacccgatccccagtccgggcaacgcaaacccccacattcctccgctgctgctgcgtcgcgcgcgcgtgtgtgcagtgcaccgcccgttcgcggagccgattgattttacaacaccgcgctcgctcgcggtcgcggggggggcggaagctggtactactcgctatcatgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagcatcaagaccaacggcgccgacagcagcgagaacgagtcggaggagtgcgccgacgacacccgcggcgggatccgcctctggtccgccgacggcggcgagaggagggagggcgtcaagaggaacgccgcgggggagccggccaccgcgccgctggcccgtcacgccaggagcctctccatggacagcctcatcgggaagttcaacttcacggcggggacggcggcggctgcggggaacggtgtcgcgttggggccgaacaggttcagcctggaattcggcagcggcgagttcaccccctccgagatgaagaagatcatggccgacgagaagctggccgagatggcgctcgccgacccaaagcgcgtcaagaggtaaataatattcgatcactctcccatccatccatatcgtctcgcaaatgcaaatgattagaaaacgatcgatgattgcaatgtatattgagcgctacgacatgaggggatcgatcgactgatcgctgagagctttcttcctccggtgacagggtgctggcgaacaggcagtcggcggcgaggtccaaggagaggaagatgaggtacattgcggagctggagcagaaggtgcagatcctgcagtcggaggcgaccagggctgcaggaat

SEQ ID NO: 58183 - DNA, 4035 bp, Oryza sativa
cgtgtccatatttcgtactcgtccataaatccacgagttactaagtgctccttcactttaaaagcatcgtcgaagtcccagactatttcattcttacagtcagcacatggacaaattatcttcctcatattgttcttctcagcgtgtgccttggcaataccaataaatttagacacttcgttgctatatggagacaaaagcctcggccaatgatacatccattcccgactttccatatctctaaaaaaatgcacataaaatatttgcacaattaataccaaatttgtagggtttattgaaaaaacttatcgctattcaaaactaattaactaaaggttaagtgtaaattaataaaaaatcaaagtttatttcaattttttttacacggacatgccaaattagtacattaggaaaatctaacaaaatcagatcatcggcatattacaaaatactataactatactatttttttattgcaccgaataaatagacattaaaaatttttttctctctctatatatgacaagatctagatctagatctagaactaagaggtggatgtgatagcaaaaataaaaaaaaaattgagaatttatgttaccacatgaaaccactacaacaagaggcatcaagtattacacatacatctaacatcagcatatcaaaagaaataaaattaaaaaacatggagttcttccttcacaattttgcatgcataaatccatcacaaattaaggtctaaaagcttaaaaaattacatacctagtgtggaaataagtagatctaagcaccgtagaaaaatcacccgaagatttgaagtcaaaacctcccccctatatttaagtcactttaggagagagaaacttcggggagaatgaacagggctcggggaggaagaagactatataggggcatcttttcaggcgggccatataagctgtcacaccctacaaatcccaaaatgtataaattgttgtttaaatgaaattattagaaatgattttaaaagccttgaagaaaagatctaattttaagtgctaaattccaatataaaagtgggccagataaaattttattaaatacttcacttgattctatagttcctagatttttctgggatttatttgagccaagaaagtatttttaataaatggaattgcatttcatgaataatttaaatataaaaaggttttaaaatctcccttttggctttgggccgaaagtcggcccagttctctccctctctatcttcggcctgctagagcccggcccatccagccccccgagctgagccgcccgctctccctcctctctcccgctaacaggtggggcccacctgcatggtcgtcgtcttcctcctcgcgccgcagccgcgccttagcgcacaagccgccgccgcccccttccaaattccgtcgcccctttcccgatccagtcaaattggtagaggggaaatgatcctcttgatctcctctatcttttctcctatagaaacttcatctaatttcgtttggaaattgttggattcgagctcgattcggattcgtttttccctcctaaccttaaaccttccttctcgccgccggccgccatgggcctccatcgccgccctctagcccctatataaggacctccgagacctcctccatccgtcgccacctcgccttagctcgccgccgcttgtagcgccgcctccgcgttagcctttgcgctgccgtcgccgccgcaagtccagccgtgcgccgccgccgctccggtcgtcgtcgtcgctcgggaaggccgccgtcgggttcgccaagtcatcgccgttcttgtcccatcctccgttttcgccgaagaccgctggagcatcgctgtcgtcgtcgacccgtgcacctccgccgcttcgacctcgccgccgtcgccgtccgttgccgtccatcgtcgtctgagccctcggtgagttcgccgcgtcgccctctacgcgtaggtgtcctccgtttgcgccgccgcgccgtcgttcgccggcgagcgtgagttgctgagccgtcgccggtgatgacgtcatcgctgacgtcagcgccgcgtcatccgtagacccgcggtagatcgattagatcccggccgttcgttttgggctagattagatctcggtcgttcgttccgtagaccgtctccgtgcacccggtccaccatgaacccgagccgctgacgcaataaatcatttttccttttcaaaaataattctttattgcgtcataattcaattaaaatctaaataaatgatttaatccgatttaatctttaaaaattcataactaattcatcttagctcggatttagttggttcaagtctctaaatttttctaaaattgagatctacatgttaaaaatatccacatgtgctgtttacgattgtttatgtactgttttggtgattttgctcttttatgcttagattccgacgttcacggagagtctgagtttgcaggagaagactttgaagagttccaaggccagcaaggcaagtcacacagatcccaaacaaccctttgagcatgttgatcccgtttaaagctattgtttctattcaactattgcatttatttttgaatgtcattgggtgggaataacctattgcttttgttatagccctttgatattgattacctatactttgtcacctggttaataattggattagctagaacattatatgattttagctaaagtaattaggatgcttagccatgcttagagactctagctcatatgaatgggataattaatgattcactattacttaatgatggcttaatgatagctcatgatggttaatcatgataggatgattaattaagatgccaactaaaacatgataatggtgagttgtgagcacatggttttgatggtcgtgctcatgacaattaaggaccggttcacgattttcggttgtgaaacattaaccgtcaccataagccagcgtgggcaacggctttaccttttgtatagtgtggttcattgtagagcaccagattgtgaagtgttggagataagctcacgggggtcgctggggagtccatgccttgtttacaagggggtgattatgattcgagaacggtacactgctttgatttgtgttatgcagaggatattgtcacaatctctattcgggtacttgttaagtatcgcgacgcatggttgacatgatgttgaggttatgtattgtgggtacagtggtacacctctggccagagtaaaactattcaaatagccgtgcccgcggttatgggctggtcgaacaatgtctttcgtgattagtctcatacttctcaccataataaatgatgctgtaattgataataacttgtttagctcctggtttggaatggtatattcctggtttggagataaaactgtgcagccgggaatggttgctcggaatggttgggcctatgcaacgggtatgttgtatagcgttggattaatattgtttaattaaatactttactgttttattaaattctgaagtatttgttaaatgccatttatgcaaaatgagactatattatgccatcctttgttatcccttgcatctgcatatttgctgcgtggcttgttgagtatgtcatatactcaccttgcaatcattcatcagaggaggagttctagagtgatgctgaaggtgtggagggttaggcgtagtcctggtcaagctgcttgtggaatggagtcgcctgcgccgtttatcttattttccgctgcttagaactttattgtttgagaggaactatctacctctgtaatgactttatattcgcttattaattagagtaataattgtactctattatcaatttgttattgtgtgcctcggctgattcctggatgagggtttacacacatgtaagcgtttggaattttggatagaaattccgagcgtgacataagcggcgcctgcgaagattgatctttgcaggcaggccatataagcgtcgcctgcgaagatcgttcttcgtcggcacacgacgtctgccgcctgctaagatcgatcgt

SEQ ID NO: 58184 - DNA, 8575 bp, Oryza sativa
cttccaaactgccaaaggacctcggttgcactagttttgacagctcagggatcggctgtatctgtttttgaggttgaaggacgaaaattagatttattggaaaattaagggacctcagatgaacttatttcggaatggaatgtaagaaaaaaaaatctatgatccttacctcaaccatggtcatgaaaaataatatgaaggaagatgattggacattgatttgtagaattcaatgatttatagatggtgttgcagatgacatgtttacatgttgagctttagaattagtgggttataactttacagtaagataggatacacgagtcctaggcctccactcttttttggcacacaaaacatcattgcagcaggcagggaagatcctgattcactctagcatattttgaattttttattcggtggaagcagtgatttattccacaaactagcaatcatctcacctattggcttaggctagttcctttcagattatttatcgaattattaaatcagattattcgctccatgtgtctgtaaatatatttttaaaaaacttaagtttggaaggtgcttgtacgagtagagtgtgtacgttagtattggttagaccaattattttaggttatttatcaaaatatttaatttattcatagaattaagtaactgatctgtttcaaactaagtcgagtagcttaattaactcgcagatcgtacgtgcgtcctccatatataagtccacaaaaatactgtgtcataaatgatatactgaaaaaagaacaaatgtgcacgaataaactttattcaaccgctgacttatttaagcgtagattgttcacattttgtacagagaaattaaagctgtaattattctttgcatatatatatacggagtatgtacaagaaggaaccgccatatatgcatccaaagaacatgttaatacaacactagagataacaataacttaatttagaataaaacaagttgtcatcattttgccttgtcttacaaagttgaccagcggtaatgcacgccctaattaattaaacatgttcatctcaagatggcaacgataaaaacggcgtaccaagaaaacctcaagcttctgtttttctccatttattgccctaattaaccaccaacctcataatcctagccatacaattcgctgctaaacctgtccttgaaaccactatgtatatccaccgcaaagccggccacggcgtcctctagtcgcaacaatggcgcgtcatcgtcccatgaccgccgtcttcttcgtcttcgtcgtcgcactactgtcgtcggcttctccggcgacagccaaggcgacaccggcggcgccgccatgcgtggcgccgccggcggcagtggcgttcctccgcgcgagctgcgccagcacgctgtaccggctgacctgctacgacgcgctcatcccctccgggtgcgcgttccagaccagcacggtgaagctcgcccgcgccgctgccgacgtcaacgcggcgagcctcaagaacctgacggcgcgggccaaggagctcgtggcccacggcgtccccggcgaggcccccgcgatcgccgccgagatccgcgactgcgcgagcgcgtcgtcgtcggcgtccggccacgccaaggagacggccgccgagctcgcgaggctcgacgccatgggggacgccgccaaggggagccaggcgaggtgggcggtgtccaacgcgaagacgtggctcagcgccgcgatgaccaacgaggccaactgcgccgacgcgctctcgtccacgggcgccgccgtgtcgccggccgcgagggagttgatcgccggtgtggtgatggccaagcagtacaccagcatcgccctctcgtttgtcaataccataccggtttcttgaggtgtaacttgcatcgtcttgtacctccgggttataacattcgttgtttcggacaaagacgtacatgaaacaacttttgaccactatttcttattataatatatatatctatctctatctctactacttaaaaaattcaaaaggtttctctgtctaaaataaaaaagagtaaactgcactcaactcacgatacacaaacttgcgtggtgggtgcaaatagatacaataacttgtaaattgtacattttagtataacaacttgtctagtccgtgcaaaccaggccaaaacagaccatgcattcaaaataatttgatgtggcgttgacacggatgccatgtcgctttccttcttggctcgtttcagttcatgtttgcgtcttcttcacaaattaaagttataaaatcataagcatatggaaattttgtttcgtgcattctattacactcacccatccctgacatagttcaatgcaacatggacctaaatcgctgactagctacaagtgctcagagatattggtgaagggtcgattggccattacactaccgttttaatacgtggcaattagtatgtgctattgctagtaacaacttgtatgagatgaagctggcatctacacttctgtcgttgatcagtctcatcaccagccactctagttgttccagtcttagaaactactactttggtattacaggatatgtgcttctttccactactgcaacccatcttcttgccattactacggtgtgcaactaattgtctcctcagccgcatagttccagtgccacatcatgttattttcaaatacactgactattttggccttaatttatatggactacacagttgttgtaccgaaatatgcagtttgcaagttgttctatctatttgcacccaccacacaagttcgtataccataaatgcaatttactcaataaaaaaagagcaaaaaaataagtccgaatgtatggtaaaaagcacggcaaaaaaagtccgaatatccgttttcatcatccgtgtgtatatcttctctatctctaatctaatctaatatatgactcttctctatctctaatcaaatctaactattttaaaaacaaaagtttccatcgtgcgctaaaaaacaaaacatacaccaaaaaataaaatcggtttacaaaaaacgcgtgagaaaaaacacatgagaaaacaatgtcagaaagcaaaaaaaagcgctagaaaaaaaggtttccattgtccgtaaaaatgtaaaaaaaatgtgtgagaaaaaatattcccatcatccgtaaaaaaacaaaaaaaaataacatgcgaagaaaaaagtcacgaaaggagccatttctaaaataaattgtttgaaaaaaccacgcaagaaaaagaaaacaccatttataaaaaaaaacaaaccgctctaaaaaaactgtgaaaaaaaacactaaattgatggacgcttggatcggataggatcatcgattttttttcatctcctacaaggcttttgtttcatcatctattcttttgtattggagaccctgcatgtctctataggcaattatcggactatttttgttaagtaaagctactattcttgataacatattatatggaaataatatgaaaaaaataaacatatatttaattgttatctagagaatagttcatagtgactctattttgtgtagacttgactatgcgaggtaatgtatgatttgattgattctattattggttgcaagaatgagattgaaagagtattttagataatatgcatgttgtcacatgaataattcaattattttaggtaaagcaagcatcggtaaggttgccatcgttaaggttgggtcattacattagatgttccagttttctgattgttctaaaacaatccatacaaacgttattattgccatggttatgcataaaaagcgtatattatcattagaattttttcactcgttgcaacgtatttttgttagtatataaatatatcaaccaaattatttgttaattaaatctccatatttttaagataaatattttaactattatctatatttaaagattttaaaggttgatataggcctgatttaaaacgacgagtattatctatcctccttggagatatggtttaatctttcagtttggtcatttataacgggggtgccagaaatactatcataccgggagggtggggtggcggcgctagaaccaaaatttcagaaattttgatccgaaattttgaaccctgcttgaagatagtacttgacatggcgttttctttcgttcggagacgtacggaggacagtaacgtgtgtctacacgggtagaaagtttaaacataattttcaattggaatttcaaagtatgaactaccctcgtcaatttcaaagacgatcgaccgaattacccctaactcaaatatcagatatttttaaccccgaactttctaaacaagacgaattaccccctaggactattttggacggcgtgacaatccaatcaacaaaaataataataataaattatagggcccacctttcgtttcctttctcctctctcccaactatctctctccctctagccagtatcatctctcccctccctctctccgcggatgggaatggtggcagtggccggctgaaagaggcggggcttggcatgagggagacggccggatgcaaggctgggaataggggcggcaaccggctataggaggtggggctcgacatgagggcggtgactagacgctgaccgcctcgccacctttctcccgtgtcatcgctgtcgaacggtgtcaacatgatagagggcccagatttgcttcgtggtgaggcacttcacctagcgatggcattggcatcctcgggcgtgagctgggcaaccacgccaatatgcacccacttccttcaccgtaggggatgagctcttgtcatcatcaccagaggagaagtctccccgactcgactgcgtcataaggagagggctagacccgattttcctgtctgctcaccttctttctccactggtagcaccgatctctccaatacacgaagagggacaacacctatgacggcaaagctacctcaagcgcaagtggaggtgggcgaagatcgcttgggcatccggcggcagtggtgggcgaagctcgcccgggcggccggtggctgaggcggagcttgcccaggcagccggcggcggatgtgcagcttgccccgccgccctcctggttgtcgatgtcgcttgatccatgcgccatcgccgcctgtcgcattgccatccgccaccaccgcagacccgtttcctccccggaaacactgccaccgcaacttttgttagccatctctgccccctagcgtgtgccattgttggccacaagacgcacgatggttgctgcctctatcgctgcccgcggctgtgctcgcacgggctcgagcacctcctaccactggccactgtgcggtaccatcggcctggtcctcatagcccggttcggtgagagagagagatggaggtgagggaagggagaagagagagagagatgatggggaattggggattaaggaaagagatagagagggtgagcatatggcatatggggctcaccaacatttttttaaaaaaattaattgccacgtagtaccaaaaaaccactggtttgagttaagggggttatttatcaggtttgcatggttaaggatataaaatgtgtggtatttgagtttaggggggctaattcgatcgacctcgatagtttatgggtaattcgtactttttccttttcaatttacagttacagagaacatatctcctaagaattgggagagtgtttatttgtctcatagacatcgataacttcgtctttcattattagaacaataagacgtatatctaacgactcacatggccattttatttctgtatgacagatgaaccatactactttgaactaaaataaaaggtgaagtgcatgagctgctcataaacttatcttggatgtcatgtagatttaaataaccttatcttggatgtcatgtagatttaaacgggctctaacctatttggtgcgctgacatagcatacattgatggcgcttacctattagtagacagaaataaaatcacatagaaaaacatcttttcttctcttaggtagacagaaaaaataaaaaagtagagaggtgaaaatatttttaaaattttacaaccccatcgtttacctggtaagagtaaaaagcgaaacaatctatttgcaaatgaaaactaattttgaatagaaattttatatatgtgttctaaatgatctaaaaacaaaggctgaagaataaactatgatgaaaaaagaattacaaaatcaactccaaatttaaagttaaaaattaaaattttggtcgatacggataagcataagcgaaaagatgaagccgttagtttttcctattgttggtatttgatactatcgcagaaaaatctgcaagtacacgaataccgttgtagcacttacccttacagtattctaaggtatcgaacatgagaaacgtgtgtgtactacctatgaacataattcaatcaaaggacaacaactgatgattgtttagttagagaggattcctatgtctttgaattagctacttaagttaaaagtaaaactttaccatatgctttaggcaccggccctccactggtctaccaggtcaagtctggtcttgagctctacgatgtgccgaacatagagggatacatgggacggataaggctatcaccacgtaccgcctacctcactttccgtggagtacacaacaacaaagataatttcaaacctaaacaccatgcctaagtcattaattactattctagcaatgcatatgaacttccttctttgtccagagtcctagtactactgcactcagttgcacactaagcgtcgtggcggttgcgccccgcggcgaggggcatggacaggcagagcgtgacgtcgttgggcaggagcaccatccttgaccaccgccgtcgccgctgcccacagccaccgtcgtcaccattgtctccacaccagccagatccttagggccctcactgaggagaagctgattagtggagaggagagggctcccgctggatggagagagagtggagaggagggggaggtggctagggaggggggagggagagaggaggggcagtggacggagagggagttgaggatggggcgaagaatgagagaagcccgataagagcgaagaaagaggagacaagaaggggggagggagaggggagcgaccggtggatgagtgaataaggtcgacgcgtgcacttggctaccctggcttggctcagtttggattttatgggtaccaattttttagaaaccggtacctattgtactgtagttgtcggttttaattaaccaatacatataaaatattataggagacgtttcttttataaaatcattacctacagcattggtgttggtttttactgtataaacagaacctatagtattcaaaggtacccgtttcaccccgtcaagatacgaaaaggtatataggtgctggttttaaataaactatcacctatgtgccgttacctattagagttttttagaagtgtatgcgtacttctccgcattagaggctgaccagttagtgggaacacgttgagttgctggacaacagtgtgagggcagatgatatacatctctctgggaaaggatcgcgagctgcggaatagtgattaattattggagcatctgattgttctatatgtacaattttgaagttaaccaaacacacaaagcacgttccaaatgtgtatttctaaattcgtgttcctcgaacattggagagcaattaatgttagtacttgcacgtaataaactaaacaatataatatattatattgcatcatatatacacgtgtgaagccgctaataacttaagtcaatgacttatactagattaaagtattttataattcaagcacgaatcggcaatatacgtactatacacataattaacttgaatcaaaagtgatctgggcagatcaagccgtgcaggggaaaaaaaaaaacagttggattacttacgcgtcatagattccgtgtatatacgtgaagccgtgtggagcaatagaggcacctctgctgacagcagtgtgagaagcacgtacgtggacggtggagagggcgacagagcagatctgatcatctgatggaaccgacactcggcaatttctgcaaactaccaaattacacccttcgtcgttctacgtatgtaatgtatgtaagatgtagttttgcggtaaatcgaagaagcttattaactttctgtgagtttacagaaaaataattaatatctataataaaaataaatagaataaaacacattataacataacaacctatcagtgccacctctatagtgtctaactgtctattggataaaacatagcgccactacatgtcctctcaaaccatgtgcgctctgcagacaagaactagcactgatggcaccaaaccagtgccaaattctagtgaacaatcgatacttattatggagggataatcggtattggtttgtgtaactagccagcactattatctcactcattagtgctactacattgttattataaccacactaataagtttttggttgtgaaattttaaaacagttgatcccccgagcatttt

SEQ ID NO: 58185 - DNA, 6254 bp, Oryza sativa
actttatcttcccaacccatatcttttgttttttttttgcggggaacccatatcttttgtttttgtagcgcccgttccgtcgtggcgcctagcgggaaaactatctcttaaaaaccctatttgcgaaatctgtttctttgcttgatgtctagtgtccgtgccatctcagatctcaaatccccgatctatcgttgagttcaatcccgaatcacaatccttcccgaaagtccctccgcaaaagtctatttcgcctcccccgggttggatgggccgaatctctctcggcccatcttcccctccctccccggctctctctctctctctccctccctcccgggctcactctccgctctgcccgcgcgccgtgcgcgcgtgcgcggcgccgagccgagccctccgactcggcccccgcgcgccgttgttcgcgtgcgcgcgcccgcgtagtcgccgcccgtgccgcgcctgcgccctctgcgtcacccggccccgctgccctgccgcgcctgccgccgcgcagccgctcggccccgcgagccagcacgcgtgcccgagccgcgccgctcaaatcgcccccgccgtcatcgccgtcgtcatcgcccggcccctgccactccacgcgctagcctccaagggacagaggcagagctcctcctccctctgccgcgtcgcccccgctcccctcctccttttcccaaagaggcaagggacaagccccctttctctccccccttttctccctttttccctctcgccggcgtcacctcctgtcgccgttttggccgctagccggagcgccagctcgttggcttgaccgtccaatgtcggttcctctctcccaaaccgacattgccgcccctataaacccaagctcctcctcctccaaatctccctcgttttcgtctctcgccgccactgtcgccctgttcgccatcgccgttcgtcgttgcgcgtgtcggaggagccggcacgagcaaggacgcggaaggggacttcggccgcgccctcttcctcctcttcctcggcccgaggccaaaacgatcacgtttcgcgctgtcggctctcgtcactgcgcccgcccgcacggtagtgcctccctccgttcttcctcctcgctccttctcctccccttagactcgggtagtagcacgagtagcctccccgtagctagccggcgccgccccgactgctgccatcgctcgtcgtgtgctcgccgctgtcgccgcccgagctcggaagcgccgctcgtcgccggcctcgctcggcacagctccgcccaatccaacgctagcatcggattcccgtagccgcgtagatgctctcgccgccgggaatcggcccctcgtgacctcgtcgccgtttcccccttcttccgccgccggttgccgccgccgcaattcgccgccgtcaagctccctccggcgaatccgagccgttggctcttctcccctcgtctcgtgcaaccacccggtgtgctcgctttcgcctgtatcgccgtggttcgctccgccgctcgccgctgtcgtccgccgtccgttccggccggcgtcgtcgtctacctcccgccggcccgcgtggcagccacgtaggcgccacgtcggcgccagctcggccaagaccgggtcgagccgaccccggtcagccgctccctccggccccgctcgcaggcgcggtccaccgcgagccgtgaggctgcgcgtgggcccgccgcatccgcgtcctccgcgaaccgcgcgcgtgcaccgcgtcccttccccaaaccctagcgcacgccgcatactccctccgcacggtgagccgagccgctgacaagcgggtcccacccgggaccacgcgaggtgagcccggtccaccgtctccctctctcctcccttcctgcgcgcgctctcggccgccttttgggccggccggcccattaagctcggccgagccgccccttttctctcgggccgcgccctagccgcccgagggaagtctaatttccctccctcttttcttttcttttcttttctttttccaaaaggatttaattaaatccttttcctttagaccaaaaattcaataatcttagaaattcaatatcttcccaaccgtaagtccgtttgactccgttcaacttccaaaattcctcaaatctcgagatctatctaatggcacgcttagaggtcattaatagggctttatttttgccatttgttgagttgtcccgttttgcgtatagtttcggagcccgaagacccgcagtgcgaggatttcgtggatcaagctctagatctcgagcaaggcaagccacctttgaacatcttgagcctatatttgaatttaattatgtttcttgaaaaatattatgcattgataggatcgcacttaatctgtttgtcccgtctgcaaggcagattggcggacctacctaatttgttgcatttgatccttcctttgttaatttttatatcatgtccccttgtaaccatctagttacgcctcgatattcgtgcaccctgtgcgagtatcgacggtcgccttcaaacttaaaatctgaaaaacttcttgggtaaaacttgggttttacaaaaggcttggaaaacacgacacctgggtcggtgcttgcgaactaaatgaatttccaaaaccacggaccggggaacataccgggtgtacggtttcccgctctcgcacttaaggaccgtttccttggaatttcatccgaacataagacaagtatgaccacatgggtggaatgggacacccctggctaagtaactaacttatcaggggagccttgatgccgagagacatgtggattcgccggggtggtatcggggaggacccctgggcatcctggcacagtatggtctgggacctaacctgttgttggtctgggacccctctcgtcggcatatggtaaacctgtgtcggctttagaaatgccttgtcatgaaagcttggaggtctaccgacgtggctgatccccacaggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcagctaggcccgggtggccgtttgaaagttgttggccgggtgccaatcttgatcaattttaaagactgatacattgcacatactccgaccggacgagacgcactgtctcatccgtgtcgtttgagaagcactcacttagttgttttcagaaaagagttcaaataaaatcaattgcaaaaacaacagccctttctttgaagcctgcattaaacacttatttcccatggcttgctgagtactcccgtactcacccttgctctatataaataatcccccctcccccagttgctgaagaagatgaagtggatcccgctgacgaggagttcttccaggagcaagccggctacgatgagttttagggtttcggcctagttcccaggtcgcgcctgtattgtttggtccaagtcttggcttccgcttcccttttgtaatgcagttgtgagctcgggatctgtccgcagcccgacttgattgtactcctactctataataaagagacctttgttgctgtgataatctgtcttcctgtgataccagcactgtttcctgggactggtatcgattaacaggttaatttggagcgtcacgggctagttccggtcgggactagttcggggcgtgacagttttcctcgtgcacgcttttcaaactactaaacggtacgttttttgcaaaaaaaaaagttctagatgaaagttgctttaaaaaaaatcatattgatccatttttcaaaagaaaaaaaaagccaatatttaattgatcatgtgttaaaagatcactccgtttgtgtgcaggagggatgggttcccatcctgcaccgtcgaacacagccttagtgctgggtctcggctactcgtatgaaactaagtggaagggaatggagaagaagttggatggtttgattcatatccatgtataagttgatattaagatatttccaacgtaatgttttttcagtattggattttaaataattgaaatcatatatataaaagttgtgcatgtaaaataatttttattccctaataaaccgttttggattaatatgggcaaccaaaccgttgttgtgcatcgtcttgcatagagaaaaaggcgtttcccgggctgaaaagcgtatatcacgaagacgtattcatcttccgtagagaagagaaccccaccacgtttgacattccatcgctttccccaccccatggatggagtaccacaccagatccgatcagatcagatcagcagatcaccaagtctccttcacactcccactccagcggcagctgagcagagagctccaccgccgccggccaccatgagttctcaccaccgctacgcccacctcctcgacgaccccttcttccccttcccaccgccgtcctcctcctcctgccccttcctctccccacccgccgcttcctccacctgcccattcttcgccctcgactcccccttcgctgctgaccctttccatctccaccccttcctccccacgccgcccactagctccctcctcgaccccttcctcctccacaccctcaccgaccgcgtctcccaactcgagctcgccctcgccgcccgcgccccacaccccaggcccaccagcaggaagtgcacctatgtcaccgagtccaccggccgcaaggtcaagtggaccaccgaggacaagcctcgcgccggcgagagggtgctcaagtgggaggctgagctcgactccccctacgacgatggattcgaccgcaagtggaagtgggaggccaaggccaagaccgcctccgctgctgccaccaagctcaagtgggccacccacctcaagggcaagggttgcctcgagccatggtcacactcctacacctgggaggaggacttctctgccaccgacgacgacgacgacgaggagatcgaggaccaactccatcacaaggccctgcaggatcacagcaagctcaaaaccaaggccaaggacgacaagaagaaaaagaagaaggacaacaacaccgtggtggtcaacaaggagcagaagaaatgccccttctccgtcaagatcgaggagatcccacctgaggaggacaacaccgctggatgcgtcgccattagaaaggtgaccactttctcaaaccccatcttttacattacatgtagtcaccatttcgctcgctgaagatcacacttttatgtgattatttccagaaaaaaagattgtatctgtcataatagaggggtttggtttttacagagatactactagtgtctgcaaattagatgtgcatcggtgctcttgctgtgggcataatatggaaatatttgttagttagagaacaaccaaccgattgattcctcttgtttcaaatgtacatttatgctgacaatcctgcattttcctcccctcattcgatcaaaggcttttgcattgggcaatggcaaggcaaagaagaaggaactgtccccacaggatgcggcattgctgatccagttgaactacagggctcacctggcacaccgttcacaggtgcttcgctgcctgcgtgatctggctgtggctaaggccaagctcaaggagatcaggtccctcttctataacatctcttacaggcatcgcatggcacatgaccatgaagagcgccaaaggttcactgagaaaatcatcgtgctgctgctcactgtagatgcgcttgaggtgagcgtcggccttctatttgtttgccgtcactgtttctgttgcattatcaatctgcaacctctatggttggtccaagggcgattaatcctttagggatctctgcataggtttccaatgctgctttatcacctcaagttactgattagtcctaatattaggggaatcaaagcatgacctaaatattgcagctgctgtgcatctctttcttatacatatggttgtgaaacactagttgaatattaaccaaattaatatgcatttccctttaacgcacaaggagatgaagggtgagcatttatacctagtaggtaataaaatgtctgcacatctcatcagattcagatgtatagctaattaaatctacttgtttcttctttatatgttgctcattttcagttcttgcacatagca

SEQ ID NO: 58186 - DNA, 1735 bp, Oryza sativa
ttacatcggataaatgagatgagtgtcggtttcatcaattctaatactttgcaatagcgagagtaatatgctagatcatgcctctagttgttttattttctcgcatgaatagatgtatttgtccggcctttgcgccgactcttctcttgttatatcgccgaccacaaagtttggcaccacgcgcccgaacgcgcttaccgtgcacacaagaaggtgcacatacataatccgttgaattgaacgatggagtgctatcccaaacgacgtcaccccatactcggtaacacacgacaccacccagaagttgtcgtctatctagctaatatagtcgttgatctatgaatatattaacacacttgtcatcaccgatcttatggatcagcgcgcttgggacactgttgattgtgacttgtatgttaatccgtcatattgctatctgtatgaagtagatggtaacaaatccgagtcatcggcacctgcatgcgccgccgctgccgcctgcacgtagcgacaccttgacgccaccgcatgacgtcttcccctttgtcaatgggtgccgaatcaatccagagactttccctcgtcaatccgccatctgaaacgccgactcgacggcctttcgagaccatctgcaacgcaattgacgggcttcgcccgtagcgacgccgaggagcttacgcccgcctcccctcgccgccagtatgcacggcatgcctcccgcactaccgcacgcggccgggacgagggtcgaagccgccgtgagcgcccgtcgccgatagccgtccgccataccagcctgtatgccgagccgagtttcgtcgacacgtaacatgaagctatgattgtcggatgccggtcacggcttgatgccaacgaatgccggtgtcggtgctactagatgttgcaccgccgttccgcctctgagcatggcaacttgctatagtcgtccatctctactaagggctcactagcacgtttgccattggttccatccgtcgtctccattgaagaatggcaattggatcatacctcacccacttcttgtgggagaaggtcgtaatagcccattgggcaacatatgagatgggctggccaggttttcaagctagccagtataaggaggtgggccaagtagaaattggcctattaaaaggagtcgggcacaaaccgtgattttggtccgaaaatggcattttatttgaaaagtccttggtttccaaggcattatgcggaactcagaaattatgcggaaaagtcctatgggacattagaaactacggggaatatacattcgccatttatactttgaaccttcatgagttgggtttacgccaaatagagaagaattaaggatttataccttagtcccgtatttctaagtatttgctttaactatttagttagtttcttgaataatcatagtcaatcctagaaacattgtttttaggcaaaagagcttctatgaacttgtgaaacctttgttttagcaccccttttggaagcatcatattttatggtttatttcctggtaattgtttatttggggtaattgattgttctgtgggttagtagttctgtaaattacacatacctttgaatagcagaaaatcatgttaattgctaggattgtaataaaaggtgtgtatagaaatttactattttgtactcgttttgtgcacttcatttactagaagtaaaccggtagaaagttgcataaaaggacatcatgtaagta

SEQ ID NO: 58187 - DNA, 3847 bp, Oryza sativa
taacaaacggagaaagacatgcattgttagcccatcgtaatgaagggttcagaattagacatcacacaagatcagtctcattagaagactcttctgcaagtgcagaactatccaatggtattgactccactaatcagccaaaattagtgtaacaaataacagtgagaatccaatcttaaaaatttggttcatgttatatattcggtaacaatgttttttaaatagacaatctatgtttaatataacaaggtaccaatgatgtacatcctccatcacaatcattcatcaatacaggcacagcatgcgcgccatgtttatgtatagtcacctatttcaatacaggtgatggtgaagtcatttttgaggttgatactgatgttgatagtatgtttcatgttgtgcaatttctcgtgtaagtgagatgtgattctaatttctacttcctctgttgtaaaatataataacttttatctatgtatctgcacaaagatatgttgaggtacttaacagattagtatgactactggacgtaagatatatttttgttttgcactgagaccacacagttcgaaacacactgtgaaactatgaacatcaccttgtcccttagactttacttattacactctcttctaagtttatggtgtattgttcttgatccactgaaacattggctcttcattttgtacagtttgttaaatcctatgagactaattgaaaatcatattggctggggcaatgcccagagttttggctagctaacctcccacatatataaattaaagagattaacattaaagacaagaagactataattccacttaattatttaaataagaggcatgtgtatgggtgtgtaaagacggttgggttaggtaagactgggtgagaaataaatgacaagtggatatatagctaggaaaaataatactcttgagccctctaatatcttggaacattttttttaaacatggtacagacgcatacgcgtacatggacaccctacccttataataagcatctttggaaggctgagctagcacgtctggagattgatgaagttactactaacgactcgctgttgacggaacatcgttcatcgctgaaagaataattagccgtaaatacgagaacatgtgtctagtctaggccttgaatctgggtgagctagtttcatgatttcatcacaaagaacctaaccagttcagctacactcatttcacttggaacaaattttgaatgtcacgatttgggacggaggggagtaaatattcagtggttacaaaatttagatatttattataacaattaatttgagttggaatattgaaaaagggttgtcaatttcttagtttactttttttttcttatatctattaatcatttcctcagcaaaacaagtagaatatttgttaatttttttaacttatactacacaacgaatatggaccgttcttgcttcttttatatatgcatttgagtgaagtcatgacaatttaactactccatctgtttctgaatatttgacgccgttgactttttaaaatatgtttgaccgtttatcttatttaaaaaatttaagtaattattaatttttttcctatcatttgatttattgttaaatatacttatatgtatacatatagttttacatatttcacaaaagtttttgaataagacgaacggtcaaacatgtgctaaaaagtaaacggtgtcatatttagaaagggagggagtataatatttttatgtgcatttctgttcagtaaactgcatttgtacgctttgtaattataaacttcaaattatgtctagtcgcaccgatatatacaacttctgtttaaaaacttctgaacgaacattaccaggagatcagccagaaaatgaagaatgttgtcatcaccaagtcctcgccggagctcgtcggcctgtcgaccaagccggcgccgccgccgcccggtgacatcagcctctcctccttcgacgaggctcttgctttcgccgccttcacgtcattccacatcttcaccaatggcatcgttgagccggccatggcgatcaagagggcactgtcccaagctctggtctactactaccccatcgccggccgagctaatttcgccgccggcgaacggaggctccgcatctcctgcaccggcgagggcgtgggcttcgtcgccgccacggccagctgcgctctcgacgacgtcaagctgttcgacccgccgttcgcggcggtgttgaaggagctcgccgtggactatccggcggagggatgcggcgaggatgatccgctgctgctcatgcaggtgacggagttcgcctgcggcgggttcgtcgtcggcgtgacgtggaaccacgtcgtcgccgacggcttggggatcgcccagttcctgcaggccgtcggcgacctcgcgcgcgggctgccccggccgtcggtgttcccggtgagctgcggcgatggcttcctcccggcgctgccgccgctggtcgccgccatcgagaagacgatgctgagcctggagaccaagcggttcgcgtacctcgacatcaccatcccgtcgaccatgatcgaacgcgtcaaggcggagtacgccgccgccgccggcaacgtggactccggcgagccgtgcaccgtgttcgaggcggtcaccgccgcgctgtggcggagccgcacgcgcgcggtcatctcctccgacgaccccgacgcgcccgcgccgctcgtcttcgcggccaacgcgcgcaagcacgtcggcgccaaggagggctactacggcaactgcgtcacctcgcaggtgcccgtgccgacgagcgacgaggtggcgaacggcgacctcaagcacgtcgtcaggctgatccggcgagccaaggaggagataccgttgcagttcaagaacgccggcggcggtggcatgaacgggaaacgcgtcaagcagctggccggcgtgctgttcgggtacagcgcgttctacgtggcgagctggcggaacatcgggttcgaggcgccggacttcggcggcgggcgggcggcgcgggtgatgtgccacttcgagccgacgggcgtgccgagctgcgtggcgtgcctgccgcgcgacggcggcggcgccagcgttctgtcgctctgcgtcagggacgagcacgtcgacgcgttcctcgcagaattggcaactctcggctgaatatttgggaaagttttctaaactctatatttttcccgtctcttactacgtgtgtattatattatatatctaaatagttattaaaaagttttaaaatattgagcaatatatatataatctgtcacgctcattgtcacgctcatttcataagttatcgatatctataagttataaccaatgttctaaaagatatttataattactactagctccatccgtccaaaaatataataacttagtatattagaacgaaaggactagaaaataatgtccgtgcactgcatcggccagtattaggtaattaaagattaacatctgttaggtccacctgccaggcaacttgtttagaatagcttatttcttatatgccactacaacttcaactaaagtttttttaaaaaatatatatataaaaactttcccgtgtactaaaatgggtccatccacataacgtatattgcctacatatattcactcgtccccattttaattttttttttgcgcggatcgccccattttaatgaatgaatcatatactgtaatcttgacgccgtgaatgcaatcaaaaaaggaagacaagattcgtgaaataagccaaccgcatattctaaacgagaagaatttgtgaatacaacctttaattccctgttctagcgatctaaaagcaa

SEQ ID NO: 58188 - DNA, 645 bp, Oryza sativa
attcttcacatgcccttcacacgaggtaaatcgattgaggttaattttttattgtgggggtattactgtttttgggggtaaatcttctgaaatctttgcttgttctaaaatgtacagaagggtggaagtggttgcgatttttggtattgggaggaagggtatattaaatacctgaataggaaaggcttgattgagcaaaacacttgtgcaaagttgctgaatgaagcaaaccagagggaaatgcagaggggaactgaagaaatcaagctggatgcagatgtgaagaagaagagcacggttcaagagattagaaaagatgcagatgttgaagaatttaagcaggctgatcatatgttgctcattttgagggagatgatggtgatgatgaagctcatgctagttggtggtgtgtgttcagttggtttgatagtgtgttgtttccttgttctatggtttaagtgatgtgtgcccattgtatcagtgaattttgggttgtattcaggctaaaccatactgtgttggtttgcaatgtgcaatgagatgtgaaacttttgaaatggtaatgtcaggtttgcagtctttagtacatttgtcatctgaattgattatggagatgcaaacaaaatgaaaatatttacagactga

SEQ ID NO: 58189 - DNA, 1504 bp, Oryza sativa
tgctacgtcagttgttaggactagtctttgcatttgttggccatgtggtccataacctgctaaatgtccagtcagatctactcagaattgcaattgattttggtagagtagagactaacatgcatcccatagtgcaaaagaaaccagacctagaattttcaatgtgaaaggtggttccttctccatatattaagtgtattcattcagataaatgttagaagaaggttttcttgtcactgcaaatctgcatcaaattctttagggagtcatcactcaacactagaaacattccatatcacaatagattttgtccttttgtactcagctgcataaatgaaggactatttgcagtttatcttcgagcggcttgtattgcagcttcaatttgcgagacgactgttgcaagattttcgatatacttgtggtcactcagctttgatttgtccattttggctctccctctctgatctttcattttcaggatagcactatgtatggctacacgattgagacgacatgccatccttttcctgccctgggactagtagtaatcttttcaacacaaagcaacaggcaaatctcctctgcctcccattggtttgtatgtattgtaggctcacagccaagcagttccttgtcccattgtctttcctcgtgtacaccttgtacacatgtataattatttcttatgggtgtgttattatatgtcttgtgtttaggccttaatcatttggtgtcacatggactttgcctctcatcacatgtagaccacacttttttttttaatttcacttgtcccctccacactctatcaggtagtaatacatctcatctccattagatgaactttcattttatcttttggcccctcatggaactagtgttagttgagcttgaaccacataatacagttgaaatgcatgcacttgtgtcttgtctcttcttgtacagtggtgaccacaagttagctatatatgttctgataaatcccaacatgttctccaatgtgaaaagtctgcaagagtttatatccccaactgcaattgatcaatgaatatatagctcaattagagaggaggggggaaagaaacatgacataccgtatttttgtttgaacctttgctgaaagatggagatatgatctgataaggactaatgcctgccatttcttgattgaagattatgacctccaaagtagctattaggaccacacaggacactttcatgggatgccaaaatttgtggactcaaagtaaagttgtaatcagctaaacatctataagcattgctcaagtgtgaatgatcagtttaggaccatactgacatggtgagctgaatatccaggttagaaactgtttctaaaataaaagagaagcatcttcattgcttctgaactctggtgccttgcatgtgaattaacctcaggataaaaggggccttgggatggatatatggctgctttactttacagatttctcttgctgcccaggaaaggtattttgca

SEQ ID NO: 58190 - DNA, 205334 bp, Oryza sativa
ttcctgcggcccccattatagacacacttgcttctctctatgcaatactagtgatttaaaaagtttgatttttttttctttgtgctccttatacaaggcgaatcatatcttaagatctcatgtgtgcatatatggaaaacacgcagtacaagtagatatagctacaaatggagtactatagtagtagtcactaataagtaatagtactactttgatggtgatatcccattcccaccactgttttttggtttgcaaaagcaaaacctgaagaaaagatcaaagcttaaaagcaaccagtggaagctaaacgtagggaaaagggcagtgtcccggggttcgcaatgcaagttgccaccaatcaagggtctgtttagtcccgataaaatttttcgcgctatcacatcaaatctttggacacatgtatgaagtattaaatgtagacagaaagaaaaccaattacacagagtaatttcgccatgatttgacaatgtgatgctacagtaaatattcgctaatgatggataaattaggcttaataaattcgtctcgcggttttctagtggaatctataatttgttttgttattagactacgtttaatacttcaaatatgtatctatatatccgatgtgacatgcaatggcaagaattttttttccaactaaacaggccccaaatggaagcaaggaatcctcttaaaaaaagaaggaaaaaaaaagggaagcaaggccggaatggctacagctacaacccggcacaccgtatacgtacagcacgtcgtcataggctgcaggccggcatccatgacgcaccgtggtcactggtcacgtgtggtcagggccccaagcagcagccggtcggctcgcgggttttctcaccgatttggcggaggcagggaggcatgtgctttgcttgtagcggcagagggcacctgcatgcagcctgctggctggagactgcagtagagtgtttgtggtagccagtgagccggcgttgtacggatagccagccataactctaccgcggcagacactgtagtactaagttgttactaccaggccaaactactgcctgctgctccttcaactcttgaccggttgggagtatgacgattatgatgaatagcctgcgcaggtttggacaatcggacagctggaccattcggatcagggtttagcttttcgtttgaatgtaaaaaccacttctcaccggtttattggaaactgaaaaaacattaaccattttatatctatatcgtacgaaaaacacaaccaaaaccgttcagtttccacaaactgaccattgacagtttcatcaaaatcaagttgttttcacgaaaaccgttcaattttattaatccttattcggattatcaatgagagaaagcaagcaataagggtactatagtaacatgcgagagagctaagcagagtgaccaccaaacaagcacatgaggtccttgggagcataggtgcaaggcgaagacaaaatcaacaaaatgcatgtattttgtttggtttacataatcaacatattttgtacaaatatcatcttagggaatttaccatgcaaaatggtgtgacctcggggggaaaaagtgtgtcacgtgcgctaaagccattatcgaggacacacccattacataaccgcggccaacacactgctcatatatatgaagcaactttatagagcagtggatttcaattgatgggaccggatgtgacttgtattggcttgtgtcaacttgcattggtttgatatttcgatcatctcccttccttaaaggccttattaattagggtgtttatttgttccaaaagaactcaggagacaagttagggtatagttccgagtagttttggtcggtagggctaggtcttccattcttatcaagaactcatttatctactccggactacatctttatttcagagttttgttttcgtgtaggagttgatatatgatgttttacacttagatacttatttagtcctaaaaaaactcaacttaggtggggatgtgaccccttattgtattaggatgtgtcacatccaacctaaaaccttatatttaggggaatgagatcagagagctacattgccatgattttggaggtatttttaactgtccgatccacaatgtacgaacgagatcgatcggtacaataaatcggtggacagtacctcgtgcagtcaaatccactgtttttcactattgctgccgtaataaaccgcacgttcttgttttgtactgtagcataagactcaaattactgtgcttccctgactttaaatgctaaagtcagaggagtcggttccatatatatttaggggaagagggagtatgcactaggcagattttaaattgtggatttgatgttggtgtcaactgacttttagggctcgatcttgtcgaatttaattagttgacaaatgctcatacataggtaacttgaatggttgtgctatacactgaattatctgtgttacactaatctgaggtatatatgtgaattgttggacgcaagtgcacgtctttgtattctggaaagcaatagtcgtgcatataaagtgcacacgggtgctttaatttgactatatcatatggaatggaagagcatatatgctagctactcctatacgagtacaagtactagtagtaattaatcaacatgacagtatttatttatcgacccactgggtctatggacttttttgcccttcaccgacgacgacatgaaagaaaccaacataacactattagtttttggctcgttgcctctctttgttgtggacgcgatgccgccacgaggccccggggagctttctactggtacgttctgtagcttcgtacgtccatccgggaccacgatcactggccgcttgatatctgcaacctacaggctacattctgtatgctcgactaattaataatcatcattaacaaacctgtcacttagactaatataatcatcgttaacgaacctgtcgagtaagctgtgtgacgagttgacaggccggatttgttggaattatgtgtgcgctataagcccatatggatatggataataatctcatgaaaatcagagaaacccatctcatagaatacatgcatatcaacttcagtaccacttactattctaggaaagtgagaccacttaaaaagaagggttaattagacacatgccattactaatttgaaggtttggaaaaatgccattactatttgacaaattgtaaagatgccattacaaatcgcacgatactggaaacatgccacgttctacgcctgatccgcgattgtactcgtttttatgcgtaccgtatttacgtatggaccataatgcccttatgtatgagtatgtagggaccgagtggaatcagtttgaccaagtgcattcacagtgaaccgtaaacctaacactaggcttctccggcggcggcgggatttggaggcggcgttggcgatggcatcgggctttggcggcgtcggtggcggtggcggcagcgtcggcggcagcggcgggctttggcggcaatggcggggagaggcagcccgattcattcgacgggcttgagcggttgcagctttcagcgcacacgggccgcagcgtcgtcggcaccatggttgagatgtgcttgcggcaaagccgctgtagtgaacaaatccaacaccccgaggaatccaaggcggcggtggattcagtgcgggaaagaggtaaaccccattgtttttcattttcttttgttgaaattcctttcttttttgtttcgttttcttgattgatgccattgatttgagatgtgttgtgcagccaaagtgttgctcgttgtggatatgggaggatctgttgaacgaatatgtggaggaaatggttgcttattcccatgctggcgaggacgatggtctaagagacatgttgcgacagcttgcagaagagcataaggaagagaggtcgaggatgcagggtttggttgaggcaaaccataggcagatgcaatccatatatcagcagctgaatgattctaagaaaaagtgtgagcagctaaagaagatgttgaaagaagagaagtgtagtcgtagtagacaactttatgtgatgttgttcttgttggccataattatgtatttctatgtatgttctgtaaattttgtggccatatttggtgcaagtaggtaaatcagtgccattctgtgtaatgttaatcactgtctatgaattatgtggattcaatttctgagtaatgacataggtgtgttaattatgtggatttaatttcccactctgggtgctctgttaaggataagtctggcagctcaaggtacaagctgatattgtgtgtttgcagcaagagctaactgctgactcctacactaaagctatgctaatatatgttcacttggtgtaaaaaaaaggaaggtataggacatcgaaatatcttttggtgtgaagtatataaagaactgaaagttctgtgtttttatttcctctttgaaaagactgcccatcattgagacagatgaaaaagaagtacaggaaaatgagttcacaggaaatttgtgcattcagatggtattagttgagatgatcagcaacaaatatttcggcaacaaatatttcacatggtataagttgagatgatcagcaacaaatatttcacatggcatgtgttcagatgatcagcaatatttcacaatatggactgcatgttcacaagtttggactaatttcagcacactgcatgttcacatgttgcacacagtgcatatcacagtgccaggcaacataggcctcaaaatacaggttcaagacagtggcaggtaacatgaaggcctcaaaatacaatatagagtgcatatcactacagcaagtcaggaaggcatcaaaatacaatatatagtgcatatcacagtggcatgtcagcaaggcctcaaaacacacaagcttcaggattgtagatattgtgacaggcttctaacaactttagctgggccttctgaggcagctcgagcatccttcttcttctggggtgtcttctttttcttaggcgtcttctttttcttgggtgtcttcttcttcttagcaggccttgatgaactttcatcttgagttttcttcctgcaaacagtgatatggatatgttagttagcaaatgcaacatatgtaaaagaattcaaaataaatagtcaaccatgcagcatattacctcttcttgggggaagcagtaggcacttcatcagtgtcttctggtgcttcagcctctttgcaagtcttggcaaagtgcccaaaaccatggcatctcctgcatcgcactcttcttgcccctggttcaagtgcacccctgatcctagtgactctaggcctccctgcacccctcttgagtctaggtggacagactttgaagcctaaattcaccacaggccattgtgatctgtctggcatagttggcactctccctgcataagctgctctgaacatgccaacagaaaagtactctaaaacaaaatctttaatctcaactcctctgttggaacatatccatgccaaggcatggttgcaaggttttcctgaaacctgccactttctgcatgaacatgtttggttgatcaaatgcacagtgtgccttctggtattgttgtcactctcaaccaatgtgatctcagccatgtcatcatcactcctagcaacctttacaactttcaggttggttgttgctgcattgagctgtttaatcacactgggcaggattccatcagtcaacttctcaccaacttgtctcctcaaatacatcttctccatgaataactctctaagagaatcaactagctcatggagatgtagacccttcagagatttaatctgattattgaaactttcagatgcattgttggtcaagtaatcacagttgcaagtttccttgaaaccagacctataccatatccttgaatgatgtttgtctaggtaatcaatggcttcaggacagaaattataaatctgctgcatatgatctctaaaaccatcctctgtgaagcatcttgcagcaggatacaagtgtagtgtgaaaataggacccctaaacttcttcataaaattaccataaaggtgtctcatgcactccctatgttcagctttctcaaatgcagcacctacagctttctctagccctttgcatgcatctgttgatatgactaacctttcaggagcacctatagctccatgcaactgtttcataaaccacaaccagttgtcatctgtctctgagtcaaaaattgcaaatgcaacataaaacaaccaattgtgtccatcaacagatgtggctgaggctagctgaccagtgtatttaccagttagtctagttgaatctacacctatatatggcctacaaccattaacaaatccatctacacatgttttgaaagcaacaaacatccttttgaaacacatatttttccctaacttctgcaaatcaattgtaacaattgtacctagagacctcttctcaatctctgccttccagttgaacaacagctgaaaactatcttcataagtgccatgaatctggttctcagcaagcctccttcctacccaagcctttgaatacttcagcttgatctcatatcgctcttcaagtttctcttttgctgccttagctcacttgtcagggtttttctttaaccaatccttcagtctatctgcaatccagtcttgagtggccatcttcccttccatgagcttggttgtgggacactcatgtgcaaatggtagcttctttatctgcacacacattttaaatagtgctataagtcacaactttcaagcaaaatggatacaaatgtgcaaattgacatacaaacctgaatagttttgccatcagacaaccttgatgcatgaatgcgccatttacacccctcatgcttgcagtgggcaatgagtcttgttggatctgtttgcaaattagagagttcaaatcctgtaacaaccgcaaagtgcctaatagcttttctgaatgttatcatgtcaggaaaaacagcttcctccttaatcattggcatctcagggttatgaagaacattaaactctgctgggtcatcatcagtgacctcaacctcaccatgaggttgagcagtcccagaaggtccaccaggttcagcattttcagcacatggttcagcattttcagcactaggttgaccagaggtttcagcatgatctgtaggtggaatggtgtgaataggttgaatataaattccctcatcatcaacacccacatactcctcctccatgtcaaacacattaggcaatgtttcatccgcttcttgagttgcaggttcacttgaaactgccactttagatgcagatgctccctgccctgtctgagtaagtggaagaacacacaatggcattgatgttggctctatgttattagcactagcatcgcagagtacactctcaacaactaagaccattaattcagcatgcatttctgacttgtacatttcaaacatgtcaaccagttgagattcatggacaattctaacgtcctcattactgcccttgtccaaaaaccacacggttgcagtctgctgctcaccccatctaacctctgagcttaagcttagcatcaacaaatccaaagagaagctaccatactcaacatcccatttcagcacacaacccttagtatacctccgtctaccatccgaatctatggtggtaaaaccatgaacctttaactctatcgagaacaacagtgtattgacattggaatgaaatcaagtcaaccacacatggaatgcacagaaaaaaaaacctacacatccagctcacagcacatcgaatcgaaggaatcgactaccttaccttgatttgggctccatcccttgcagtacgtttcctacccctccatggaaagaaagagtcgtcgccgctgacgccgtagacgccgtcgccgccgccgccgaatacgccgctgctgccaccgtagacgccgtcgtcaccgccgccgaagatgccgccgcagccgtcgtagcccgcgccgtcgccaccaccgccgccgccgccgtagacgttgtcgttgccgcggccgccgtagatgacgtcgccgccgtcgtcgctactcctgctagggttaggtctaagagaacgagaaaggggataaaatgtgtgctactcctgctgacccgactccagtcggtatagccggtcaaacgggggcattttggtcattaagaacaaattttagtcacacgtggtcaacaatcgctgatcaggcgtagaacatggcatgtttccagtatcgtgcgatttgtaatggcatctttacaatttgtcaaatagtaatggtatttttccaaaccttcaaattagtaatggcatgtgtctaattaacccaaagaagaacgatatcttcttgggagtggattctaatccctcgaggggatatccccttatatacctttttcttctaaattcgatgcaaatagttgtgaaaaattctaaaaaaaaattgacaatgtagagtataatgattcctactagtccaccaaaattcatgttcaaattcgatctacacatcgagaaacaaaaaagacaaatttagatataaacagtacgctactattcatatgctgaatttgtcttttttatatcttgacgtgtgagttgagtttggacttaagattttgtgaagttgtatatatgtgttgtatgaatgttgtcaaatttttccagaatttttcatgaccgtttagatggtttttgagcaaacgaggaaacatcccctcgagaaattagaatagtttccctatcttccttgctatatacctactcagtacaacaaagagagtaattcatatgagccctacctgagtaaattagtttttttagtcaaaaagatgtgccatgccctatactaggtttattttttatgggacagagggagtaaagttttagcctttgacacatgtgttaagtagttgccttcttaatgtgggtaagatataggtctgaactagttagggcccctttgaatcgaagggtagaaaaaaacggaggaataggaaaaacacaggattctgacaggaattgaagtgtaaaacagaggattgcaaaacacaggaaaaacacaggaatggtcgtttgattggagcacaagaaaacgcaggaatcggatgagagagatagactcaaagaaattttccaagaggttggagctcttgctaaatttcctccaaaatccacatgcaatatgccattccataggaatttcatagtatttggaaaacttcaatcctttgaatcaaaaggctaaataggaaattttcctataggatttgaatcctatgaaatttctacataaatcctttgattcaaaggggaccttagagttgtaacaaaccaatgggtagtgcggatagtgtgggcagtaaaatgataaaagtcacatttaaaatgataattgtggatagctcttttcacttgtcttaaaataagtttacttttagaataatcgttgcgctagagtttgtgaaagtagaaaatatttatattgaaaggataaagaaattgagaaatagttgcatttgaatttgatgacgtagatgtattctagtccttttgttttgtattgggatgtgcgattagtgaaaaataaatttatttcaagagggaggaagtaagggcccctttgaatcgcaatattgagaaaacataggaataggaaaaacgcaggattttgatatgaatgtaagtgtaaaacacagtaacaacttacaaatgatcgtttgattggaccgcaggaaaaacacaggaatagaggagagataacgattcaaaggaaagtttccacgaggtagaatctcatgttagatttcctccaaaacttgcatggtattaggcattacgtaagaatttcgtaggattccataggattcattcttttaattcaaaggtctatataggaagaattcctataggaacaaaatcctctaaggtccctttgatttgtaggaaaagtgtaggaaatttgaagggtttcaatcctatggaattttttttatgaaagtctttgaaacaaaggattgaatcctatacaatcctttaaaattcctatgaaatggacaatcctatatagattttggagaaaaattagcaagaggtctaacctcttggaaaaattcctttgagtctatttctctcatttgattctcgtgtttttcctgtggtctaatcaaacggtcattcctgtgtttttttctgtattttctattactctattttacacttgcattcttgtcagaatcctgcgttttttctatttctctatttttccattcttgcgattcgaaggtgctctaaaattcttataaattttctttgaatcaactgcggtctaaaggtggagcatactcctagactcctcctagctggtctcgtaggttttgatagctgtgtggaagagccaaaggggagagcactttaagtgaatggtccaataacagtgacagtccttggagcgtgggagtactccagaaaccggggcaggtggtgcgtttaaaggatacctctccatttcctttcagggtctctccagctattcatggccagtcggtagaagtatacacatatatactccactgtagtacatcaatgccaaggagcagagatgttactggatcagaacaaaactgtgtcctgcagtttatagccagaaagagagaacatcgagcgcattcataaacagcgtcatcaatgccagcccagagaggcagaggcagaagagttctgattggtcaccaccaatcagccaataggaggagacgcaattgtactatggtgcagagctgctggtacggcagccactgtgcagcgcagcccacccaacacggcctttttctaacccaccagattttgctgggcctttggatcgctttctgggccagaccaaagttgaagttgatcgaggaggagcatcccattccattcccgggccatttgcaagcctagaaaaggacgcggaaggcgaaccggattctggcccggccccctttggcccctttcggtcgggtcatccatccagctgtaccacactactccaacgttgacccgcgcgacagcgaccgcccatcggacgacggctcacgctacgaatcagatgccccaaacgacgaaagaaaaaaaacaattccgctactactaccaccactaaaagcagctcgctgtgtcactgccgagtgggcccggcgcgcccaaccttacccgcgaaggaagggagcgacccccccgaccccgagccttttgcggtccccaccccgcagtgtgatggcacgtcgtggggcccacggtggctgacaggtgggcccgcaaggcggagttaaagtgagcgaccggccctccctcttcttgacttgcgccaccccaccccacccaaacccccaccgccggaggaaggaggagacgccgccgccgccgccgcagccatgtcggggggaatcgcgcgcggccgcctcgcggaggagcggaaggcgtggcggaagaaccacccacacgtcggtgcctctcgatctcaacgcctcccctctttttttttttaatcccttttacatgtcgcgccgcggggcttgatccccctgatctgtgttctgatttggttccgtagggtttcgtcgccaagccggagacgttggccgacgggacggtcaacctcatgatctggcactgcacaatccccggcaagcaaggggtaagcatcgccctgaatgctacactgaatttaatagtaagagtacaacttgaaattcgagaggcctctctggttctcgtccgattctgaaccaggatggtttcgatggttatcccgttagctatccactgtgttatcagatggatctcttcaggcggagattatttcagtgccatctccctcttgttttgggagatcggaattagggattgtgctgtagtacatttgttgccatggcctgggtttgaggtgtggtgcttttgtgccgcgaaaagactgtcttttttttgggctagccaaactgttttcaccatagatcgaagttgagttctggttcactgtcagtcaccaagcttttgcatgatgtgcttacatgctttaaaaccagtcttcatttcagcaactactgcaaaccgtaggtagaagggagtattgcctcaaatgatatatcaaagggtgaaaccagtcttcatttcagcaagacagcaactaccataggatgaagggagtattgccccgaatgatatataaaaagatggactgggcattaaaatcaagtgcacacataaattcggttgaattatacacgtgggcttctgcaagttcttatcatttactaggccaaataagcgagtagaatgtcatgaaaaagataatactactcagtaggtctggattaacactatttcatatttgttgcgggttctcttttatggtcagattcagctttgacaaaagacaacaaagaggaatagtgattgcgtgtgtcatgtgcgtgcatgagggaccatgtgcagtctctccttcaggagtttgaccaagttaggagtccttgagatagaatagctcgatttcttgttggctcagtttggtctagaagaagtttgaacaaactagagagcatttgagcaggaattgctgacatttatctagccttttaaaagtggcatgcgtagtactacctccgtacactaaaggatgacgctttaatgttgggcacagagaacagcacagtttaactgctgaggaaaatagaaaaaaattgccccttcattagtattactaatagctcatgctccataaataatgataataataaatgttcatgcattctaatccaatgacccacaagagtgcattggcattgattagtgcaagcaccagtttgccacgagtggatgtgagcgaacgctaggccatgcgaatctccgatcaaaatattatggcttccttagatttcaattagatacaccaaacgctctcttgaattaatccaaagtttggccttatagctcccctttttagggtagcggtgaccggtgatattggaaaaatgttgcctaaaaaatctaaaacatcatctactgaagaacaaaatcaaaatcctaaaacatcacataaaagggcaggggtaataacattttgaacttgttagcacaccctcaggccttgctctgcacattagttgtgatgtgagccaagtttcacattattcaagctaacacgatctcttacaaaacatcaccatccagagattttcatatctttacatgtattaccactgtctggtaacattatcttagtgttttagaaaatatatgaaacccagtaagttcctggcaacctaggctgtcctgccatttgtaggtgctttggtgtgatttaggatatattaatgttccttctatctgaagcaaatataaattaagactttgaaacatgtccatatttacgtgttacagctttttttaatactcagaatcctttgaaacatgtccttggtggtgtaacacagtaatatatatttttttcctgaaaagacttattttttctgttaacaaacaaaattgtttgcttttacttcatcagtcttctatatttctaacgtgttgattgatgttatgctttgaattcttgcacatggtcagcttatatgttactttctcaagcttgtcatactttacaaaactacattcttatattgcttctctgttcatgtagagaagtgtttgtaaaaaggcattgcagctagaagcctataactaatgcacatctctctctctctctctctctctctctcttttggcagactgattgggaaggtggatactttcctctcactcttcatttcagtgaggattaccctagcaaacctcccaagtgcaagttcccacagggtttcttccacccaaatgtctatccttcagggacagtctgcctttcaattcttaatgaagacagcgtaagctttacaagcatttattaggtttttagcaatcccaatttagatatcatttataactgttctgattttctgctttcagggttggagacctgctattaccgtcaagcaaattcttgttggaatccaggacttgcttgatcagcctaatcctgctgatcctgctcagaccgatggttaccatctttttatccaggttagccatcagtaaaaagtgaccaatcagggttctgctaatttttactataaatcaataatgctaagatattcaagctttgtagttttaatgtgctctttgggtttgcaggatcctacggaatacaagaggcgtgttcggctgcaggccaagcagtatcctccgattgtctgagaatattggcatagggacccatgctgcacattcgcttagttcttgctagatctaaaatgagtgcctctgcaaatatggattagaccaaaatatgacctggaaaaagggtgctttcggagtttgagaagtattatcatcgttgtggactaatgtcttgtgagatccgtcttggatgtaaacggttttcttaactgtgatttttcaaccgtttgagtgcttgctttatgggataatgtcaaacattggtttggcaggcaatctcaagagtattgctatttctgtgctagtctatatgaaaacccagattaaattcgacgaaacatattagtttgcaaaaagatgtggcaacttccatattttctgcatttttttctgttttgatccggatctgtcggctatacagaggtgaaaataatgtaaacgtcggaggcgtaagtacacagtgcacctgctttgctcagaatttctctaaccttaatattgacttgctctgctgggattttctgtaacctgaacattctctggcagttatgctatcgccggtatatctctggcagcaatagcgttaagttaccgatacgtactagcgctgggttttcagacaataacgatggacttcaactacggacgacgcataattaccttgtacaactacaaagctgggaagctaatcttttgttcctagtcaattacgatgtgaaattgtgatcagaccagtgacttgtacaattaccagatgattcagcacaatgatgatatctttagtttggtactgctagtgccttgcacaatagcaaggtttatgttttgtaaagagctgccgtttactcttactctcttcgtcccagaatatagcaatctaaaattggatgggacgtatcttaatactacgaatctggatacgtctcatccgattcttggttgctatattctaggacggatgtagtatttattatgcagcatatacacttcatcccatccgatcttggttgctatattgcgggacggatgtaatatttattatgcagcatatacactaattttgtgtatacattgactatacgtttgatttttctttgcacaaggatttaagtagaatgggacgattgtccgctcaaaaaaatagaggaaaaggctatacacaaattttcttactgaactctaaaaaatctaaattgtttacgactctcatccagttaaatcaagcggttgaaaactttatcgtaaagagttttataataagattgttcagttttatagagtaagattttcttaaatgcgtgtaggtcattagcgttcgtgtttatactatgtttctttttctttaaaaaaaaaaggcaattgcaacacatttgttatggtggccatgtcccaagtggatagacggtcctgatcttctgccgtgctgttctgctggtgttgccgcataacccacggcggcggcgcgtaggcaaagccgggaggaaggattagggtttaggcggcggccatggcagctgaggagcagactccgcgaaccaaacccagcaccgggaacagcaagaagaggaagaagcccaggaaggacaagtggggccagcctatcatcgacgccggcgatcgcccggcggttgagccggagcctgagccagagccggagcctgtcccagcgcccgcagcggcggcggcggcggaggaggaggaggaggcggggatctatgaaaccggcaaggtggtggccagcggcctgccgtacaccaccaccgaggcggagatccgggagctcttcgagcggttcggtcccctccggtcgctccagctctctcgcttcccggactccggcaacttccgcggcctcgcgttcgtctccttcgaggtaactgtcgaattaacacttctattatgctccattttatttccatcttgatgttgcaccaaataatttcagcatccgtatgattgtactactatttgtcttaagttgtcctggactttggaggtaacaaatggttggccgaatgctcatttgcagccatggccgcttcatcctctacctgaaattctgaatcaacttggtgttatgacttgctagttgctacagaggaagttgctgttatagtcttatggtctgcacctatccgattattgttacattgctctgattgtcgtttcactggtattgagaaatgtcgttctactggtgtatgtatcatattaaaagccttgtatagttgtattcctaatcttatactacaatccttggatgtctgtgcatggaacaatactgtatgtcatgactttgttggatcgatggaaagctgataaagaaataaaatttttaacagtggaattccttttcatactatatttgtaattttcatttgtcatggaacatacttgccaaagttggttacttttagtttgatttgatagactgattttgttctactgtgccatttcagtcaaacgaggtggtaatgaagtctcttgagcttgacggattcaaaatgtaaggatgaggagtggctatttctcttcaactcatggaagcacgccatggagcatttgctctatactgatatatgcattgtgtttacagtggcaacaggtttatgagagttgaaagatgcaggttggctgctggctcgaagaggaaaaggactgtggagttccaaactgatcctaagaaggctgatgggtgtctgtcagcatatgttggcaatctcaaatgggatgttacagaaacagacttaagggacttcttcaagtcactgaagatttcatcgataaggtttgctatcaacaagagaacaggtgattctcgtggtttttgtcatgttgattttgaggacgacgagtcgcttgagaaggctgtaggaatgaatcaatctgaactgcgcggccgacctatcaagatatcatatgctgtcagtaacaggggctgaaggctactagatagtaaactttgagcatgagcgagcctcagtgttatgcttttgctccctcagttttgttacggttatatatccgtattaagtttctactgaaagtgttgtttcttgcatcaatctctatgtagaatgtaattcaccgtgtgacaaatacttggtgctacttaatatcgaccttataaacacttctcagaaatctctgtcaaatataactatctggtcatagcagtggcgactgatgttggaatgttgtctcattgagtttgatgtcgagggcctaaagttagtaattgttgagctcagaactaaacctaatcttttagagtattatatcccatctgaatagacgttctttaactagagtatatgcttttcacagtacttgtttgcagggaatgccttctccaatgcattttaacgtctccctgaggcacgcacgcctgctgtcaatgcttgatgctgtctgctgtccactgcctgatgttttctggttggttttatgcatcttttgtggtgccctgggaggggtaactatgctcataatactgtccatctcatgatatagaaaaaaggcagtcgctgagctcatcactacatggacaaggattttgtttgtttcaggtcttgtttgtcgacgcattcattcacttcccgtcctggcaagaacatgtggtcagtaaataagatgcccgtgatatctcattatgacaagaacatgtctctgattttctggccgctgcggggccctgtgttcttgcaatggaggagacattgcccggttgtgaagttcagatttcagaccctgttggctttgtgccgtgcttggtgcttctaattaactggaatgattctcctgtgtttggttaacccaactactacttgctcctaccactagttgatagttgcaactgagctttggcccaatctgaacagctgaaacgcgcctgatcagattaaaatcggagatctgtgtgtgatctgttcctggatattgatcagattacgcaaaggaacgtcgttttcctgtacgtacgtagcttgcctgtcaggtgtgcaattggcatccgtggaacggcttgctggaggagcatgattgattgattgccatttgttcatttctcggagatagctggctaaccgctggatgatgattcgagttttctctctctgtcccgaatggaaacgatgaactcgacaagctgggaggacacggatcgggaacgtccttttctcgatcatttcagcacgggaaggaatcgaccagctcaaattaaaacgaggtgctccttataatagtaggattgagataagagcatcggtttgggcccaggttctcaagcagcatcgcgtccacgtccagccacactaatccaggtcggactcgtgccctccccgagcactaacattacaacgaggcgcctataaatcgggtgtccgattttttttttaatcaggctctgtttcatcaagtagatcgaatatgtttaactaaatagatcgaaaatatttcagtcttttaaaaagctgtaacacaactaaatcacctcattaaacattttgatacaacgtatgaaacaacgatttctaaaaaatcgagcgttgtttcaccctatataaaaacaatgtttcagcaaatagcgacaaaatatttcaattcactgtaacatttgatctatacatagtaaaacattatgagtacactaggtgaaacttttttgtggaaaaaaaatgaaatggatttccttagcagagagtttacatagtatactggtgatttattgcaaaagaatatttcaactcactgcaacatttgattcatacatagtgaaatattatgagtacattaggtgaaacattttagtggaacaaaaaatgaaacaaattcccttaatagggggtttccgtaatatgtaggtgatttgttgcaacggcgtgcgtggtggggacacatagcgggagcggtgcaggacacgtggcgggggcggcgcgcgcgggaggcacggcgtgggggcgcccgattttaactcccccgctagatgctcgatttgagataatttcaccattacaatcactggtacatgaatcttactcttctatatattgcctcacacgttaacacatgtatcttaaaatgatttgaacctgtcctcccctctccatcgccatccacggcaatcaatcctgagacttgcagcgtgcagcaaccatgtcgttgcttgttcgttttccagctctatcatgttaatcttcacaatttggccggcttcggacggcccgagcgagaaagaaaatcttgaaggtatcttctgctgttgctggcagcatcgtcgtagctggatgccgcgatccctgtcactgggcgactattacgatacacatcgtcgtacactttaaacaccatctggagtagtaagtttttttttcccccaaacgatgacataaaatcagccgtgctggtccaaggatctgccgtctaatttgcttttgcgaggtagtccagtacattatttccttcacttgaaatgtttgaagaaaaaaacatatcaaattcatataacatcgattttatgttgatcacacacgtcacaggtggtgtcctaaacacaacctgatcgagattcgagagagacatgtatatgcttagcgtcggattagtactaaaagacgggatcggtttcggtttacatcatcctgagcggctgagcgtgagcatttactcatttagagtgaattacgctttgggccatattttattatctatatttcactttggactatccttaaacgtatcttttcactttggattggataaatttaccattgttgcgatttggaccaccacgaatgatttttttctcatacaatcaacaaccttaaacacatcagctctagtatacagtcgatctcctctatatatggttcatatgtttgctgaaagagaagttaaatatgacgagaaaagttgtcacggtagtctaaaccgcaacaatggtaaatttacccggtccaaattgaaaagatagatttaaaggtggtccaaaataaaatttagataataaaaggtggaccaaatgacaatttactcatttatttatttatttatttatgtatgtatatggcccaaaccggaagaagcgaacaaaaaaagagcggcaacaccaacaagacgaagcaaaaagtcgagtaaaaaaaggcagtaaaataggcaaaagagagagagagaaaaaaaaagcccgcgaagggatagagagagagaaagcgcgggggcgcgaacgacagcaactgcatcacccaccttcctctcctctcctcccctccaactcccgatccccaaatctctcgcccccacccatggatcaccaccaccaccacctgccgccgccgccgccgcggtcgccgatggagaactccgcgtcctccaagccgcccaccccggcgtccaccccgtcgtcgcgcctcgccgccgcgccgtcctcccgcgtctcctccgcggcgccgcacccctccccgtcctcctccgcgcccacgccggcctcgcggacggtctacagcgaccgcttcatccccagccgcgccggatccaacctcgcgctcttcgacctcgccccgtcgccgtcccaccacgacgccgccgccgccgccgcctcccccggcgcgccgcccccctccggatctaccccggcctcgtcgccctactgcgcgctcctccgcgccgcgctcttcggccccaccacgcccgaccgggtggcgtcgtcggcgtccgcgtgctcctcctcctcctccgccggggcgtcgcccgtgggctcacccgccaccggcaacatattcaggttcaaggcggaggtgccccggaatgctaagcgcgcccttttctccgacggggacgacgagggcgtgctcttccccggggtgttcacgacgaggggcactggccccaggaagatccctaggtcaccttataaggtgagaagtgttcgccttcgatttcatagtttctttcaattgatatggtctgtttcttgattgatgtttctttgaattgagaaaaacatggtctttattattcatctgctctgtaccaagaatcctgtgttatttgtcatgcataaagagactgatatgaaagcttattactcaaaatctcacatgaattttccttctgttgctcttaggtgctggatgctcccgcattgcaggatgacttctacctgaaccttgtggattggtcttcgcataatatccttgcagttggattggggaattgtgtctacttatggaatgcatgcagcagcaaggtgagccaactgcggccatccatgcgcattcttgtttgggtacttgaagagggtttgtaaagaagtttattgctgtgcaggtcaccaagctatgtgatttgggggtggatgacaatgtctgttcagtgggttgggcacagcgtggcactcaccttgctgtagggacaaaccaaggcaaagttcaggttagacgtatgcccctttctgaaatgatcagataacatagtcatgatccaccaaaatttggaacgatgccttagcttaatctttatctagagtgtcaatggaaacattgagaagtatacaactcacttatggaaagatcagaaaaattgcaatactattaacagtggacctaatttttcgcacaaataatatatgatagacgcagtagagttttatgactaaactgaatgactttcatttttactccaaagaatgaatttggtccattgtaatctctgtttacaaatgtgctgtagtatttgatgattatcgattaatcctgttgagctctgaaattggtatgcaatgctacaatttcaatttggtgtctgactgtcaccttggattttatcttatttaggtatgggatgccactcgttgtaagagaataagaaccatggaaagccatcggatgcgagtaggtgctcttgcatggaattcatcattgctttcgtcaggcagtcgtgacaagagcatccttcaccatgatatccgtgcccaggatgattatattagtagacttgctgggcataaatcggaggtgatctattttatacatcattatgaattttccgacatgtcagattcttggattatcctattgtgctcccttttgatatattcttataatatgcatattctgtttccaaacacctttcaggtctgtgggctcaagtggtcttatgataaccgtcagcttgcatctggtggtaatgacaacagagtaagaatgcatccatgaattgtttcttgattggatcattggtattacatggaattcaaggttgcaatttcttatgtccatatcaatgtctcttttccagctttatgtatggaatcaacactcggcgcacccggtactgaagtatactgagcatacagcagctgtcaaagctattgcgtggtcacctcatcttcatgggctgcttgcatctggtggaggaactgcagatagatgcatacgattttggaataccaccacgaatatgcacttaaattgcgtcgacacaggcagtcaggtattttgctacacatctaatttctttagtgattgtgcagcccatgtttatagttctgaactttaatgaactcttgtttattctatttatagtaccatattaaataccgtggtatatggtatgtgaaataagcatgataactctcaatctttggacgcacttaaaaaattgaacatttctttagtcatgtcagttccgaaaagtaagaaatgtaggctgagctctattttcaatagtgaagttctatttcttgttttcatatctgaaaccttcacagaaatgccatgtcattaagactgtagagttaagcatattgttttttggtatgtactgaggacgctgagtgaatcttgaataggtctgtaatcttgtatggtcaaagaatgttaatgagcttgttagcactcatggatattctcaaaatcagataattgtttggcgatacccaacaatgtcaaaggtatgcttgcaagcttattcttaactcagtacgctttacctttttcttgtattaattgtgctcgatttctcctttgtagctcgccacattgacaggccatacatatagggtattatatttagccatctccccagatggacaggtgaagttatctcttgagtctttgaatctactgaattctgtttattgtatctagaatattttggcatagctgtgtttttgacattttatgtcaacagactatagtaactggcgctggtgatgaaacgcttcggttttggaacgtgtttccatctcccaagtcccaggtaccttttttaaaaatagtataattggtccttatttcaatttgaatgaaatttcactttcatatatagcttctaaataataattggtccttcaattacagagttctgacagcctaagtagcatcggggccacatcatttgttaggagctacatccggtgacactgagatgtggtaatctaataacacttggctcataagtcataacactactgcagcagagtgttgatgatcatcaatatcattccatttgtaccacttgcatcaccagttcatgaaccatcaaacctagccaaattttagagatagtaggatgcagaatggtgaaactggctcgcagacctcggagtggctcatttgctgaatgctgtatatatttattcattggctttgtaggagcgaagatggcaaacactgaccatccgcaatgtaccattgataagttcacggcctcctgtttttgtttttgctgagtcaacttggagctggagctcttatgtataccatgctagggcttaacaacattggccaactcatgatgctcattgcatccaagttggaatatgctaaggaagctggagaatttctggtgcaatgtcctattccagctggtgttgtttcttgcactgttgcacttctctgatagttctggtagactaggctcagaatcgagccagtcttgctactatgcgtctatgccaacgcggcaactttgtactgatctatgtcaactgttcatgcaagatttatgacgccaatgtattgagttgagttatcgtcatggagcttcattgctatactgtttattccactggtgccatgcttcaggttgacgtaattcattcgtatgtatgggctccacttctcttttgtggactatgtcaactcgcttatgatgatcctatcgcaattagtttccaactctccatcattcattacagacataatgttgaggcttgctgaaaacgtatcctgaagttaagttcagacttcagtcatacttatatttaaaaaacacacagacaagataaaacttgtctcctttatattgacagaggctattcaatcctggagttcagacttcagtcataccatatctagggtatgtttagttcatgtcaaaattggaagtttgattgaaattggaatgatgtgacggaaaagttgaaagtttgtgtgtgtagaaaagttttgatgtgatgaaaaagttgtaagtttgaataaaaattttggatctaaactcggccctaaagaaacgacacaaaacttgtctcccttgcattgacatagccacataggctattcatgcctgaaaagcagatgcgtgcaaattcactaggactagttactagaactatagaagctaatcagttagttgtaaatcaaccgaattacagaacagggcacctgaagtagctcgatgcaatcattatcctctccatattgtgattcgttggagtctaattggttctggttcaatgtcgtaatcagggcagtacagcctcttggaaaggcataacgaagatgggattatctgattagctgctagtaggtcctgatgaacacccatatctgaggttagcaaaatgtacttgcaagttggaacacagtatacaactaactatattccgccaccttttgaaggtgcgttggattgggccaacagagaaccactccagcaagtttcaatcaccaactactctttgatttctctcccttttctccttgtattctattgtattgtaggcctactctctcagtctctcttgctccatgaaacgtccaagagcttcttatgtacttacttttttttttttggataattgaaaatgtatcacatcttcggtatctccggtttctgccgttggacacagccaataatcttagaactagaaaaataaataaggttatgggatccttatgtacttgcagtgcattaacatgaatatatttttttttccttttcggatggtctcactcagagaagtggttaatgtgaacaatcatgcatgttcaagatgtgcgcgattgttcagaaaccgtgtaatttgcccttggcgacagggaccttgttcctttccttttcattttaactgcaaccctctcttgtcgaagtggtcctccatcgaacgtgtgacctcttatcttagaaagataagcagcctatcgtgattccttctccatgaaacatgtttttcagcaaacagtggcaagcccatcatatctgcatatgtgaccgaaagaaagaaagctagaaaaacacgtttttcagcaaacagtgcgcgaagcgatcatatcatcgaaattagcatgtgtgatatcgcaacttcttcttcttttagagacgaagacgcaagcaacaaccagggcacgaatcgtcttgtcgtacgtcgaactaacacaggaggctgcaactgcaatgatgctgcaggcaatcgccatgaacgggcagacagtttcaggcgaagagcaagaagacgcagaaacgaatgcagtttttttttttcttctctgggccgatgggacaatgcatggtcgagttgaggcccagaagaagtagcgtgaaagcccggcaagaagatgatcaaagagacaagagaagaagattagagaaagaaagaaagaaaaatgggatagataatgcctgtaggtggaccaaccaaccgattgggacccttctacgccctctccaaccgacgcctctctcaccaaccgaaattattatttctccaccatttttggtgctcgatcctctcctcccaatcaaaataccctcctctactctaacaagcatacgcttccatacagatggtgccaatttttatacagatgaaacaaagtcagattaactgttgcaaaacatggtacagtgctggatacccttttgtctagcaaatgatcgttttcagtgaagttttcatcaggtgtgtggaagtccattggatggtgtaattgtcaaagcaagtaaagcgatcgatctctgaatgtcatggctcgttttttatatccaaaaactacgattgatgaacttggaagtaaccttgttgtactacatcaaaacagttgttctaccaaatggaggtgaaatttcagcacaccaagaaatacttcgtgtcacatccctctccggccgtctcttccctgctaggagtttttatttttttcctttgagctttcgctttaaaaactttgctttccgtaaagcttcaggtcctactatccaaatctggaagactgtattaaaagaagcctgtaatgctcctttcgtcttgcacacaaattttcccatgcaaccaaagtctactgctttattcttgtttttttttctcttcttctttccctcgtgtcttgtcctctcttttggtgcctttctgactcctttggagtgtgtagaagcgtacacactaactaatctgttgcggccaccgttttgtgccatttgtctgcctcaaatgttagcaccagcactaactaatcagttcagcattttattaactaaaagcacatactccatactgttgaaatctgccgaaatggcttatcacaatgcagagctactagtgaaattggaaacaaacgatgagcttatgagccagaaagaagcaaaactgtccggcctgaagcagaagctaggagtaactcttatcaagaagcatcaccgttggggccaatcagagtggatatgtattttgcaacgagggaggggaggcccccgcacgggaggattgcatttcgtacgacggagcgacgtggacgcgaacgtttccccgcaagattcgattgctcgtcgacagtgactcggcctggaaaatacagggaaaagcttggtgtagctatcagcatgtacgtcccagaagtatacaggactcatcgtagaataaataatagtcagccggggtcgagaatgtcttgtacgtgctcccctctgttactcgtggcagtctctctacagccaaagcaagatgcactactctattccctacagtatagcacctccccgattgagcgcaacgacggtttcgatcaaatttactgttttaaatttgaattctcgaaaaacattcaaaatttcgctcggaatctactttcagcccctgtttgagagagcttctagcttcagcagcttttcctaaaatcagaagctcctccaaacagtccattttgatttttgagaagttgcagttgtataataaaaaaaatgaaaagctagaaactaataaacctagcatttttaaattttcaaaagctatctccaacccgttgcttcttataatcttaagcttctcaaacaggccattcatcccgcatgagaacctaaaaaatttcacagttattgatcggtttttagtcgaaaatacgagcactatttatggttcccatgacggaacaatggaaggagtagtacataatcagtgtgttgaaaaactggtccgcgtgcaacggcaagatttgcattgcgggcaggcggcagcgggcgtggagagaggcgcgtgtgggagagcagcgcaccgacaggtttaagcccgcgcgacagctaggccgtaggccgtgggcgccgcgtcgctgtcgcggatccaactccccaagcagccaagccccgcgcggcgttccgcgtaatcccattcccgcctcgtctcgtggtctcgcgccgtatcgttcgtatcgtgcgttgccgtgccgcgcggccgaccgcaacggcggaagcaatgccttctctccgtatcgcgcggtcgtgccgtgcgtgcgtggaccagcagcagcaggctcgcgctgggtcgcgcacgcgggcagctcgcccaaccaccggcgcggcggctgcgcggcccttctcccaccgcccccactcccccaccgtgtcgcgcgcgtcccccccagccgacggaatattttgtactttcccgatccgcttccgcgacttgggccctgtacgatatcccaccacttctctctcccccaatctaataatcctgcatctcaataacatatcatatccatgattatcattactccgtctctgcatcttgtggatacgagtactacgtagtacgcagtagtatgtagttttgtacagtcgtgccagcgatacgctcctttcctgtagcactttccaaagacgtacggtgccttttcctgtatgctactactggtagagtacgtcggctgggaccggactgcatctgcgtgcttttgtttcccggacttagtccaagattctgctacctattccatttgatttttggcaaaacttggctaaagaagatggacactacaaactgttgttaggatcgggataatagttagtattgttttgcttaaagtaatatcgtatcatagaatcatatcgtagtattgggataccatgagatttttttaagtttaattaatatttatattaattctatatagccattctatataaaaaaatatagtaatgatgtatgtcatgcaaatatagacacttatcaagagaaaccacgttggttttgatatatttaactgattaaatttgaacatatttatttgcattatttttaaaccatgttattttaaatattattttatattatcgtagggattgtaaaattggaaaaccacgtaagatttcgtatgatcgtatagtaatgaatagtaagatcgagatactatcaaaattaaaatactatatgggatcgatatcgtttcgatttggtaggatcacaccactataagatattaggatacgaatcgggatactggtagttaagtaacaaactcaagtcgctaatccaggccggtcgagctaatctcctgctccctgagcccacagtttttaatgggaaataacgaaagaggatgaattaattttatggctctatatatcttgttacaccaatcttaaataaagaaatgtattatatagctaaaagctgcttagaaaggcacatgtgttttgttcatttgtcatgtctgtccactaaagaaaacttaaaagtggacaaggtggttgtgttgctgctagctattaagtactacttcttcctctgcttctcattaaaaagatcgattttgtgcacgaattggtaaggaaaaagagttaataataaccgatgcaagcaaaagaaatggagtcatatatgcatggatttagtcagagaggtagagaccggcaagggagaggttcgttaattggacgggcggggcaaggaggccatcagggctaagagcaggtacaatagcaaactataagctagctataaacacatatcgaaaaaataaataatgaaagagaaaagcagcgaactacagcacaaagacacaggtaggaccaaatattactagtggagtagagtatatatttataggtaagtataatataaatatattaattaactatgaaattgactatatatagtttagaactagtagttggtactgctcttaagcattaatataccaacatgcccaacaaccagcgatctatagtaatcttgtgcaaaacgtgtgggcataatcatcgtcaagggtgaccaaaagtacacgtacaaacccgatcaaatccgagtctttgactgacctgcatgcatgatcaggctgcaaagctacccctgccggctccgccgtccggccgccgctgccgtgattaattaaccgcgcctagcccatggtaacttattaacatctctagtcaactactaactccaaatcatctagagccaatataataataaattcatacaataattgcttactatactattaatatttagtcccacctattatacacacgctacgttttgaagttcgtgctacagctgactacagattctatagcccgctgctattctctcttttttttatctctttaaactatgtttatagctggcttaatattctgttatcgtacttgctctcagctgcgaactactaatgttaatgtacttaccttacatcatttagctggctcgggggctcggttcaaacttgctctgaatggtctatttttttcttttaaaattaaaaatatttaattttgtatggaaggtgttttcaccctgcctcagctcgttatgaaacaaaatagtaaaaaaaaagtaaatcatgattttgttttcgaagaaagcttgataaaaatctgattagcttccacccacccctcgatttagaattaaattgggtttgatccctcatggggatgttctctcattatttgcatataatatatcactccacaaacatgcaagttcatattcaacttctatatcttgtaaaaaaaccaaatttgattatgaatatacgttaactacttatagtttaatttgttttttcgttgcgagatgtataagatgaatttgaacttgcacgtttatggcctgtgatatatcacatgctattaatatatcttcttatttttaaaaaaaaatttaataactatttaagtgatatcaaacaacgagagaacatcctctcgatggattaaaatagtttctcttaaattggcaggttgtatacaatgctattttttttcattgttaaactcgaggaaatcaccactgatagggagtacaaagaccaaacgtggaattaatttggaaaattttcttcaggattaattaatggaagacggcagttggcaaatcaagaggcacaagagactaccagagcgaacaactataacaactactaccagctgctactgctgacaatgcaagcatctcttgatctgatacgcctgcaggccggctgcagctgatacgcgatgggagtacgtacgactgaatgaagctagctagctagttaatggctggagagaggcaatctaacttgaaacataatggacaagctaggtagcatgatctacgttaatgctgttctgagaggtgtatgtacggtacggattaattaattaactgatgatctcttgagcatgatcatgtagtgcagtgcagcctaagctagagttgatcgatctctgaccaataagagtcgttgctggacgcttaattcccaaacaaaccagcaatcgtatgatatattcgtagtactattcatgtttatttttgcccaaacaaactaagttaattagtatatatatatatgattcagtatgactacgcgtcctcataagagaaaataaaacatagcgaatatattaaagttgcagtaaccctaaacagcaggcagcatgcatgtcattatccttttgttaagatatgataaagacaaggctacagaagacgggcccgtcataccatgggcgattatatatacaacagctgtcaaaagtatgcctaaccaataccattattatactgctgagcagtacgtacgatcgattaaaggcgttgatctccctactaatacgctgattgattacgtactactaatactaacaaagcatgcactcaccctgcagctatagcaggggaaagccaataatggagacgacgaccaacagcagcagaagcaggagcagctaagctagctagccagcagaagcccattcccgacgccaaccgcaaagttggtagaggcaaccgaaactcccaaacaccaccaaaggtatttcctttcttgaaaccaactcctaattattcacgcaccaaattacaaggagaacaacaagctaagccaggattaggttagctatctaggttagtttacaggaagaacaaactccccggcctattcctgtacatgatcattgacacttcatcggttgtattcaacaattaattgaactccagatactatatatatggtatgtaatatgtataatcctgaaccatcgctgaccgaaacatgaggaattgttaacgacagcaacatacacatatatataattcgtgcatgcgattctcgtttctcaatcagcttcaaaccgactgttgttaagtttgatctaaaatattgaaaaaagaaagaaagaaaggaaagaatgatccatgcaaaagctaagatgaaagctcctatgtacgatcgattctaccgcctttggagcacagcatgcatatagtgcaattcggtaggcaccttttcttaggtttggacatgcttaattagattccaaaaccacctcaccctcctcgtccaccttcttcttccacctatcctagctagcttattacaacctactgtttcggttccaatgacatgatctccaaaatacatctttgattaatttcttttatctatattgtatataataaataaatatattttttgcttttattattaatattttgttagacaaaattatatatgttctcttagtgtctttatttttaatatttttaaagttactgataatcgcacttctaaatatttaatcctaatcttgttcaaaacattaagaattatgaaatcggaagagttaagttagagcgagcgagctagctttttcccagctctatcctctcgtggacacaccttctctctcatcgtgctggattaatatattcttctccatgctttagcatccaagctccagtttcaccgagctaaggtagggggaagggaattgaattgaaggttcttgggtgctttcttttccagttacctcccaccttaggaaccctcgaaaagacccctcaccatctcctttgtgtccttgctaaccaactccccattaaatccctctccgcgcgccttctcgctggccattagagctagctagcgagagctctagctacagctatacatacgtgtacccaacggccacggtcacccgcgcgagcgagcacgcgcaccaaccgatcgagcccaacaagctcgctcgctcttggtgcgcgcgcgcgcggcgagttcgatcgatcggtgtatacgcgtatcgtgttgtgtatgcaaggcggtgatcacggaggcatggagatgggcgtggggtcgttcaccggcggcggaggaggcggggagtgctcgtcgtcgtcggcgacggcggcggctgctgcggcggctgcggcggcggcggcggcggcggaggcggaggagcggcagctgctcaagggggagatcgcggtgcacccgctgtgcgagcagctggtggcggcgcacgtgggctgcctgcgcgtggcgacgcccatcgaccacctcccgctgatcgacgcgcagctcgcgcagtccagcggcctcctccactcctacgccgcgcaccaccgccccttcctctccccccacgacaagcaggagctcgactccttcctcgtacgcatctatttaatttcttcctgagttcgatgcgccatgcttgattaatttcactaggttgaatttaatctttgcatttgtgcatgcatgcatacattacatgcaagtatcataccgtacgcactagctacatgattaactagaagctatccagccaagctaactgtatatatgcatactgaaatgatcgatgcaggcgcagtacatgatgctgctgtgctcgttcagggagcagctgcagcagcacgtccgggtgcacgccgtggaggccgtcatggcgtgccgcgagatcgagcaatccttgcaggacctaaccggtaattaactactacagtatcatacatgcattacatattttccactatatattacatatttcattactttccctctccttctcgccgccttcttttctgtatttttttttcgatttccatggtgtcgtctttatgatttttgttcacctttttgctcttctcgttagttagattagatggtgaaattgtttttttttagttcgttgccgctagctcttgcagtgatatattagttgcagcgtcttgttcaaacatatatatggtctcttgattccctctcaacagatttgcatgccttgacttctaaggttccggtttctacaggtgtattcagaggagattagttaaatatgaaaactctaacacacgtacctaacagcgactttattgctgatgtttatactcgaatcaatggaatgataaataacacggaattaccaaggcccacatagatggcagcccgtatactagggaaagcccagaagcccaacggtagatgtcacgaaaacaatttcagatattcctttttagcataaaatccttccagttcaaaaacaagggcaccaatttttttttataatcattttgtgttattaacagagaatagcatagtcaaggtttctaaggcctatatatatatatatgtgtacgtagttagacgtgatacccttggtaaaattaacttaatcagttcatatatatactgatatgaggtgactagctagctatttttcttcttttctcacaaagtctcaattggaggtttatgatcagttgaaataaaaaaaattccaacaacaaaatttgaaccaactatttggcataaatctaatgaaactatcctttgctaagagaaccatgggttggatatatacatccttattagtgtagaggctggatattaatctgttatctaagaaaacaatccatgaacttataaaatgcatttagccatctccggcgcagatcaagcgctgccattcggtcatggccgattggttggttggttgctagctagcgagaaatcgctgagaggatattgaaaagctagtaggtagtgtaacagctacctaagccttatttggagagctttgagattttaggaagcatagctagttagtagtcaatcactcaattggtgagaatatggaaaaaaataggttttctaactttaaacttctagttcattttttaaattcaataactataatttcttagaatctagatgaaaatttaaactgtttgaaaaaaaaggttatataaaagaagctacgactatcaaaagctccctcaaacagaatctaggttacatgaaagtcatctaggttccatgctaatcctggctcggagttgaaagtccatgcctctcgtctaatcgactagctaattaaatgattcaggtgcttcgcttctgtcgaataatatatatcacacacgaccatggaaagtggaaggtgtgtcacatgacatgatatgaccggccgatcgagctcttggcgatcgtcctcttatcatgaggggcatcgtcataatcatgatgcatcgattgggattcaactatagtagtcattgcatattcaaaaagcatcagggttgatgtaatgtaactgaagaaaaacacccatgatgattggcgaaatagatgttgaaaacttagcatgcgcatacatacgtaaacttcaattgtaggtagagaaaaattacatttcacctgtaaattaggacactgggaagttgttaaattactagtccactcttttgacctggattctaaggttctttataggttgaatttttatttttattttttattttggtgtgtgtgcgcgcgcgcgcttcagttggttttggttgctttagagcataacatcaaagccatgctactttaaaaaaactataataataataataataataataataataataataataataataataataataataataataataataataataataataataataataataataataataataataataataataataataataataataataataataataataataataataagaagaagaagaagaagaagaagaagaagaaataaagacgaagatcgaattggagctataatatgctaacttatctagctaggcagttcaaagtacactggtagctagctagtagttcctgcgagctgtttcatgcaggcaatgcagctggcgagagctgcatatgcaaaactccaaatcagagacatcttttcgattgggtagctttcaagctgtttcaagtggccatgcgcatagctcgtacaactgtctatctctgctcgatctcacacgttccagttcatgcagctcgatcgatcgccgacgtcgacaaagccctcatgcatgcctccgtactgcatgcatgccctagctaattagctctaactcactgtgtagcacaatctagattgaatataaccgacaaactttgctagctactagctcttctttttcatgttattatacttgcttcaagctaatctttaatttttcatgttattagatataggaataactaatcaaataaattaaagaaataggacagttacaagagatgtgatcatcaattaattaactacagtagttgatttacacttacctggatgcatatgcaattgatcatcaggtgcaactttggaggaagggacaggggcgaccatgtcggaggacgaggatgagacggcgccgatgctggagggcccgatggatatgggctcggacgggcacgacctcatgggcttcggcccgctcatgcccaccgactccgagcgatccctcatggagcgggtcaggcaagagctcaagattgagctcaagcaggtacatgcatgcattgttattaatttcttcttacgtcttgcatgcacctacattcgtctcttcaactcatgcatgcatatatcttatcaatgtttaagcgtgttcatttaacatgcttaaacattgataagagactgttcatgcaaggatcatgccgagctagctaaaatagtactactgctgctagctagctgctttttagggcaaaaacagtgcatgatcagcttaaatgagctagttactagcatgaaaatctccttcttaagttccttgtactgtgtcatagaatactttgactgaagactgagcctagatcattgcatatcatattaattggtgtcatgtttgatgcggcgcctcagctatatatgtgactgacaataactgactaagactagctacttctggatgcatgcatgctattgctagttcttcaatcagttcctaaattaattatattggattatgtaattaactagagggtgatacgtacttttgcaatcttatctctgattaaattattaaattcgttacagggcttcaagtcaaggattgaggatgtgagagaagaaatattgaggaagaggagggcaggaaagttgcctggggacaccaccaccatactcaagcaatggtggcagcaacactccaagtggccataccccacggtgagtacattgtacctatcaagcatgcttgcaagagtgcaactaactagctactagtcgagatagcccttcttagctgttctccaacttgttgatcaatatatcttgatgtgctaactttacaattaatatttatatataatatagcaagaagcaataatatttattaattagctaatcagatatgcacgaagaattgcatggatataatacagttggttgagtggcatatatattttcttggtacaggaggatgataaggcaaagcttgttgaagagactggcctgcagctcaagcaaatcaacaactggttcatcaatcagagaaagcgtaactggcacaacaactcacagacatcaacccttaaatcaaagcgtaaaaggtaaacaaaccgttatccaagtattttatccacagtaatacaatgttgatgtttcagtaattaacaactgaattataacacaaacttcttttttctatatgtaatacaggtaaagggcagaaaaaaatgtatacctgacgtactcgctaatcaaatcaaaagaagacatggtgactcataagtaataagatcatcttaaattgtatatctagttattaattagtcagaggtgacaaattcatgacatacatactagtctgaccactggcatatgcgttgtaatttttgagcagatatgctcaagcaaattcttcttgttggtatagtttttaattttgttgtcgtgggtgtacctgcatgcatacataaccccaagactaattcatttgctgtgcatatacattgaccattctataaccttctgctagtcaaataatcaaaaagcgcacgccattgcaatccagcattaattcaactgcgtttatggatggaacggaatctctatctatatttgtgggccttgtatcaagtagtagcaggtatgccaaactggagttggactattggtgattaattggacaattaggcctaaccaacaccacaagacaaattaaggctggcactagcctctcatgataatcccgaaaatttccggcgtatatgcgagagcccttccagcaagccagcagggacacaagaccaaccatatatatattcacgtttctgttttttagtgtgtggttagtgatagttttgcatcgtcttcctcattagtatgtggcttaacatcttccagataatcgctgtgctgattgtcaaatattccaatcaattaaggctggagctagtgcacggctagctacgtctcaaccagaacggacaactccgttgagacctcactgtctcggaagacgctgcacgttggttccctgaagattggcagcgaaaaacagcacccataatccatatagaggttgctatccagctactcatgtccaaaatctataaagcaaccaaacatatactgatcgtaaattcaaagttctggtgaaaaaaaaaaagtatctgatgcgtcaatctgtgttgctctcagacgtaatattcagagattcagacataacacgggtcacatacaagctccagttgttgattgttcgttgtagacaagcaacaatctacacaggcaatgttatcaccaaattctgataaaaagttccaaatctaagttgacatttcatggcgatcctttattcagagaagaacgtattcaagaatgatcaacacggggagctgataatttctacgaaacgggttcacagtataccacacccggaggaatccaaattatgtttgcagtttaccacccagaccagtcacagatcgattaatatatcgacatcacctataataacactacaaccaccctaatgtttacattgttcacaatataccgatttcgtcacaaagacatatctccaatttctgcatttcctttacttgccgtagtaaccttgtggaggagggtaggagccctgaggcgggtaggaaccaggtgggggataagagccagggggagggtatgcaccaccctgggggtaacctgccggagggtaagcagctggtggataaccttgagcaggcggagcaggaggatagccaccataaggctgaccgtatgctggctgttgtggtgtgtacccaacaggaggtggaataggctgatcgatgcgcgacatttgctgcattggaggcactgccatgggctgtgggccgaacttcccatctctcttgtccatttcaattttgtgttgggtctgcacatgcatttcagtggataagatggatacgcaaaggttaagaagagtgagtaaataatcaccaaagatattatgtatgtttacctgcatacaggcgcaaaccctgcaaaaaaaaaatggtgcacaggtcacaagattatcaacattgggggacttaactatggagaagagaaaataacagagttatgagagcttacgagcagtagaccatatcagacaagcaggaaaggatttgggaagcctctgaaagctcttcactaccaacaatagcggcaactatagagaagatacaagcaatttgttggaggcagaacatgaagccctacaggaaaagagtgatcttctgcagtgttatagtctcatagaaagggaacataggaattatacctaaaagttagtaaaacaaacaacaagaggacagtgacagtacaatgatgcagttatcgcatttagttgtctgtatgttgaattcatcttggagcaagaagcgggttgaagcaactgaattaccaaagcacagaaacacctgaaaaataaagtactagttagttctaaggtaagcacaaaaatagcataattaaaggaatagtgacagtattggagattactccattcaagacaagcattacatgttcccgttctaatctgagatatatacgattgatcaaacaagataacaacaaaatacagccaaattatccttaccccagaatcattgaccctggtgctctttcattgaaaaaagaagaacagaaaaaatattgtcatactgaactgtatttcagactatcagaaataccatgaaaagcatgctttttgagcacaacaaatatgtgaaatccagaaatcagtagaaaatataggtaatcaaatattacagaaggaaccatcaatactccttttctttagcaaggggtggccaccactttccccccccccccaaaaaaaaaaataaataaataaataaataatcatattaccggaaatggaacagtctttacaggctgattacaaagccagatagcaaagaaaagaaatataaaaaccatcaatactcatagccacatgagaactgttacatgtgacatgctgcctataaattcagcctaatcagtcatcaaaaggttatcagcaaaaaagggaatggatcttgtacctcagtagcaagacagaactctgggcatcggctttcaccacacttcccactgcatggcatgtacccagcacagcagacatatctacaagacagaggtgcaggggaatggattcagggaggtctaacacaatgttcgtatctaaccatagcaagtagaagaaaatagaagaaaccccaccttgacatgtcattatacagagcccttttgcgaagcatgtatgacacacatggtccactgaacagaaaggggggaatgtaaaagatcaaatactgggtaaaaaattaacatttctaaatgctaattctgcctactcaaagacaccacagaatatcattgtacagattaatgaaacacgactccgtttaaatgcaatgcctgtggaaaagcagagtacccagaagactaaaatcttttttgtggatagctattgatgataaggtgacatggtccagaatgagcttgagggcgggaacttaaacaagaaatagaactagacaaatgaaaggactaccatatatgctctcaacgcattttattgcaattcttatggaatgtacaaacactggcaccaatgtggattcaaaagatatctttcttttagggcctgcaggtactgaatgggctttgtggatccatcacgctgatagtatcttatcgaatatcccgtattaccccatatgggtcattgcgatagagacaaaatgcctttgccttgcggctgcagaggaaagtaatgctggtcgaggaggtgactagggaaatcaggaaagcattgcatgaaaatcaaagaacctatgcggtgactgctcattgacgctgctgatgcttgaagctaatggagctgtctttaaaacgacaaacttcagtttagttcctatccaggaaccgttttacttttgccattatgagaactttgaagcgtaatgttgaacaaaatatattacatgaaacagtaatgtgtcatcctggatctgattcctgaggccaatctaaattccgcggtcctttcagtaataaagaataaaaggaactgacaaaggtgcaacgcgtcccttaatgtcgcaatgtattcctcgcacctaaaatccgatcaaatttaagaatgcaaacaagcgcataataaacaggcattaagaatctaggcaatctccacggctgcgagtgattgaacaactcaatgcggaatcacacattgtccttatgctcatcagacttagaattccttaaaccctagtttaattcagaaataaaaagacagattcgcccagatctagaagaaaaggggggcgtcgaatatatcaggtcggggtaaaaaaaaatggagccggggagatcgacgaggatcgcttaccaccagagcgcgaggcagcaatctgcatcagcagcagcaacaacgacagggagaacccatcagaacgaaatctcgccatgggaaggcgcagtattagcattcgcagagaggggggaaaaagaaaagttgacatacatgggaagtcggcctggatggtgctggtgagatcggagtgccagaggttgcggtagctctggcggagctgcatcttgtcgaggttggcctgcgacgacgccatcgcctcctcctcctcctccccgccgccggcggcctgcacgaggggatggatcggccgtggactctgcgggagatgtggggggggggggtgtgggatcccccttgcaccaagccactatccttctctctctctctttttggggcgcgggggaggaggggaaaagaggggaggaaaacgacggtgtttcggtggggtttcggccgttggatcgggtccgatttgtgcggcctcgttaactgatggccatggcccgccggtcaacgaggcggagtcgtccaaagtttttccccaattttcttttcttttttttcccttggttgtagagtgttttggacgtgatcgaccgaggtaatggacggcacgaacgacgacggcttgcacagacggcgggtgaccggccccggcgacaacgatgcgagtccatttggttcgtcgccactcgccaagccagcaaggtgcaggcgtgcagctagagcggatctgcggagacggggtggggtttacggaacacgacgagcgacccaacgatccaaaagtgacaaaacgtggaatgtaagactgggcctcatagtctatcagctgggctagatggtagtgggccttgatgggttccatgctgttggtatgtcgtaaggcggaataagtccacatggcaaccctcacctttacgctgagtttaatttacaaaccctatccgtaatgccagaaatattaaactttcagcttgcaaacccgattaaattagatccttcactcgcgctgttgatgggtggtttcgctgacgtggcaagttgacccggtttactcgtgctgactagctgtttacgtgacaaaacaaaagtgggtctcacatgtctccattcttatctctccctcctcatcctccccacccctactctcctacggcattggcagtgacggtggctggtccctcggacgcatttctccatcctctgcaacgacaccacccccgctcactaagaaccctatcctcgtcaaggtctaccaatggtagcgacaagcaacatatataccacggaataagtccactttaacttccttaactagcaatcgaatctgttttgtatccctaaaccataataccgaatatctcgaccaccccccaactattaaaaccagtgtaatttgattccctcggcggagtccatgccttctactttaccctacgatggagtccatgggtggcgatgacacgacaaggttggcgcagcctggttgcgaagtcatcggggagctggagatctcccctccgaccctctccctcatcttgttgttgcccaccacggcgccacccctgtcactcgtccatcgagaggcccttcatgtgacggagcatagggggataagagcggggagagatggcgtcggcatcgacctcgtcgaccatgtctctaccgcttccttcgtgatcaccgttgtgggctccccttcaccgcttcgaccctcacttgcctgtcaccgccgctgctccagccaaaaggaaagagaaagggaagagaaaagagaaagagagaagggagagagggatgaggaagaaaggatgtgggcccacatatcagtgggtcccacaaatgttttttttgtgtgaatgataaatgggtcccacgtatatgtttttaattctagtgccacataaacgctacgtgggactaagacagatcgacactgtcacgtaggagccacgtcagtgaaaccgccgagagtgtatcaggaattgtggtttaagaatgcgaatcagatttagccattagttaagggagtcagagtgaacttcttcctatactccacaaatgtgcctccgctttcccttcgtctcctgacatcggactgaacatttgatggtcctgttaaactgagcacaaggcacgatccagtccagtgaggatttaaattgattatcctttatttcctgggccaggcttatcttacaggatggaaagacgaggaacttttttattttatttttattaaaatatttataaaaatgttttattttacatatttaaattgatcatggtgtgcttcctccattaggtcctgtttagctctcaccccaaatttttttcaccatgtcacatcgaacgtttaacactttaagaagtattaaatatatgcttaaaaaataactaattgcacatattacgactgatttgcaagacgaatcttttaagcctaattgctccatgatttaataatatggtgctacagtaaacatgtgttaatgatggattaattaggcttaataaattcgtctcgcggtttaccgacggattctgtaattagtttttttacagtgtccgaacaccttatgcaacaccatatataatacctgatgtgacacgccaaaactttacaccctggatctaaacaccccctaaataggaaaccctagccaccagagtgctagcaatgtagagtttaatccagcccaggatatacttgatggtgcaataaaaaaggggggcctccgatgcaaaggtggattctcgatctcgaccgtacataagagatcgaacggatagtcaagcacgttgtatggacgattcgcaggggaataggggatacggcagatcaattcgtaaggagatcgactctgatcgaaggcggtacataacagtactgtagtcatacgaacggaatgtgcgaactatggaagaaacgatggggaaatacacggccatatggcggccatggtcgctgtcgtatgatcgagctgagctcacgcgagggaggaaatcgtacgggcggccatggcggcatcggcatgtgacctcatcacctgaaacggccgagctccgcctctactcactgcatgccgcgaaatatcaaagcagtgacgtcgctgctcgcaccgcaataatttggaattgttgccaacttttttcccatggctgatcccgtcattcaaatctgtacaatatgatattatgatttgcttgcaggatacagtacgtctttctggtgtcatatctaattaatcacacgtgatcggagagatgtgtactcgacaattcaaatgcataacacaaattgatatgttgctgccatctttggcttgacaggatcatgtgctcaatagcttgcagtggtgatgaacaaaccagctgctggccgttaattcggtttggggcacacgtgagaattggttgggggtaggcaagcaacagaggtgctgtcaggagaaaggggattaacgataagaagctagattcggattaatcctaatcacaatctttcaagggctacaattaaaggccctgctttacacggaaaaggagtcttctggttaactcatgccggagatttgagtggtaagtggattagcccgtgacgatgaggagatcaggagaagtcaaaaggcaaagagataaagatgtgacacaaggcgcactggttttagaatttaagttggggtgacgtgggattgtcttatcctctaatcaccctccaattggactcatacaaagcaaatatctggcctaccctgtaaaaataaaaaccctctcttcttttttttttgagcatttagctagcctatcctgtattttcaacttgcttatataaaaacaaacttgagtgcatcattggcacgtggaacggccggtttgtatgtagtggtactctacgaatttacaacagctgggttcagagtttgcagcatttattatagacagcgtggcatccatacaatccacaattgacacctatttgcagttgtcccgtgctcaaagatatgatgaactcacaaacaacagcaggttgtacaattaacagcgagtgttgcaattagctcaacctagaagctccagctcttgcacgtgaatatatttgcatagagtccaaattttgaccggaggaaaagtaatgcgtgaaggaaagaccagcaatactagtagtggggtaggttctgattactgaaaggccctaaacgagtaaacgacagctcccggtcaaactcaaaccaacaacgaaggagagagaacgaaaaaaactcccgttgtgatcatcagcggaaacttctccatggtttgtcaaacaagaaacatgatcagatcaccatcagaagcttcttggcgttttgtcaaacaagcaacagttgctcgtgattccgtcaccaagattctcttaaatattcagtcgtcaactgatcgaaatccatcgttctgatttctgaaaccagaatgccagaaacacgcagagggcacacgcaacaaacaaacccacggttaattcgagaagaataccctgatattgcaattaaccgagatgctcccgggccaaacaattcagagtttcagacgcaggcagcagtgctgctacctggcagaaagctcgccttggaagtgttgatctggtcagcagctatactcaactcagccagacaagccgtccaagactctccaaggggtcaggtcccagcactcaaaacccgtgagaatcctcgtaaaaaatgtgggggaacgggacggccggtcgcttaataatccacgacgatctgcagggcggctagccatggaggaccgagttttttttttaggcctttggactcgtggctatcacgagggcggccgttaacggttaccgcatgcgcgcgccgccccgcggcttcccaactccaccacaagggatcgggacgttggcgccgctgcgaaattgtagcggaaatcacggcatgtggagagggggagtaccggtggtggtgtgcgtcgaaatcgatcgcggccatgtggttttcaacctgggatgttttgaactgccccgatcgcgttttgagtcacatggctgccatgtgttgtgtccaaaagcacgggtttttttagtcgtgtgtactgctatcagcctgtcgtttttttccgtttggtcattacacgatcggttttctgataaacgttgcaaacgagagacaggtggataacagggatcgcgctgacaaattgcacttccttctagaagtagtacgtcgctccatttggctcatgaataagcaatgaacaactcatggcagccggtcctatgattctgagggccctaagcgaactcatcgcgatgggccctctaaactatatatataaaattttatgatatagagataataattttacttgcaaaacgataacaaatacaccatatattaaatttaacatgtctggtaattatgaagaaataaaaataacaatatatttgtaacttggaactaatatcattattcattaacttaatgaagaacaaaaccccatcatatccgttgctcccatgaaaagatacttcttcgggcatttcttgatgcaaaatcatcaataacggtattaaaatcaatagtgttcaagatatccttctcaattgagcacatagccaagccatttaacctttttttgacatagttaatctcaaatagttcttcaaaacttcaagtttgagaaacttctttcagctgaagctaccgtcataggtacagttaatagatttcgataggcaactaaaacatttggatagcaatctgcatccataacgaacttaagaatctcaggcgcaaacatcgaagaatcacacatttaattctgaataaaaaaacattgatctcaacatcggatgaggtactagactactagtattaggtgttggcccctccaccatcatgggctccggcggtcgcctcggctgcatagggccagggccggccctgcatggcagttgttagtaataaaagattttgttaactagtcctgaaaggcatagccgccgtaattcgtactacacggcagcacaaagtgttcccaggaatttccatccaccggtttctttttctcccctgaatttatctacgtgttcatgtactgctacaatcgccataattctctagtttcgtacacctgaaaccgcgatgaaaactcgttgagaaatacgcaagccgcaagcgcgggggaaggttctcaacgaagcccacgcagatgctgacgcagcgcaggcgtggcgactaagggcagccacggggcccaccaggtgagcccgtggccgtggggtcgggtactcgcgtgggcccacctggccggtcaaatcttgttccttcctccctttactacccgtcgtcgtcgtcatcttcttcttcctggtattcgctattcatctctgaccctgcggcgcaccaaaacccccgtttccgtctcgcgttcttcgatcgcctccgcttaaaaagctcgccgcctccgaccgaatccactccccccccatcaatcccgcaaccctaccgaaaccggtaaaccactggaagaaagcgggttcgatcgatcgatcttgctagtgcggctatatctgctagtaggtgaattggtcgctcgacgttggtgatcatggtggagaagacgaagctgcagctgccgctggtgcacaacgagcggctgtgggcgcggccgtggcggtgggccaagacggtgttcttcctcgtctccatgctcgcctcgctgctgctcgtctgcgcgccgccgctgctcatcgtcgtcctcgacctgctactcccgcccgcgctcctctccaacttccaccgcgccgcgaaccaccccacctcgctcatcgaccaggccaggggcttccacttccggtcatcgctcgtcgacctccccgccgtctccgccgcgcgctccctcctcatcctctgtgagtaaccccaccacgcaatcggtatcaagcgtatgtgcgattcgatgcgatccccttaatctttttttctgcgtgttcatcgatctcatgtcgtcatggtggtttggctgacgagcacttggtgggcgttgttgtgcaggcgcgtacacggcgtgcgggggaggcgcggcctacctgtgggtggccgtggcgtgcagcgtcggctcggtgtgctacgtcgtcgccaaggcggccgtggtgttcggcgcggcgcccgacagggccgtgctggggctgcagggcaagggccagctcgtcgccgtggaggccatgttcctcatgtcgctcgcgctcgccgccgcgcacatcgccatggcctaccgcgccagctgccgcgagcgacgccgcctgctcgtctacagaatcgacgtcgaagctgtaagtgatcgattccctttctttgctcgtatcgtatcaattgtttcttttaccgagtccatgtcacgcccgcacaaaacagagaaacaaacgattccgcctagctgtagcttgtagtgtggattggaaacatattaaacccaaaatatgcaagctttccagattccaatccgtgttttagagagattctgtagaacaatacgcttgccgggtgtatcctgtattgcccatttgcgcaaacgctttcggccaaatgtgatataggtaacgcgtcgacatagtcaaatagcgccatggaatctgctttagcccttgccgaccaagccgtgtactcccttcgtccaaaagaaaaaaaaaaagacaaaccttgggtttccgtgccaacgtttgactgtccgtcttatataaattttttttataattagtatttttattattgttagatgataaaacataattaatactttatgcgtgacttatttttttaatttttttcataattttttcaaataagactgactatcaattattggatacggaaaccagcgtttatctttttttttttggacggagtacctgtgagcaactgtgcgaaggaggtcctcgcgatttctgcattggagattcctgattcctcacgcacaaactagccccaccaaacttcttacctccacctgaaatttcagatagctacgagtaattactgcagtaatggtttactagctgaattgttcccacggtttaactggtaactgttgctctggaatgctgttaattagcgatttagtactggttcagtttttttcacatttatcattaaaaaatagactgtcaaatcactccaaaccgattagaatttgaaggaaaacccgcatgaagaagattagtctaacataatggcctgagcatattttccatgcgttggatgtcacagcctagtggaccgatcaggacagttctctagaaatatctggaaaatgcagccatccgtgtacaatgagctcaattgacatcacaactgcaattgtttaccctgtcactatccctcacatccgtgacagtttctagcgtgatattcatggccagggaatctacacgaccctgtcaaattttaactgtcacagtattgaacagggagaaaccccaactattatcttgaagtttctaacgattatttacccacaaaagaactgcattgaattgtattagttgccggaaataaaacagtttccaatagcatcttgctaatgaactctttgctggatcatgcaggtaaggctaaagggaggccaaacgcccaagtccctgaagcagcagttcgccgtatgacactcgctgcctggccgttgcagtcggacacaaactgaatgccacggcatggcagggccctgcagggttcgttcctccggtctcaatttttggttcaagtagatgtgtacaacacgaccgttcactgtacctcaagtgaaaaatagtgtaaagaagatgtaaatacgaaacatttgtgcttcggcctcctgcagtcaatgcaaaaataggatgagccgttcggcagatgcatgcttgtcatttttggtgggtttcccatttgtgagctgtgagacggagggggtggtttcgtcgtgtgaatttccacaggtgcgcatcggtgacgatgcacatgattggatcaattcgaatcatctggctatcaggtcgatatctctcccctgtgagagtggcacgtttgagttgagtccgtttcagaagaacgcgtctcaatcttaactgttttctgtttaaaataagtactaattatcttaattttttaaaaaagtactcctatctgaagcatttttgagccatctccaaactctattgcttaaacagagtaacagcgtatcttcgtttggaagatgaagatatcctaatacaatcagtcctacctcagtcctcagaccagcgttttgctattcataaatctataaaaattgaccagcaccggatctcatcaaaattataaaactatacaatactaatatacggtgacaaaaaaaaaagttactacaaggaactgctttgtataattctctgaattcgcaaggtcctcacatgatcatgtgaatggtcattaaccgtggtcaaatcaaacacaaatatatcgaaatttatcaggtagctccatatgaaagacgctgaagatttcttccatgtttcacctaactgatggaaaaaaaattctgctaaccgtagaaaattcagaccaatgatcaatgacgcacctgatgataatttaaaagtagcactgcccaattgaatcgatgctagcaagtcttctaaacggccaataagcttggcaatctagacccttgaccaaaggggtaaagaagactttgatttgcatacagcttctagaagtcccagtcagccttttccactagaggggccggttgaacggaaaccacaagtttgtgtctgggctactactaataattgtcaaatgtattaggaaaaatggaagatgcacaatgtgaaaaggatctgctggatttctggactcttgggtagcgtacacaccttgtgaataaatggacttggtttaccggcccaataccatagtactaggcccaacaagatgtcaaggttggatagagaaacaggtacagggcaagcaaactcaaaaatgaaattccactcgtactaacaaagatcgtctaaatttaaaagagctaaattgaagtaggcagtccatcattggatggagaaaaaggattaaccaatttaacgtaagagtgtaagacgctctttcatggaacgtcaaatactaacatgttatcagatttcagaaccaaaggtgtctttcgggggaaaaaaggggaattcggaatcaaaggtaacatagttaaatacaagaggggactaccctgtagttaagttaaccctcgcagaaaggggaaaaaaacagcactagcagctagtatcagccgtattaccagtgaggatatacagaggcagcttgaaaaaagcataggcatctgaagttctttccggcgcgaacgatgataatgatgggctgatggcttggaattacaatgctccgcatccacaaagtgatcgagtctaacaaaagcacgcatgctgtatatagccgtcggcagaaagcaagctatacacgcatagattgtgtgagatcgacgacctgcagaaacgcgacgaaatccagctgacaattaccgacatggatacactacttgtggccgaagcagacggttaattgtgaggctgcaggaagacgggtgcatgcatggacagcgtgtgtgcatcgtccacaagatgaaaagactgaagaagtggtcgaaggagatggtgagattgtagcacgaaaaggagcgtgttccccggcgcggcacatacgtcgtgcgagacagatccatcccccgttccaatccaattggcccacccctgtatacatctcctcgccgcggcctctccgacgagggcgacgtcttatctcgatcggtacatgcaccaagctagcttgccaagacttcgtgcaattgtgcatcgatttttagggtttgggtcaagacgttcgtgtttgtggagattatggataccctatatctacatgacagttataatttagtcggatatatggtaccaaatataaatagaatatctctatgaggacttggtagaatatctctatgaggacttgggttagattctaaacttgtatgtcaaggaaatatccgggatcttagtcggttacgattgtattttatctataatcccatattccgttaggatatggactgtactttgtaaagcggattccttcccctatataaggagggtccgtgtgcctctcggggcacgattcttttttccagtttatacaatcaataacacactcggcggaataatccccggacaggagtagggtattacttcttgaataagaaggcctgaacctgtataaaattcttcgtctccaaacccatccgctttcctaacttgatagccacccccttttactattgctgaaatcttgtttcgacagtgttagagatcgatggttgcatatgcgtgcgtttgcggagcaatatgtcaagaatgcgcgtaagccctcggacggagatcaaggcacatcaaagaagaaagatgatgaagacgatgccccgactggttttcaagatcatcgcaaagaactcaatcacatcttcagcggacccctggcttatgaatctaagagaaagcagaagtgtcacgccccgaattagtcccgaccggaactaacccgtgacgctccaaattaacctgttaatcgataccagtcccaggaaacagtgctggtatcacagggagacagaatatcacagcaacagaagtctcttcattatagagtagaagtacagtcatgttgggctgcggacagatcccgagctcacaactgcattacaaaaggaaagcggaagccaggacttggaccaaacaatcacaggcgcgacttgggaactaggctgaaaccctaaaactcatcgtagccggcttgctcctggaagaactccttatcagcaggatccgcttcatcttcttcagcaactggggggggggggaaatatttatatagagcaagggtgagtacgggagtactcagcaagccaggggaaataagtgtttaatgcaggcttcaaggaaaggctgttgttttttttttttgcaattgattttatttggaactcttttctaaaagcaactaagtgagtgcttctcaaacgacacggatgagacagtgcgtctcgtccggtcggagtatgtgcaatgtgtcagtctttagatcttgaaacaaggttggcacccggccaaaagctttttgaacggccacccgggccaactcttttcaaacggccacccgggccaacaacttttaaactgccacccgggcctagctgatcccatcagctgtaggttttccaaacatcgaacccagtttcacaacagcaatttcacaagcagtagtcaaacaaaactacgctaggaatcacctcacatccgcccatgaccgtgggcacggctgttcgaacagtttaatgacctctgcagagggggtacattttacccacacgacattactaacccgggtcacccagcccgtggggatcagccacgtcgggagacctccaagctttcatgacaaggcatttcgaaagccgatgcaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgttccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccgagtcttttgtaaaactccagttttacccaagttgttactcagattttaagtttgaaggcgaccgtcgatactcgcacagagtgcacgagtatcaaggcgcaactgggtggttacaaggggacatggcatagcaattaacaatggaaggatcaaatgtgacaatttaggtaagtccgccaatctgcttcgcagacgggacaacagattaagtgtgatcctatcaatgcataatattttgcaagcaacatacttaaatttcaaatataggctcaagatgttcaaaggtggcttgccttgctcgagatctggagcttgatcctcgaaatcctcgcactgcgggtcttcgggctccgaaactacatgcgaaacggggcaactcaacaaacagcgaaaataaagccctattaatgacctctaagcgtgccactagatagatctcgagatttgatgaattttggaatttgaacggaatcaaacggagttacggttgggaagatattgaatttctaagattattggattttggtctaaaggaaaaaggattaaattaaatcctttttttttggaaaaagaaaaagaaagaagggagggagggaatatagacttttctcgggcggctagggcgcggcccaaaagatttggggcggctcggccgagcttaacaggccggccggcccaagacggcccaagcgcgcgcgcgcgtgggggggggggagaggagagagagaccggtggaccgggctcaccacgcgcggtcccgggtgggacccgcttgttagcggctcggctcaccgtgcggagggagcacgcggcgcacgcgcgcgggcggggaggaacgcggtgtacgcgcgcggtttgcggtggacgcggatgcgacgggcccacgcgcagcctcacggctcgcggtggaacgcgcgcacggggagggaccgaccggggtcggctcgacccggtctaggctgagctggcgccgacgtggcgcctacgtggctgccacgcaggccggcggaaggtagacgacgacccggccacgaatggacggcgggcggcggcggcgagcggcggagcgaaccacggtgatacgggcaaaagcgagcacaccgggcggttgttcgcgacagggggaggcgagccaacggctcggattcgccggaggttgctcgacggcggcggattacggcggcggcaaccggcggcgggagaagagggaaacggcgacgaggctacgaggggtcgattcccgtcggtgagagcatctacgcggcttcgggaactcgacgctagcgtcggattgggcggaactacgccgagcgaggccggcgacgagcgggtgctacggagctcgggcggcgacggcggcgagcacacggcgagcgaaggcgacggttggggcggcgccggctagctacggggggtctactcgagctactaccgaaagctagggagaggagacggagcgaggagggagaacagagagagacatcaccgggaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcggaggacggcggaggcgagacagagcacggggcggcggcaacggcgcggagacgaatggaagaggaggggtaaggggaggccgggggggtttaaaggggacggcaatgtcggtttgagaaccgacttgcgcggtcaaggcgcgagctggcgctccggctagcggccaaattggtgacaggggggatgacgccggcgggaggaaaagggaaaaaggagggggagaaagggggcttgcccctttgccggatcgggaaaaggaggagggagcgggggcgacgcgccagggggaaaggagggctcggcctccgtcccttggcggcttgcgcgcggagtggcgggggccgggcgatgacgacggcgatgacggcggggcggtttggagcggagcggcgacactggcgacaggcgcgggcaggcgctgacgacggcggcgaccgggcggtcggccactcggcacgcgcgcgcgggaaaacaacgggaggcgcggtggtttgaacggcgcggctcgggcgacaggcgcgggctggcgggaccgggcggcatccacgcgggcgcgcgcgagcaactgcacgcggggagcggtagcgagggatggggagacggagagcgagggggcgctcggcgcggcggcacacgcgcacacgcgcgcgcggcgcgcgtgcgggatggagcggagcggagggagagaggcgctcggggcgactctcgcacgcgcgagcagcgtgcgggcgaggctgagcggggggggggggagcgcgccggggggagagagagagagggagagagagagagagggagagagagatgggccgagcggaattcggcccatcgaaccccgggggaggcaaactaaactttgcggagggattcgatttggaaggatttggattcggatttgaactcgacgatagatcggggattgagatcatgagatggcacgggcactagacaacaagcaaggaaacaaatttcgcaattagggtttttaagagttaattttcccgctaggcgccacgacggaacgggcgctacaagaagctaacagaacgggagatcaatgcggttcagcctaacacgccccaataccttcggtggtcagagatagcaattaagttcgaccgctcggatcatcccgaccgagtggtccacccggggcggtaccctctggtactagacccagtggttcgcaatgtcaagctccgacggactctcatcgatggtggcagtgcactcaacatccttttcgctaagaccctggacgatatgcagattcctcgcacggaattaaagccgagtaatgcactcttccatggtgttatcccaggattgtcagctacgccactcggctagatcactcttccagttaccttcggcactcaggagaattttcgcacagaaaacgtttgtttcgaagttgctgatttcgagacagcataccatgctatactcggacgaccggttctggccaaattcatggccgtcccacactacacctacatgatgatgaagatgcctggtcctcgaagggtcatatcactacggagcgacatcaagcaagccgtcacatgtgacaaagaaagttgcgagatgacccaaacccacgagatcactctcgctcgcgaagagatccgactggctgccaccacggcaagcgaaggagaggtgcctccgaccaagctgtcaaagaccgaagaaggcgacgacaagactaagaagatttcactagatccctccaatcctaccaaaactgctgtaataggcgccgagttagattgtaaataggaaagcgcgctcatcacctttcttcaaaataataaagatatttttgcatggaaaccatccgataagccgggtattcctagagaggtgattgagcactctttacatgttaaggaagacgccaaacccatcaagcaacgactccgccgttttgcacaggacaggaaggatgcgatcaaggaggaattaaccaagctgttggcagcgggcttcatcaaggaggtccttcatcccgactggctggctaacccagtcctggttcggaaaaagacggggcaatggcgcatgtgtgtcgattacaccgacctcaacaagtcttgccctaaagacccttttgggttacctcgcattgaccaggtggttgactcaacaaccggctacgagttactcagtttcttggactgctactcgggatatcatcagatccgactaagagaatccgactgcttgaagacctcctttattacgccctttgggacctactgctacatcaccatgctctttggattgaagaacgcaggagcaacttatcaacgcatgattcaaagatgtttttcaactcagataggtcgcaatgttgaagcttatgttgatgatgtagtcgtcaagaccaagcagaaggataacctgatcacggatttagaagaaacttttgcaagcatttgtgctttcaggatgaaactaaaccctgaaaagtgcatcttcggagtaccgtcagggaagttgctcggatttatgatatctcaaagaggcatacaagccaacccggagaaaatcaacgctatcctcaacatgaaaccgccaagctcccaaaaagatgttcaaaagctgactggttgcatggcggcgctcagccggttcgtctcacgactcggcgagcgggggatgccctttttcaagctgctgaagaagactgacaatttccagtggggacccgaagcacaaaaagcctttgaagacttcaagaaacttatcaccactccacctgttttggcctcgccacatccgcaagagccgctactgttatatgtgtcggcgacctcccaggttgtgagcacggtcctggttgtcgagcgtgaagaggaaggccatgttcaaaaagtccaacgaccaatttatttcgttagcgaggttttagccgactccaaaacaagatatcctcaagttcaaaagttattatatggtgtcttaattaccgtcaggaaattatctcactactttcaaagtcactcggccacggtggtcacatcgtttccactcggggatatacttcataaccgcgaagcaaatggacggattgcgaagtgggccttagaattgatgtctttggatatatcgttcaagccacaaacttcgatcaagtcataagctttagctgatttccttgccgagtggaccgagtgccaagaagatatgccagaggaaaatatggaatattggactatgcattttgatgggtcgaagaggcttacaggcactggagctggggtagttttaatctccccgactggagaaagattgagctacgtattgtggatacatttttctgcgtcccataacgtggcggaatacgaggcgctactccacggattaaggattgccatctctctaggcattcgccgattaatcgtccgtggagactctcagttggttgttaatcaagtcatgaaagagtggtcctgtttagatgataatatgactgcttatcgacaagaggtacgcaaattggaagataaattcgatggacttgagctcacccatgtcctctgacataacaatgaggcagccgacagactggccaattttggttcaaagcgggaggcagccccttctgatgtttacgaaccaaccatacccagaaaagaaataattgaagccatggatactcaaggcgtaagcatgatcgaaaccgactggagagaacctctcataaaatttttgaccaagcaagaactccctcaagacaaaaatgaagccgagcggatttccattcgtagcagactttacattattcataagactgagttgtacaagaaaagtccatcaggaatactgcagcgttgcgtgtctttggaagaagggagacaattgttgaaggatatacattctggtatttgtggtaatcatgctgctgcacggactattgtcggcaaagcttaccggtagggtttttttggcctacagctgtgtctgatggtgacaagattgtgcggacatgcgaaggttgtcaattttttgccagacaaattcatctgccagcccaagagttgcaaaccatcccgttgtcctagcagtttgcggtctgggggcttgacatggtcggcccatttaaaagggcagtcggcggttacacgcatctctttgtggctatcgacaaattctccaagtggattgaggctaaaccggtcatcacgatcacagcagataaagctagaaattttttcatcgacattgtgcatcggtttggggtacctaatcggatcatcactgataatggcactcaattcactggcggagcatttaaagacttttgtgaagactttggcattaaaatttgttatgcctccgtggcacaccccatgagtaatggacaagttgagcgcaccaatggcatggtacttcaagggataaaagcacaagttttcgaccgactacgtccctatgctggcaagtgggtcgatcagctgccatccgtactttggtctttacgcactactctcagtcgggctaccggacagtcgccgttctttttggtttatggtgcagaagctatgtttccatgtgaagtggaatttgaatcactacgatttcagaacttcaacgaggagcgctatgaagagggccgagttgacgacatcaatagactagaagaagcccgtgaagcagctttaatccagccgactcggtatttgcaagggttgcgccgttatcataatcggaatgttcgatcacgagtctttttagtcggcgacctggttctgaggaaaattcaaaccacacaggatcggcataaattatctcccttatgggaaggaccgttcataattgctgaagtcactcggccaggttcttatcgactcaagcgcgaagatgatactctcatcaacaattcttggaatattgaacaccttcgtcgattttatgcttaggcatttcgtttgtatctttcctctccgactgctaacttcaagtttttccttgaagttttcagtcggggggctactatgataataatggagtatgatttttatcaattcaatttgcttacttgatttatcattgccctgtttggtctttcggcttagtcaatgaggactgaaggtttttaatagcttttgcgggttttaggctcaataaggcttgacaaaggcttttaagaaatcagaagctaagtatggaactccaagcatagcataaattcatcagtattgtacaaattgagcctccatcatcattaatcatcaaaatcattgttatatcaatcaatatcagttttttcatcatcagaattatcagacccagtcggccgaaggtcgacatcttgaaatctctcaaccacgtcggcagcaatcttgtcagctgctttttgcgcatcattgatgaggtcaagagcaacttcttcgctcgtcccgtctgcaaagccatcaatggcatcaatgtccactcttggataaagggatttggtcatcgccaacgccagacttgctcccatacttccagcttctttgatattcttgaagtaagtatccggagtgactctcagcttgtcaaatatttcggcagcatcaagtgtactcggaccggcgttattgaagaacatggcttggatgagtggagtagcggcattagcgactttatccctggccccttcaagcctattgatcttgtcaactaagacatcaaactgtgcctgggacttgatcttgcggtctgcatcaacagattcacattaacgaatcagcatatagaagataatggcttttaaggtattgattattggtaccttcaacctcctttaaagctgagtccctctgtcttgccagttctgccttaccattttccagagtttgaatctgcttctccagttgagatatcttggcagtttgcactacattgactctagttaatcaagattacaaagataataacataagttagttgggcagagtttgtgtgtaccttttgatgagccgctcagttcaaaattggatttctggagctcagcaatccgatccctcagatcatgttcattcttcttggcaagctcttttgtttcgtgcagatgattcctggtggcttcgagggtcccgagatgagggactaacctctctaaggttgccgttttagcttcgttcctaagatgaatcctctgcaagacagtttaattagcacctggactaaatggcaaacgagacggttgagatcaggcgtcaaagagcctacatttacaatgcgggtggcttggctgagtgcctttttcagcaagcatacctcttcatcttctttttgcttatttattacgattccttgaggctgcatgttgtcatcccaccacttgaccagaatgggagggcgcgaatcctcagctgcttgtatccggaggatctcttcttcatcaccaatcattggtcctaatgtatccatggataacgatcaaacaatcaaataaagtcagttagatcaacgtggtttcagacaaagtgcttacccgtgataatttctggatgaggacgagtggactcagatgcctttgaaggagatccagaccttcggtcgtggctggcatcttgaccgcgaggactatctgcttgagctccaacttctggaatctcttggcttggcttggtgtccgactggttttcagtcgggggctcctgattaattccggctccagcttcggccgactcatttccggtcgggggttgatcaccagactctacattatcggttgctggctggttgtcactcagctgatcctcggcagttggctcggttccttttaagttcgtttccctgctggtcggctcagaatcttttccagaaggatctatatcagatggtttcctgcaagtttgattatcagtattatttcctcactgggtgtgcatcaatgcaagggagatcgttatatgagttgtacctagaagacttcctgatctttggcacaggacgactggatgttttttttccttggagtaacctgcttcagcagtttcttggttgcctctcggtctctgagctttctagcagtgtcgccttcgtcgtcacttagaaccagcttcctcttgcgagaatctggctggccgattggatcagaagcacttagttgagtttcagaccgaattcttggtcctccgcttccctgaccagattggcggcgaggtgattggtgctgggaaattggaggatttgacttcatcaatgcgaatttctgagcataaatgtcaagcaatttaacgagagatgaaatcatgtttttgaggaaggttggacgtttgaatacataccggtggaggaggattgaatgcattgaacggtaagactggcaacaagtgtgaatagctggcaacaatagcatttgagaagatcttatatatcctttctttcataaccttaaagttaagagagtctggatcttcacgatttggatcatgtttgccgtcaaactcaaaagctgtgcgggacctctctttgattggggctaaccgacacttgataaagtgccgggtgatctgttctccttgaaggccttgttcttttagctttatcatcctctccatcagttccactgcttgcgcagcttcatctcccgttggcaatgagttccaagtatcctgataaactggaggaagacaggagtattcggggagagcaggctcagggttttgacaataaaaccaattcacatgccagcctttgtttgaggttttgaagggcatagagaagtatttttggcttaaggttcccctgagttggaaaccagcccctccgacaacacatggtttgctcttgtttggctgaggcttaaggaagaagatacggcggaacaaggcaaaatgaggcctaatgcccagaaaagcttcgcagacgtgaataaaattggcaatatgcactatggagtttggattcagatgatgcaggctgattccgtagaaattcaaaattccccgaaaaaatcttgaggttggaagggagaaaccgccatagaagaaatgagcaaataccacgatttcatgcgtatcaggggtcgggaatgcttcgccgaatgccggtcgccacccgatgatctcctttgctagaagaacgccgtgcgccaacatctccttcagattatcttccgtcacatcagagggcgcccactgactctcgaagctttctcttttttccgccatgaatgtggactggatggtttgatttggtccgagatacggctggaaagggatggggaatcggagcggtggacgcggggagaaattccgtgaactttttgaggatggattggagcggattgataaaccctagtttggccggcgcagtttgtactgtagcaggaaatggggaaaatggcgagagtttcggtggggaagacgaagagacgtttttcacttcggtgatattagggtatcgggagtgctaacaggcctgggcctgcacagtacttcagcctaattttatttccgacgtggcccgttgtgatccttagagacttaggcactttttgctttggcaatttgtgctcacaatgatgtggcccaatgttgttgaagaattggatggctacctcaactcccccggcgtcagttctcgaccaaccgagatcctcgactacgacgacttcggctaccactacgaccacggcgaccccgacaacttcgatgacggctatgaggacaactacacgcccctcttcttcggcgtattcatggctgacaacgaaacggaggaatagcgtcgagcccgagaagcgaaccaagatcgcgaacggcaagaagctgaacgtcgccgactggaggaagagcgacagcaataggagcgagaacgactacagcgtgagcaacaagatcgcgaacggattgcaaaggaggctgaagatcgacggcaacgcgccttggaatctgggcggcgagcgagagagctcattgggcaacaagacgtcgatggaacaacggtctttcgcacccccccagcagaacgcggttgcagcaatcactctcctcgacaccctccccaaggaagacgcactcaaccaagctgatcatgttgtcaacatcttgaaccagacgaagaccatgatcgctgcctcggttccagccaactctgcaagcacccgcaccccgactggtagccgagtccctaatcttcgatctcaagactatcaccagccaagcctcagcattgccggcgccggatctagtcacaggagcaagggacatgatgaacggtctgtttgttcgcctcccgaacgatatagggagcgtcgagttgaacgaccacactccccacatcgaaggcgccccatcgatcttcgcgacaccatcaaccagcgccgtgcagcaagaggccatcattcaccggatcgctacgacgacgatgtggacggagttgctgccttcacaagcgatctgcgtcgagtggattggccagccggctttaagccaactggaatcgagaaatatgacggcaccaccaaccccgagtcttggctcaccgtctatggtctcgcaatccgcgcagcaggaggagacaacaaagccatggcgaattatctacctatggccctaacggattccgcccggtcatggctccacgggctaccacgcggcacgatcggatcatgggcagagctacgcgaccacttcatcgccaacttccaaggcacttttgaacggcctggtacacacttcgatctctacaacatcattcagaagtctagagagtctcatcaagattacattcgacgcttctctgagcaatgcaacaagatctccgacatcacggacgacgtcatcattgccgcctttactaaaggcattcgccacgaggacctagtcggcaagtttggatgcaaacctcccaagacggtcaagcagatgtttgaaaaagccaatgagtatgccaaagccgaagatgctatcacggcgtccaagcagtcgggcaccacttggaagccaaagaaggatacgccgaccacaggagggagtggaagtaacaaccacaaggatcgcaagcgtaagcccgaagaacttgtggcgacaacctctccgtcttcccgacaacgttcccgcgtcaacaccttcgacaagataatgaactcccaatgtccgcatcatcccaactccaaccacgtggccaaagattgcttcgtctacaaacagtttgcggagcaatatgtcaagaacgcgcgtaagccctcagacggagatcaaggcacatcaaagaagaaagatgatgaagacgatgccccgactggtttttaagatcatcgcaaagaactcaatcacatcttcgacggacccctggcttatgaatctaagagaaagcagaagctaacagaacgggagatcaatgcggttcagcccaacacgccccaataccttcggtggtcagagatagcaattaagttcgaccgctcggatcatcccaaccgagtggtccacccagggcggtatcctctggtactagacccagtggtttgatgaaccctagtttggccggcgcagtttgtactgtagcaggaaatggggaaaatggcgagagtctcggcggggaagacgaagagacgtttttcacttcggtgatattagggtatcgggagtgctaacaggcctgggcctgcacagtacttcagcccaattttatttccaacgtgtcccgttgtgatccttagggacttagggactttttgctttggcaatttgtgctcacaatgatgtggcccaatgttgttaaaatcttttttaatgtggtttgataattctttagaattaacacgatgcaaacaaaaggtgcccgacagaaaggtgttataccgtttttgtaagcttcattaggctgcaaaagctgtttgggttgatttgagatgactggtttattaatagtcattcttttagcatgttatatgcttattttggttatggtaagggtcacagcctaggctattagactcattaattaccatgatttttttatcatgtttggtggatcattttaagagtttcttactcggattcctatcaaatatgtctatttttggaccttttgagtgtttatcactcggtccttcttgtattttttgtccttgatatattcaagttgagaagcagtcggctgggtatcttactaagtaccatgcgtgcttcgctataaaaccactcggttctttattatatgtttagtttttcaactaaacacatagtcgggggctacacctaattaggtgcatctactcgatgcaccatgttttattttcgcccttcgcagtctttgattttagcactcggcaagctggagcaagttgaattgaagcactcggattactgttttttgtttcgagaaggctattattgtcaactgcgaaggtctcgggggctactgtggagattatggataccccatatctacatgacagttataatttagtcgaatatatagtaccaaatatagatagaatatctctatgaggacttgggttagattctaaacttatatgtcaaggaaatatccgggatcctagtcggttacgattgtattttatctataatcccatattccgttaggatatggactgtactttgtaaagcggattccttcccctatataaggagggtccgtgtgcctctcggggcacgattcttttttccagtttatacaatcaataacacactcggcagaataatccccggataggagtagggtattacttcttgaataagaaggcctgaacctgtataaaattcttcgtctccaaacccatccgctttcctagcttgatagccaccccttttactattgccgaaatcttgtttcgacagtgttagagatcgatggttgcatatgcgtgcgcaccggcagagatcgagacaatgttaataagtttgtgcgtgcgtgcgtgccccacggtcgttgaactatgtggctcctcttaattctgcacgggagaacagcaattgcgttgcgatcttgcctggaataacgctgtacggtgatggatcgattcactgttagcgctgtgtgttcttcatatcgatgtcggtgccgacacggacatctcacatcgctcttgtacgtactactcctatgtacgtaccctgtgagagcttttgtaacgtgaggctggttccgatcgaacgcatggtcacgtactagtgtacatgacctgatggacatggatatattgtcccctgtctcattctcgtatagtatcaccaactctgttttgttaaggatatactatatccgttttaaaaaaatcaacatagaaagagatgtgtcttctcctataacaatgcatctagacacggttataggttgattgatgtgacttctcctataacgatatatctggacatggttttaggttgattttttttacggagagagtatagtactccctccgtcccaaaaaagacaaaccctggtttccatgtccaacatttgaccgtccgttttatttgaaaaaattataaaaataagtgacgcataaagtattaaacatgttttatcatctaacaacaatgaaaacactaattataaaaatatttcatataagacggacagtcaaacgttggcacggaaacctaagatttgacttttttttttggacggagggagtactatgcaagtgcagataaaatcgattaatcaatctatatatatactcggcgtgcgtgttagcttggcatagaaatacatcgtggcaggacaggtgtcgcaccagctggtgcaggccggcatctaggaggccaggatgggatcatgggagtagcacttttaaccgcgcaatcgtgcataaatttgaggcgagactgccgcgagaggtcaggccaatacgcgctaggtaataaaagtcgcggattcctcacccagttgcattagcgcctgcgtcgtctcttcacgtttggcgtcacggccgggtcccgccctgattgacgaagaatactccttggaattgtggtctcctgctattcgctctacgtacgttcccatcttgttggagcgcggccgactcgtcatgcgtagcccggtcgctgattactgcagccacgacgacgattcatgtatacgctgcttgaaaaattctgcttgtgctacctacctgctcgaccgctgaactttcgtccaataccctgatagtactagcaccttgctttgcaagttcagtaatcactagcttcctccgttatatttttttctacatagtgcaacgaatctagccacgcttaattagtcgtgttggtgtttttttttctgccaatacataattcacctaaatatttgcggtgttaacagagtcaccaaccatcttctacatcaagatgggttttgaagattaaaccgataagcggagcttgtttagagatcaaaccagcatctaggctgatttatatcgatttgaagataaccgccggtctcgtgggcgaatcggaaagtttacgggacaaaccaataaagatgtatcacactctcacagcgaaaacgaatgatttacgaagtaattgataaagatggactaaactagggaaaaatagaaggcatagctaaaaagtaaaggtaaaaaaaattcaattgattatgtagggattgaggtcgggggttaaaattgaactggtcatagctcttagaaaggggttggttatgcctccacagtttttcttcacgtcctattaggcttatagatcagtgttgggggaatggctccggatgaaatggctagccttcgaagggcttgcagggcttcgaggagccattctccccagggagatgacctagggtgaatactaccttggagctccgaacggagcccccgctccggagacaaccaaggatcccggagagctgtcacggcttcgaaagccacctcgagctccagagcccaacgaggcttcggaggctgcccatggggctccggagatggtcaagaactccggagcatctgtggcttccggagcctcgcgagggcttcgcatgccggcaaggtttctggagctagcagcgtggcccggagggaatcaaggctagtttgaggaccaggcgctagtgggttagaatgaatgcgcactacgcgccctaactacccctgacaccattgacgatgacgagacggcgcacgctattacccggagcaggcctttatccggttaatagtgcgcaccctcgggaataggtgccgctcccttatggggcgcctcactcctatcaccgggaattttactaatagcccaagggctggccggggccagccactctagattcactataggaccaagggcaataaagaaatttcttcttgtatacccttgtataaatatgtaaacattgctcacagttaagcacattaaatacagaggaatacacatgcacttgttgagttttgtcccaacaatcagttaggactcaagaatccttaagcccaaataagaaaacccaagaaccaacaaatcaaacttagagtaatcagactgggcccacaccatcggtccgaccggctatatgagagcgatcagactggccacatatggtaaattagggttttttttttcaaatctgatcatgtttctctatttttttttgaatgactatgtttttctatttttcatctgaagtgttaaatttaggtgtattaacacgtcatattaagatatgtctaatattctatagtaggtagtaacattttgaaagagatgcagtatatatagatgatgatgaaagcaagctagcgacactggacagtgatactgatacgtacatcggctatggaacaaatcttgtccctcttgtcctctgcgaagatgacacttgtatgtgtagtctcgactactgcacactgtaggctgcgcaaaacagcagaattcagagataaccggtcgtgttcggttacaacgtgcccgtacccggccgacgacgactacagtattgcttttcctaatgtcaaaatacatgtacagtatttgagatcgcttacctagctacttgcacgagaggcctaggaagtgagtattgtaggtctactagtttgcgcatgcatgcatgcactgttttgacagttaggcataggactagtatgtactgcacacggctcatctgaagagaatggatacaattaagtagtggctttatgcttcaaagtaacacgggatatgaagcaaacacagcaccattcaaagcccagatatcagaactgtatggctttactatttggcacagaaaatttcctgattggctatagtgcattagtgcatgctccctccgtcccacatgaaacaaacataggacttaatgtgaaacaacgaatttgaatagtcgtacgcatattcagattcgtagtattatgatgtgtcaaatctagtgctagattgttttttatagacatagggagtactccctttgtccaaaaagaatcaaacatcccctcttaggacaatgtatgtggacatactcatatccacatatatcaacctaagagaggatgtccggagtcacattctcttctaggttttcttttcgggacggagggaatatggagtaccagtacagtagcctatatggctatatattgtgcagcacactgcagcatgacgtgaatccttaacctatactgcaggtagctcacgtgagtgcagagttttctgcgtgacatacagtatgagagaggaatgatacaatcatatactaatagagaaaccggccgaacgtacggtttcgtccatttcttttctaatgagtacaacatccaagattgagaccatgcaattttctcaatatcatcgaaaaatatacggctagatcaggctgagcattgtagatttgtagtaagttaaatataaccaatctccagttctcaaaaaaagagagaaaattctcctaattaacattgtctcttgcgctattgtaaccatgtttacttgcaatggaatgtggaaccaaggagtagctagtatccggcagggccgttggtagtatagaagagagacaaataagaaagcaaagctagcaaaggtggacgagatgttgatggacccacaaataggcatggtcccaccgttctttttttttgcttgttttaattgtaattagttggaaatgtggaccacccttttcccagttggcgccaggtcctacatctggaatattttgtggggtgtggacaattggagcacatacgctttttagtgttttttctttaccaaaggataactctaaacgacatatttctcgttctttgcaagtacatttcaccaagtgttaaacattatatcgtgtaaaaattttctatacaaaaattcctttttgacgtgtcaccaaaaatcctagccagacagccacatcaaactcaccttaaaagtttcttagtagttttagaatggttatattctacaaagtttaagaaagatttatgtacagttcataaacattgtcatcaacttaatttccttactcctttactccaaataggacgagagaagatgcatgtacgggcgaaaacttaaaatggataaggcttggtcttctaaaaagttttatgcgcaaattatactcttacgtactttacatccatacatagcttgatcaaaatttccatacacaagcaagtgttgcaaacaacttctaattaagcaaacaaaagacacatagccccaaaaaagggatagtgatgccatgtattggattttgtcagctattaagacgaatgatcaaacgtatatgtaaaagttaaatgttgtgattttttttatagcaaatcaacaggagaggctaacactacactaatatactccatcagtttcgaaatgtttgacaccgttgactttttagcacatgtttgaccgttcgtcttattcaaaaactttttgtgagatatgtaaaattatatgcctacataaaaatatatttaacaatgaatcaaatgataggaaaagaattaataattacttaaattttttgaataagacgaacggtcaaacatgtgataaaaagtcaacggcgtcaaacatttcgaaatggatggagtattaaaatacaatatgtacaaaatatttacaggttatattacaacaaagagtatttccacctcttttgctctgtgcgtatggaaaggaaagttttccttgaaatcctttttccaaagaaagaaagagatctgaacatcatggaaaattagagcatatcttctaaaccaaatattccagcaatatattcataaaacttcttgtcgaaactagatttcggcaataataaaagagggtggctatcaagctggaaaagtgtatgggtttggaaacaaaggatttatacaggttcaggccttcttattcaagaagtaataccctactcctgtccggggatgaatccgccgagtgtattattgattgtatgatttggagaaaatcaacatctctgcccctagaggcacccggaccccccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacaaaagcatatgcggcgcataaagaggcattctagccgactgctttttagccataataaaaagaatccgaatggttaacactctaaaaggttcacgaatgaacacacttgacaggcatccgaataaaaaactctaaagattacccaccaaatattataaaaattatggtaatgaataagtctaatagcctaagctatgactatccaccataatgaaaacaggcatatgtggtgtaaaatccgagtaaataaactcataaaggatttaccaaccgcctaaaaaaaatgactacaatatataatcagcctaagccataatattggtcaataaaaacgcacacttacgtggcaaagagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacgtgacaggccacacctgaaaattcgcattgcaataattccgaagaattatatgaccgcgtaaaaaaggattttatcagcattggacaacactattgtgcgcataagttgccaaagcaaaaaatgcctaagtccctaaggagcacaatgggccacgctgttaaaagtattgggctgaggtactgttcaggcctaagcccattcgcacctccgatacccttaacaaaaaatcccgtgatccaagcgccacttcgtcttccccgccggaactctcgccattttccccactccctgctacagtacggagctgcgcaggcaaactagggttcaccaatccactcaaatccaccttcgaaaagttcatcaaaatccttcccgtaattcaccgcctcaatccctcacctctccctagccatcccccgaatcaaatcagcgcattcgggtaaaatcaatggcggaagagaaagaaagctttgagggccaatgggcgccatccgacgtgacggaggagaacctgaaggagatagtggcgcacggcgttctccctgccaaggagatcatcgggtggcggccagcgtgcggtgaggcttttccgtcccccgatacacacgaggttgtggtcttctctcatttcttttatggcggcttcgctcttccgacctcgaaatttttccacgggatattaagcttctatggaatcagcttgcatcacctaaacccaaattccatagtccacatcgccaatttcatccatgtttgtgaagccttcttgggaattaaaccccacttcgctctgtttcgccgaatcttctttctcaaaccccaaccaaacaagagcaagccatgtgtagtcggaggagccggatttcagctgaggggaactttgagccagaagtacttctcaatgcccttcaagacttcaaacaaagggtggcatgcgaactggttttatgttcagaatcctgagcctgctcttcccgagtactcttgtcttcctccagtgtaccaagatacttggaactctcttccgattggggacgaagcagcccaagccttagagttgatggaccgcatgctaaaactcaaagaacaaggcttacaaggagagcagatcactcggcacttcatcaaatgccgactggcgccagttaaagaaagatcccgtacagcttttgagtttgacggcaagcatgatcctaatcgcgaagaaccagactctctggattttaaaatcatgaaggagagaatgtataaaatcttctcaaatgctattgtcgtcagctactcacatcagctgccagttgtgccatataatgcattcaatccacctccgcaggtatgtatctgaaatcttcaacctatgaccaaaatagtatcttgtcttcatgttgagttaactaaccatggaggcatcttattcaggaatatgtattgataaaatctgatcccccaatcactcagcgccggtctcctcgccagcacaccgttcagggaggtggagggccaataatcagaccagattcgcaacctcaaacctccaatccaactggacagacaggttctcgcaagagaaaactggtgcttgacaacgatgaaggcgacgacgacaacaaatctggggacaagggctcgcctaataaactctcgaagcgtaccatgcccaggaaaaaactggctggccgtcaaatgccaaagattagaacatcttccaggtataaacctctcggtaccatttccctttgacatgcttctctcatagaaattatactaaatattgaaagaacactttgcaggaaaccatccgacatagatccaactggaaaagatcctgatcaagccgtgacagagccaaatttatccaaggatcctgagccaactgccgaaagccagccgactggtgcccatgcttcgggtgataaggccgatccgagtgaccagccgccgactggaaaccagtcgacagcagctgaaactgcaacaacccaagagcccccgactggaaaccagtcggatgcaggtcccgatcaagaaatccctgaagttggagcgcagacgacaacttcccaaggaccagagactagtaaagactcaatgattgggtctccaaataaagaacaagggtcacctcacgctcagctaggaacatcctcaggtaactcatcttctcaagtgataccgatttaaataactccagtttgtttgcctaatgtcttggaaatacatcaggaccaccgggcgatggcgaagaagaaattccccgcataaaggcggctgatgattctcgtcctcctatcttgctcaaatggtgggacgagaactcacaggttgccggcatcgtcataaaccgtcaaaaagaagatgaggaagtgtgccagctgaagaaggcgcttggggaagccactcgtattgtgaatgtaaatctttcaggcgactgcctttgatgactttgttttctttttagcagaactaaaccatgaaccatcatgcagagaatccatcttcgcaatgaggccaagactgcaactttagaaaagctggttcctcatttgggaactctggaagcagttagggaccagctacacgaggccaaggagcacgccaaaaagacagagaaggaattaagggaccgaattgcccagctccaggattcaaacttcgagctgagtggttcatcaaaaggtaatcttctagatctgtcccattaatttgtactgtcataactgtatcctcaaacatttggatttcaaacagcgcaagccaccaggatggctcaaatggagaaacaaattgaagccttgaaaaaagacaaagtagaactggctgcgcaaagggactcagccttgaaggaggttgaaggtactaccagctaacaatctggacttctctcttttaaatacagcagattcttatcataaatgtgttttgcagactgcaaaatcaaatctcaagctcaatttgatgtcctggttggtaagatcaagaggcttgaaggagcaagagatgaagtcgccaatgtcgctacaccactcgtccaagctatgttcctcaataacagtggtccgagtgcactcgacgcaaccgaaattttcgacaagctgagagttgctccggatgtatatttcaagaacatcaagaaagctggaagtatgggagctagcatggcattggcgatgaccaaatcattgtacccgagaattgaaattgacgccattgatggctttgcagacgggacaagcgaagaagctgctcttgatctcatcaccaatgctcaaaatgcggctgacaagattgcaagtgacgttgtagagcaattccgcaacaacgaccttcagccgagcaacaataactctgatgatgaaagaactgattctgactgagtatgaatgtaacaaatggaggctcaacttgtacaatactggtgtatttatgctgtgtttgataattctagccaagtctttgatttcttaaaagcttttatcaagctttgttgagcctaaaacccaaagaagctattaaaaactttcagtcctcgcagactaagtagaaaaaacaaacaaggcaatgatagaccaagtaagcaaattgaattgataagtaatcaaactccattattataatgatagcccccgactgacaacttcaagaagaaaacttaatgttgacagtcaagatagggaagtacaatgataagcctaagcatagaaacgacgaagatgttcaatgttccaagagttatcgacgagagtaccgtcttcgcgcttgagtcgataggaacctggtcgggtgacttcagagatgataaatggcccttcccatagaggagataacttgtgccgatctcgtgtagtttgaattttcctcaaaaccaggtcgccgactaggaaggcacgggatcgaacattgcggttatgataacgccgcaacccttgtaagtatcgagccgactgaatcaaagccgcttcgcggacttcttccaatcggtgcaagtcatccactcggtcctcttcgtagcgttcttcacggaaatttcgaaagcgcaaagactcaaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgccttaatcccttgaagtatcatgccattggctcgctccacctgtccattgctcatgggatgcgctactgaggcatagcaaatcttaattccaaagtcttcacaaaagtctttaaaaactctgccagtgaattgtctgccattatcagtgatgatccgattgggcactccaaatctatgcacaatgttgatgaagaagtctcgagcgttatctgctgtgattgtgataaccggtttagcttcaatccacttggagaatttgtcaatggccacaaagagatgcgtgtaaccgccgactgcctttttaaacgggccaaccatgtcaagcccccaaaccgcaaacggccaagacagtgggatggtctgcaactcttgagctggtagatgaatttgtctggcgaaaaactggcaaccttcgcacgtgcgtataattttgtcggcatcggatactgcagtaggccaaaagaaaccctgccggtaagccttgccgacaatggtgcgtgcagcagcatggtttccgcatatcccagaatgtatgtctttcagcaattgtctcccttcctctaaagatacgcagcgttgcagaatccctgaagggcttttcttgtacaactcagcttcatgcataacataaagtttgctccgccttgaaatccgctcggcctcatctttgtcttgggggagttcttgagaagtcaaaaatcgtatgaggggctctcgccagtcggcttcaaccatagctacgtcatgagtgcccgcaacttgagtagcatctttgtgaggtactgtcggcgtataaaggtgttcgacgaaaacatcggagggtgccgcctcacgcttggatccaaagttggcgagtctatcggcagcttcattgttgtgtcgaagaacgtgactgagctcgagtccatcgaacttatcttccaatttgcgtacttcttgtcgatatgccatcatgttgtcgtcaaggcaggaccactctttcataacctggttgacgaccagctgtgaatcgcctcgaactattagacgctttatccctagggagattgcaatccgtagtccatgaaggagcgcctcatactcggcgacgttgtgggacgtcgaaaaatgtatccaaagcacatagcttaatctttctccagttggggaaattagaactactcctgctccagtgcccgaaagtcgttttgacccgtcaaaatgcatggtccagtgctccatcttctccgcgggggtatcctcctggcactcggtccattcggcgacaaaatcagctaacgcttgggacttgatcgaaattcggggcttgaatgatatgtccaaagacatcaactccaaagcccacttagcaatccgtccgtttgcttcacggttgtgcagtatatcaccgagtggaaatgatgtgaccaccgttaccgagtgaccttgaaagtagtgagatagcgtcctggtagtaattagaataccatataacagcttctgaacctgagggtacctcgttttggagtcggctaggacctcgctgacaaagtaaatcggtcgctggactttctggagatggccttcttcctcgcgctcgacgaccaagactgtgctcacaacctgggaggtggctgatacatacagcaacaacggctcctgcgggtgtggtgaggctaagactggtggctcggtgaggagcttcttgaaatcttcgaaggccttctgtgcttcgggtccccactggaagtcgtctgttttctttagtagcttaaagaagggcatcccccgctcgccgagccttgaaataaatcggctgagcgccgccatgcatccagtcagcttctgaacatctttctgggtacttggcggtttcatgttgaggatagcaataactttctccgggttggcttggatgcccctatgagacaccataaaaccaagcagcttccctgacggtactccgaaggtgcacttttcagggtttaatttcatcctgaaagcgcggatgctcgcgaaggtttcttctagatccaaaatcaaatcatccttttgcttggtcttaacgactacatcatccacataggcctcaacgttgcgaccgatctgtgttgagaagcatctctgaatcatacgttgataagttgctcctgcgttttttagtccaaacggcatggtgacatagcagtatgctccaaagggcgtgataaatgaagtcttcaagcagtcggattcctttagtcggatctgatgataccccgagtagcaatccaaaaaactgagaagctcacagccggcggtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtctttcctgtcttgtgcgaatcggcggagtcgttgtttgataggcttggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagaaggatctaggggaatcttcttagtcttggcttcgctttctccactttttgaagtcttggtggcgggcacttctccttcgctcgccgtggctgcagccagtcggatatcctctcggacagacgtcatctcgcgggtttgggccatgtcgcaactctccttgtcgcatgtgacggcttgcttgatgtcgctccgtagggataggactcctcggggaccgggcatcttcatcatcatgtaagtgtagtgcgggacggccatgaacttggctaacgccgggcgtccgagtatggcatgatatgctgtctcaaaatcggcgacttcaaagctgatattctctgtgcggaagttttcccgagtgccaaaggtgaccgggagggtgatctggccgagtggagttgcggataatcctagaattactccgtgaaaaggcgcattgcttggttttagctcggagcgagggatctgcatgtcatccaaggtcttggcgaagaggatattgagcgcactgccaccgtcgatgagggttctgcgaagcttgacattacggaccactgggtctagtaccagggggtaccgccccgggtggaccactcggtcaggatgatccgagcggtcaaacttgattgcgatttctgaccatcgaagatactggggcgtgtcgggttgaacagcattgatctcccgttcagtcaacttttgcttccgtttagactcataagccaaggggccgccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagctggcgtacccttatttggcttccaactaggacccgactgctttgatgcggtgacggcgtcttcagctttggcgtactcgttggctttttcaaacataagcttgactgtcctgggaggtttacgcccgaacttgccgaccaattcttcgtggcgaatccctttggtgaaagcggcgatgataacgtcgtcggtgatgtcggagatcttattacgttgttcagaaaatcgccggatgtaatctctaagggattctccggacttctgaataacgttgtagaggtcgtattgtgtgccgggacgctcgaaggtgccttggaagttggcgatgaagtggtcgcgtaattcggcccaagatccgattgtaccacggggcaatccatggagccaagatcgggcggaatccgctaaagccactggtagatagttcgccatggccttgctgtctcctcctgctgcgcggattgcgagaccgtagacggtaagccacgattctgggttagtggtaccgtcgtacttctctattccagtcggcttgaagccggctggccaatccactcgacgcagatcgtcggtgaaggctgctactccgtcaaggtcatcgtcatggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaaccgcccgtcgtgacccctgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtcggtggggcgcgagtcgacggtgggagagctgtagtagccgtccaactgatccgtcgaaaccgtgccgagtggttggaggatgacgccgacttccctgaagctaggcgaaatcggtgttgaagccgacttccgcctaggcctacgggatgaagacgctgtcgtgatggaggcggccgccgaatcgtcggggagcttcattaggatcggtgggtaagccccatcatcttgatctggtgtcgttggagaagatgcgatctcgcccgagtggtttgaagccaactcgattgagatggtcttgaagtaactttcagccgcgtttgggagtccaaacgggactgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctccccctacctggcgcgccaactgtcgaaactagatttcggcaataataaaagtgggtggctatcaagctggaaaagtgtatgggtttggaaacaaaggatttatacaggttcaggccttcttattcaagaagtaataccctactcctgtccggggatgaatccgccgagtgtattattgattgtatgatttggagaaaatcaacatctctgcccctagaggcacccggaccccccttatatatgggaaggagtccgtgttacaaaagataatctatatcctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcatcgccgtgtagatatgggatatccataatctccacacttctgcaaagaagggatgtccgaaccgaagcttagctgatcgaatcatatttttcaaaaaacacatggagtaatattatggctaactgcgtacattggaggaatggagtagatgctagctagtggaactcgttgtgtgctaacaaagccatatgaaaggtagctaaaattttgcaacaacagccttttgtaaaagaaataaagaacaattgcacaactatttaattaactttctagtcaagtggcgtgcatgctttttgtcatctctatatacgtaccataagccaccttcacgtacatgatgaacagtaaaattgcactggaattcaatcacataagaaagaaaaaacgagtgattacaaactcaaaggacatagccatgcaatccaggcaatggtgaccggcacattaaattgcattcaagcactatttttttaatacaatgaggtgcaaaatttttacatattcgtgaaaataaaatatatgtgatgttgcgaaataaactatgatgaaaatacctccaataactctagtttttcaaaattcaatttctagctgtgactgataagcagacgatgacaggcacacttgtcactattgcacccccaactgtgctacatatattgacctctacaaacctacgcgaaatgatcatggtgcttcttccattagtcagtccatcaggtaaaacaggctagctctagctgctctcgctgcagtgacacgaagaaaagctacagctatagagagaaggcaatgattagttagacttaaggtgtgatgttttcttctctttcctagaccttgtttggatccggaggactaataattagcccttcaaaattttactatttagaaatattaaacgtagattactgacaaaactcatttcataacttatgggctaattcgcaagacgaatctaacgaggtatattaattcatgattagcgaatgattactgtagcatcactgtagtgaatcatagattaattaggctcgttagattcatctcgcaaatcagcctaggggttatgaaatgtgttttgtcagtaatttacgtttaatattcctaaataacaagatttcggagggattagccctccggatccaaacaaggccctatcttctactctcacattttctgcgtacaattttttttgaacgaaaaatagcactagagtgccttttcattgaatagagcaggagaaaatacaacccctaggggcaacaagaaaaaatcgaggaactgtagttatacactatacatagtgtgggattaactcgcgcaaccgcttagcctctgctaaagcccaaaggctagcctcttctttgatttttgataggaggaaactcgttgccacctctttatggtcaaagattcaccgatttctattttctgcatacatatttcttaaactgttagtgtgtgttttttaaaaaaaaacataaaagaaaacattttataaaaccatattaacctattttaagctaatacttaattaatcacattaattgttaattgattgtttctttttttgtgcgggaaggaatgggttttaaccctcaccttagaagataggagtagcacagagtgtgagtagacgcaataagccctgcagacgccgcatgtacagactacagctcgagaagacgcactggaactagtctcctgcagatatttggatgggatgtagcagttgcagcggcagcggcagaaggagaagttgctggtaagaagtagcgcgcagctgctcctgcgcgcgcatgtacagggcgcgaggcgaaagcttgacgcggcaaccaccacccaccccccaccccgcccggctcagacctcgccatcgatcgacctgctcgcgctctctccctccctccctccccattgatcccatgtatgtgtatgctttttgcgccatatcccaccttttttccgtttcctgcttgcttgctttcctgacgagatctttggtttggttggtttctttaagacccgtgcgtccaaatcgccatggcttttcatcttgttttccttcttttccctgccctcccaggacaaagcaagattcctgtgtttctgaggcttagctgaggaaggattcggcctacctgctctcttctcctgcccggccgattgctacgacttgcaacacgcatcaccatagtaatagtatcgtcgtgttcactctccgacgacttaattgtgtgcgtgttgtatttcccaccgtcttgtcacttcatcacacatctggctacatcgatggatcactggtgctactagctagctagctcgctagttactcgattactggctgaattttcgcttctgtctccatctattttacacaaattaaagtgagctctcctgcgctctcaatttcattgctgcttataacttattgtgtttagcttggtaattagtgattgtttgtgtttgtgtttgcttttgctaggcttttggcgatcggaggaattgaaacaccgatatggcgcatgatccgaacctggggttcgcggattacttctcggcggcagatgcatcggcgtcgtcggtcacgacgctgatgccggcgatggacgaagcggcgccggagctgttcgggttgcaggccgggatggagcttctcggcgtgcgcggtctgggtatgagtatgatgcccggcgcggcaggcaaggtcgccgcgctggtggccgacgctggggacgacggcggcggcggctccaccatgcgcttcctcagcgagcagcaccaacagccgagccaggcgccgctgtcgctgtcgctgtgccgcccggacggcgtgctgcacctcggcggcgcggcgcggccgcagcaccaactggcgcccgcggcgccatggatgacgcaccacgacgcgtcgtcgtcggcgccgcaagtgcacggcgcgtggcacctgcgcagctcgaggttcctcctcccgacgcagcagctcctccaagaattctgcagcctccccgtggacagcaccaagcgcggcaacggcgccaaggcagcgacgcagcaagaagacggccgcggcgacgggtcgtcgtcgtcgtcggcctcgtggaccccgtcgccgcagatccaggccatggaagccctggagctgcagaggctcaaggacaagctctacatcatgctcgaagaggtatgagcgatcgatcgatcgatggagctaatataatccactctcttaatctaacaaatggaatctgcagctttggaaaggagctagtagtaaaaatggcacaggaaagtactaggagttccatcaatcatggttgcccgaagggtgcacctgagactagggcagggaagcgaccccattcttgggcctcaccattagcttttggaaacctctattcccccttgcctctctttagccttaggtatatggtcccctacgtacctagccggccggtcagccatggcttctgcttgctagcagcgacaccggcctctacccctttgcccatactttcccccttgccatgcacattcaatgcctcggctagctagctcatgccggtttttgctactgtgcgtgctgcgacgtttgcagagttgtggccttgtagccatagcttgatacggtactgggcactggcagttgttaccgtttcactgtttcattggctatctccatctttaccacgtccatacacgtacgcttggtgcagtgccctgtacgtgtactcctagctagacgtgcagatagatggctacagtgaaaaatcaagtaaagggtttcttaatttgagctaattaaattgatcgatgaacgtgtgtatttgtgcaggtggacaggaggtacaggaggtactgcgagcagatgagggcggtggccggggggttcgaggcggtggccggggagagggcggcgggggcgtacacggcggtggcggcgaggacgatatcgaggcacttccggagcctgagggatgggatcgtggcgcagctgcaggcggcgaggaaggcgctcggggagaaggacgtgagcgcggccgggacgacgcgggggcagacgccgcggctcagggtgatcgaccagtgcatcaggcaccacaagtcgctgcagggcgtcgccgccatggacagccacccgtggcgcccccagcgcggccttcccgaccgcgccgtcaccatcctccgtgcctggctcttcgagcacttcctgcacccgtaagtactccactttacattgttgtttatacgtacatacacgtattacgtatacatatatacacgcatgcatcaatcatctagctactttgcatatccatccatgcttgatcgatctccacacaatgcatttcttgcttgatcgattacacttaaagtaatgcagctgactgatacttaattagatcccgttcttttctccgacaaaacttggatgaagattaatattttcgtggcatgcttttcaaactgctaaatgctgtgttttatatgaaaaatttttatataaaagttgctctaaaatatcatattaatctatttttcaagtttataataattaaaacttaatcaatcatacgttaataccacctcgctttacgtaaaaaacttaatcttctttttcaagagaaaagaacactacacagtgtgctacaatgtatagcaatctaagttcaactgttcacgtggcagtcactagttagtagaattaaggtgacttttggttagtgcaatcacgtacagaacgtaagaatgtcagtgactaggtgtaatagcctagtagggccggtgcagtaatattatcgcgcgtgacacacaatttgctatggacggttgttcgtaattagctttttcgcggtatatatatatatatatatatatatatatatatatatatatatatatatatatataaatttattctgcagcgagcattgttctcccggaccacatttgtcttggcatcaaatgctcaagtggccgttttgccatattgcgcccctgcttaattaagcgtacacgtaatgtcatgtgtgtgcctcactattcttttgccatgcatatggtctaatataatgctctccttttttttttcgacaaaaataacggttaagtactctcgtgactgtggtttgtgcacaacgtaggtacgtacttactcccaaaacattataagtagctagctatgattaaagttgcgtctgtgtcagtggtaatatgtttgattttttttaagtttgtttttccaaatttattatttagctagattatactccctccgtttcacaatgtaagttattgacatcaatataaatatgaaaaatgttagaatgaattatattatgaaacggagaaagtagtatattttgtgcaatcgaatttcctatgaactctcaggttttgtattaacaactatttatcacgtgcattagttgttgcaatgtgctaatatatatacatccaaacaatatatctacgttattataagcttgaaccatatcgatcaatgattcaagcacgtctatttttctcaggttagcatgattattttctgattaacatttttttaataatggacacgattcacatcttggccctctaccaattaataaacacacggtcaataagttctaaaatatgaataaacagactcatcaaggttatgtgaatttatctgattagcatgatagtaattagtaggcctggagaattcattttcaccttgttttaataatagatgcatggatggattgtttgtcggaatattatactactgatgaccagtaatcgatttagatctcattatatttgcgtgagttgttgaatttttttgattcaattcgatcagattcatatatgcatcggtgttcatatgttcaatcccattcaggtatccaagcgacgtggataagcacatcctggctcgacagacgggcctctcacgtagccaggtaacatgttcttcgtgtattgatgcatatatactatttcccccgtttctaaatatttgacgccgttgatttttttaatcatgtttgaccgttcgtcttattccaaaacttttataaaatatataaaattatatgtatacataaaagtatatttaacaatgaattaaatgattaaaaaagaattaataattacttaaattttttgaataagatgaacggttaaacatgttcaaaaacgtcaacggcgtcaaatatttagggactgagggagtagtatagcctgaaccaaatcatccactaataccctaccatgaaataattaagagtgtttttatatatggtcctcaccgggagtttctagtataaaatttgttacttggatcaaatattaataccttagatatgaggaggtacgtagtcgttacctcctcaaatatcataaaatttctaaataatcatacaagtttaatttgagtagctagtttgttcatttttgggaatagtactaaatattgcgcccactgattcgatcgccgtctcgtagatgatacatcaattcatcgatcggttgccatgtcaaggtcctaccatgtcctcttgtgcttgcaaatgttttttggaaacgaatcttgtttagccatcgacctcccgttacaacgacatgtgttgttgttgcccgcgcgcgtttcttctgacaattcgatccatggcaggtgtccaactggttcatcaatgcgagggttcggctgtggaagccaatggtggaggagatgtacgtcgaggagatgaagggccaggacggcggcgacggcagcggtggacaggggagcctaaaccctaagcctacctgcagccacgcctccgaggcgcgcggcggccagcagctggtcgtcggcgatggcgacggcggcgaacagaagccgacgagggcgcagcttcgccacgacgccgggtcgctggcctccgtcgtcaacgtcgacgtcgcggccggcgcgggcggcgtggcccggctgcaccaggcggagaacttcggcatcatggaccacctcgacttcgacgcgtacgacgacagccaccaccagcagcagcacggcgggttcggcggcgtgtcgctgacgctcgggctgcagcagcacggctcccacggcggtggcggcgtgaacatcgcgttcggggcgccggggtccgcgcacggcggcgccgggttcttgtacccgggcgagcagatggcgcctgacgccatgcatccggggcacggccaccacgtcgtcggcggacagttcggcgtggccatggacggcgacgccgcctcgcacgcgcaagagcggtaccggagcctaagcgccggcttccacctgctccgcgacttggccggatgatccatgcggcgaactactcagttcatcgcacgtacgcatatatatgcattccgtgtactgtactagcagacgatttggatgtcgcagcggcagcggccgcggcggtggcgactaggtagggatcctcgcgcgcggccggcgctgcggcgtgcattggttgggcaaccgaattaagcgtttttgttggtggtggtccttgattttaccgacctataggtacagttcgtatatatctctcgcgatcgatcgtacaccagcaggggagtagcccagtagatcgtcgtcgatggcgctttcgtgtggttcggaagcgggcagtttattttagcctaccggcccggcatcggttgccgggggttgtgtggtcgtgtgttgtgtagtggagacagcttttatttgtactggaaatctggaatttgattgatggttcaacttaggccgccgtgactgcgctggaactgggactgcacgctatttgtatgcggcaacagcaacagtgctgcgacaggtccgcttcaaataagccacaaactactccaacctaactaatgatttaacggtgtaagaatgacttgtgtttaaaaaaacaaaaaaaaggggctatctgtttatttaggtttacaattttcgattcacaagtaagctagaccataaactgagagacagatatgtcccgtaagcatgctagccacatgacccaaattatctaatttggattcagcaaaacaaattacaccccctctgattcgtaagaaaaatataaaaaattatggattttatttctatagaaaaatcctaatgagttttttttaaaacaaaaatgttagacactatactttcacttgaaattcgaacgaaatagacaatccaaaaattttaaggaaagttagcaagagttttaacctcttgaaaaattttccctaagtttatttctctaattcaattcacgtgttctcccatgtaatattcgaacgatcaatcattcatgtattttccttgtcttatatatgttctctttgtttccaattgattatcatattacatgaatatgctaagactaagaaaagtcaataactctcgcacactacatttactccggtaacaaactcgatacatgcaccatctctgctcttaaccaataataaaatcacaagacattgcatgttagtcatacatagttatgtgtatggatgcatgcactaatatctatttactctcatacgcatatgacgaatagacttaggaaatagatttaacatggtcataacaatctataaaacgttatatgatgattaattggaaatagacaattttctatttctcaattgcgttcatattaaaatcaggtattttatatactttttcaagagtttcaaatgagtccttaaaaaataaagatattcgaacatatttctttaaatagtgggaaaaatccagtccatgcatcaattgtggatatataatgcagaaaagcatattagttgtcgatatccttgtaaacggtactagcatacgtgatttttcttttaataaaaagaactgcacgggaaattagttaagcagcaatccgacggcgtaaaaatttagagcgccatcagttggtctaataagtaaaagcaaaaggtaaaatttaattaaattttcgaacttgtatttgaagttgatttcaagattttttttaacgtaattcccttttagcattagtttttaaattgctataaacaaatatataaaagttttacatataaattaatttttattttctaataaaccgttttggcttatcggtgaatatgggcttaaatcgcttgcaccgccatcgccgtgcaactcaataatattcgagtgttgcttgctataacacggcaaaaggcaatcattaagcatactaattacaagacttgaaacgttagttgagatcataattaacgatttgtgtaaaacttcgaagatttggtcaggtgggaggtcactttcatatcatcagcaaatttctgtcatcactaagaagaagaggtgtccatcaccaaatgtgcgagattctcagctaggagagttggatactacctccgttttttaatagatgacaccgttgactttttctcacatgtttaactattcgtcttatttaaaaaatttacataattataatttattttgttatgagttgttttatcactcatagtactttaagtgtgatttatatcttatacatttgcataaaatttttgaataaaacgaatggtcaaacatgtgagaaaaagtcaacggcgtcatctattaaaaaacggagggagtatatggtttggccgcgtactatagtgattttgctcttgctaacagctagctgcgtgtctgtgtgcgcgatttttttttcggaaaaaaaataaaaaacaggatgcggagaacgcatgaacttttttcatttttaaattttttgttttaatatttatagaaatattatactggcaaaaatgtttacaaaaatatatcctgccgcacaagtggagagcggcaaggtgatgtggcacacggcgtcgtgtgcgcattttgcgttgaggtcccttgccgggtgaaatgcaattttcgccgcacgcaaaattcacatacccgctcagcggtctccggcgtctgctcacacacgtcaccctaccgttctcaaggagggttgcgtggtctatttatgtaaatattttcgtctgtataatatttctgtaaatattaaaaaaataaaaatgaaaaacattcgagaacgcatgggctattgggctgggtgctggagcccatggccgtcaggcccagaggagaaaccagtgatcctacaaacgcgacttgatcattgaccactgaccatgctatttatggggtaatcagtccaggttgcaactggggcctacaatttctgttccctatatgctccacagagcgactcgccctcaaacacgtagactggaacgaacgaacagacgaacacggtgcactccactactacgctatttttgaccatgtggccattagtgatctgtgctcttttggccgctcatcgatcttggccaccactgtcgtcgtcatctccttttccaggccttatttggcatgaaaggaggaggcggcgatcggcatcatcacaaggacgccattgtcatgcacgccgccggcaaggcgcccaagtgcaaggcttccttcttcctctgcagcctcctcctctactttctcctcccggtgctcgccctgtacgtcgttgccctcgccgtgtcgccgttctactcgggtagctcgtgcccggaggagagccttgccagtggcgacgttgcacatctcgcggccgccggcgatgctggcaacaggcgtaacgactcgtcgccgccgtctgatgacgccgcgccgaccgggctgggtcacattgtgttcggcattgccgcctcttcggagctctggaagagccggagggagtacatcagaacatggtggcggccggagcagatgagcgggttcgtgtggctggacaagccggtgtacgagttctactcgaggaacgcttccacggggcttcccggaatcaagatcagcgggaacacgaccaagttcccgtacacgcacggccgcggcagccggtcggcgctgcggatcacccgcatcgtgtcggagagcttccggctgggcctccccggcgcgcggtggttcgtgatgggcgacgacgacacggtgttcttcccggacaacctcgtggacgttctgtcccggtacgaccacacgcagccgtactacatcgggaatccgtcggagagccacatccagaacctcatcttctcgtacggcatggcgttcggcggcggcgggttcgccatcagccgcgccctggccgcgcagctggcgcacatgcaggacgggtgcatcgaccggtacccggcgctctacggcagcgacgaccgcatccacgcgtgcgtggcggagctgggcgtgccgctgacgcgccacctgggtttccaccagtgcgacctgtggggcgacgtgctgggcctcctgggcgcgcacccggtggtgcccctggtgacgctgcaccacctggacttcctgcagccggtgttcccgacgacgaggtcgcggacggcggcgctgaggcggctgttcgaggggcccgcgcggctggactcggctggcgtggcgcagcagtcggtgtgctacgacggcgacaagcagtggacggtgtcggtgtcgtgggggttcgcggtggtggtgacgcgcggggtgctgtcgccgcgggagatggagatgcccatgcgcacgttcctcaactggtaccgccgcgccgactacacggcgtacgccttcaacacgcggcccgtggcgcgccagccgtgccagacgccgcaggtgtactacatgcggcagtcccgcctcgaccgccgccgcaacaccaccgtcaccgagtacgagcgccgccgcgtcgcgcccgtcaagtgcggctggcgcatccctgaccctgccgcgctgctcgaccgcgtcatcgtcctcaagaagcccgaccccaacctctggaaaagggtaatcaaacacacaccgtagttaaaacctgaattgatttgtacaacaaagaagcttgatttttgtaatggtgctctcaaaccggcgtgcgtgcagtctccgaggaggaattgctgcagggtgttgtcgtcacccaggcaagggaaggaccggaagatgaccatcgatgttggcgtctgcaggggcggcgagttcgccagaattgaggtagccaggtaggccacctccattaacaattttccgatatggcattattgatctgatcaccagctcgcgcgcgttgcgtttggttcgcgcagggaagctagctaggatcagttgctaggacagcaaaacgagagcagaaggcgaaaaccatcaagcatcaaggacggtatcggagcaggacgcgcccacctcgcggcggtgcacggcggatcgctcggttactgcttgcttcggctaatgatagctgtaaccttagataataggtgtatgtaagtaaccgaactcaccttgatacaacactgtgccggcgagaatgtggcgcacttgtgggcgttgtacaagtacgggcagtgctgctgcgaacggcgacaggcttgtttgtttgtgagcccgtcgactgtcgaggtgttcaaataatctggcaaacaggtgaagaccagaggctacgagtgttcaaatagcccatgggcaattttcaaaaaaaaaaagaaagctcatgggccatgtatcaactaactgatgaataagttcactttgtcgcagagtatgaaattcatcgagttacaatgggatataatgggaaccgaaataccagatatattacagatctctttcggtttagggaggaatttcacactcgatgacaaattgaggaacctaaagtgaacttattacactaaccgaaaggggtgcaacctctgttgggttctttttccgagtcggcccgagatgtcctgacaaaatcctacttgggccgaagtgatagaagcgcaagcccaatagttcctttcagcctgctagagaagcggcatatacgactcacagcgttaaatgagcggggcagaagagctcacggctcccatcggatgcactaatcagttaaagaaaaaactaaatttcatatttttaaatttaattttaagatatttataacatagtttctttttcagcattgacttttaattcaccaataacgcatatataaaaattttatctacaattttatttttattccttagtaaaccgtttcggtttattagggaaaaagctaaacgatagcgacacaaacatcggtctactactcgcgtggtccgacggtggcgatctggtcgtcggctgcaccggcggcagagtgcggtttatgagcacacggagtgaacacaaatcatgttgcgaagataataatgtatgcaaattggaaaattatagagctacagcaaagggatagcaaagctatcaatcaggttctgggaagtggcaacctatgaaaaaagagagacacaaacaaaatcgagaagatggcatacctaccatacaagtagaagaacagagcagaaatttgcaatctgcagcatgctttgttttgagccgaacaaatcggtagtcagtgggcgggggggcataggaaaatgtgatgacccaatcagcgtccactccattgtccattccactattccagtattccaccacgcgctgccctccggtcgttgtcccatcttcctccgagtccacttccccgtgcccgactccacacaccactccaccgcatcgcactcgtccttccctctcccttccaacaccaccacccgcaccgtccgcacactcgtccgcttccgtctcattctctcgtggacgcggcagtggcgccacgaccacgcctccactaccgcctcaatggccaccgtcatcgtcatcctcctcctcctcccgttactcccgtccaccgccctcgccgccttcccctacttcctcgcctgcggcgccgcctccaacgtctccttcccaggcgactccccagcgcgcaccttcgtcccggacgctcccttcctctcgtccgccggccgtgtcccggcagtgacgagcaccggctccaacacgatcccccctctctacgctgccgcgcgcgcggccggctcggggttctcgtacagcttcgccgacccggacaccgccacggtcaacgtgtcccgcgtcctccgcctccatttcttccctttcaccagttcctcctctgtgaacctctcgtccgcgagcttctccgtctctgttcgcgatgcctacaccctactctcctccttctcgccgccgcgcgacggcgtcgtcaaggagtacttcgtcccgggggacggctccggcgagttccgcgtcaagttcacgccggacgccggctccaccgcattcgtcagcgccatcgagctgttcccggctccgccggagctgctgtggagacgcccggtgaagccggtgggcgccctggtcgacagcgtcgacgtgaacgcgtggccgcagcaggcgctggagacggtgtaccgcctcaacgtcgggggatccaaggtgaccgcggcgaacgacacgctgtggcggacgtggctccccgacgacccctacttctccagccccagggggctctcgcaggtgaactcgacctcgaccccgatcatctacggcacgtcgatcgggtacacgagggaggtggcgccggacagcgtgtacaagacgcagcgcgccatgaacatggcgagccagcagttgttcctcactccggggcctttcaacttaacgtggaccttcgcgcttccgccgccggcaccggggtccgactccgactacctcgtccgcctccactggtgcgactactcgctggtgagctccgttgtagcaacgggcatcgtcttcgacgtctacgtcgcgcagaggcttgcttccaaagacctcgaccgaaacgcggcggacgcggcggagcagcccaacgaggctttttacctggactacgcggccacggccccgaccaccgggaacctcaccatcagcatcggcaagtcggacaaaagcgatgcaggcggcatgctcaatgggctggagatcatgaagctgcggcgcgccgataatttgaactccgccggatcgcacggcaggaggaagaagattctcatcggcacgctctcggcggcgctcggcgtcgctgttcttgcgtgcgcgctgctctgcttgctcgccgtgctgcgcaggcgtagacaggcgccgactccggcgccggaggagaaggagagcacgcagctgccgtggtcgcagcacacgcaggatggctccagctgggttgacatgtcgaacgcgtcgggcgcgggcatgaccggcgggctgcacaggatgagcatgcagctcaacatctcgctggcggacatcacggcggccacggagaacttcaacgagcgcaacctcatcggcgtcggcgggttcgggaacgtgtatagcggcgtgctccgcgacggcacccgcgtggcggtgaagcgcgccatgcgcgcctccaagcaggggctgccggagttccagacggagatcgaggtgctgtcccgcatccggcaccgccacctggtctccctcatcggctactgcaacgagcagtcggagatgatactggtgtacgagtacatggagaagggcacgctgaggagccacctctacgggtcggaggagccgccgctgtcgtggaagcagcggctggagatctgcatcggcgcggcgaggggcctgcactacctgcacaccggctactccgagaacatcatccaccgcgacgtcaagtcgaccaacatcctcctcggcgacgcgttcatcgccaaggtggccgacttcgggctgtcgcggatcgggccgtcgttcggggagacgcacgtgagcacggcggtgaagggcagcttcggctacctcgacccggagtacttcaagacgcagcagctgacggaccggtccgacgtctactccttcggcgtcgtgctgttcgaggtgctctgcgcgcggacggtgatcgaccagagccttgagcgcgacgagatcaacctcgccgagtgggcggttagcctgcagcagaaaggggagctcgccaagatcaccgacccgaggatcgccgggcaggtgaacggcaactcgctgcgcaagttcgccgagaccgcagagaagtgcctggcggactacggcctggaccggccgtccatgggcgacgtgctgtggaacctcgagtactgccttcagctgcaggagacgcacgtcaacagggacgcgttcgaggacagcggcgccgtcgccacgcagttccccgccgacgtggtcgtgccgcgctgggtgccgtcgtccacgagcttcctcatggatgacagcgtgaccgactcggggatcgccaacagcaaggccttctcgcagctcagcagcggcgatggccgttgatcaatcagctggtcagtgaaccgacagtcggtcagactcagatagagaagtttgtaaccataatttttcctctctttttttttatgctgatctattctctgaatccaaaacccatgcacgtcgcagcaacgatacgtcttcagaaattttgctgaacacgaacggaataccgtaatctgcagcaaaattggtgttgcaattttttctgtccttgctgtctgcatcgtggattcatttcatatgttagcgcgtgacgaaatgacttgacccaggatgaacagatcattttatatgttcagatgagaacaaaatcctttgcctgttctttcttcccaattggccacgggcggccgttttatagtacaaacaacaattctctgcaggaccttgacagagacttgtgtacagttgagttgtattgtactcctacgcatgtctggcgtcaccctgatgaggccaaattctcgttaccgtgttccgcctaactctttgattataatgatgattataatgattatcttgttagtggaagattcattaatgggatcattcctaaactactggctttagagcataataatatatggttcacacgattgctgacctagaaaagccgccgtcccgccaaggccattagagaaaccaaaaataaaaggaacttttttttttccaaattcgatctcgccgaagcttttgcatactacgatgatcatgacatacacgaattgtgtggttagaactcagccaaactgggacgtgcatagctgcaatgcacgcattcttcagaatccccctgattgtctcccttctgctttgactggaaggacggcacgcatgcatgcgcccaggaagagtaataaccaggtaaagccaaattctttgggctatttccttttcgtttaattatcaggtgctgaccgctgaccgtgccgtcgtaatcacactgccctgctgactaatctaaaccattttttttatctattatcctttgactgtttaattttgactacaattccaagttgcaaccagaaatcactactgccctattcaggtggcaaccgatatgtccacggcgaaagagacagcccaaactgcaaggcaaaaggctatggtacttgggccaaaacgtgtacagatgctctcccctccgcaagcccaaccaaatccacggcccaaacgaaaaagataaaagcccacgctgatcagagcattaaaatacctaaaccaaccggcacggccacgacgcgtgggccccaccatccagcgagtcctcggctcgtcgcacgcgacgcggtgaattgattgatcgaccgattcctccccaactccgctcgccaatccacagctggcctccatttcttcctcctccccttcgccgaatcccccacaccaatccgccatggctagtgttctcgccgtccccctcctgctgtgcctgctcgcctccgcctccgccgcccgcttcgccccggcggacaaccacctcctcgcctgcggcgcgacggcaccggccgtgctccccgacggccgacgcttcgtccccgactccggctgcgcctccacgcgcctccgctccccggcacctaccctcccgtccgcggcctccagcgcggccccgcagccgacccctctccacgccgccgcgcgggtcttctcctgccgcgcgtcctacgacctcgccgtccgccgccgcgggtaccacgtcctgcgcctccacttctaccccttcgagcccgcgctcgcgtccgcgcgcttccacgtcggcgccgccggattcctcctcctccacaacttctccgcgtcggcccccgtcgtgaaggagttcatcctacccgtccactccgacgtcctcgtcctcaccttcgtccccgagtcgggctctaacgccttcgtcaacgccatcgagctcgtctcggcccccgatgagctcgtcggcgacatcggcaccctcgtcacgagcagcggcactgaccagaccaatggattgtcgtctcaggtctatgagatgctctatcggatcaacgtcgccggccgcaaggtcacaccgttcaacgacacgctgtggcgaacatgggtcaacgacgagcgcttcctcgtcagcacggaatcatccaacagcggggtctggtcgttcggtggccggattgcttatcccaagggtagcagattgatgacacgggaggttgctcctgacaacgtgtacaactcggcgaggtcagtgagctcacagggcaaagtgacatggggatttcccgtgcctgcttccagcaggtacctagtgcgtatgcacttctgtgacatcgtgagcaaggctctaaatgagctttactttgatatctatgtcaatggtcagctagcagtaaaggatttcgatatctctggtgccactggattcttagcctatccatattacatcgactttgttgtggatgttgaggatgaaggggccctgaaattggccattggtggctcgaagaatagccgatcagacgaagtgagcggtattcttaatgctgtagagataatgaggatgaacaaaacaaatggtggtattgatggggattttgcagtttctctgggcatggagtatgtggctagcaaggggatcggagaatttactcgctcactgctgtgtggtttcatttttgcgggattgttgttggttttgttaatgcttgtggtgaggttgaggactgagctgaggaataatggtacaacttggtcttggcagccaaatgattctggtgacgggaagctggctagagcatatcaacttgtgtccgctaagacagactattgaacatcatgagatgataatctttgaggagctttaaactgtggctgttgacctattgtatgtaatgacatattgcattacttcagttgtaagtattgtagttttacacttttactcccttaatggtaagttttcggttatttgagcttggctaatggagaaaacggtcgtggtgttgtatctggctcaagatatttgtttgtattagtactgcttttaatagctctatccagtttgtgatgcttgaatgaatatgcctgcaatttatctagtttatttatgcttttgtagtactggttattgttatatgccattactataattcatattcttgatatgaagatagcggctaaatcatggcaaatagaatctaccttccaatgttagtgttatttactattctttattctacttggtaaggcaagggggaagctcttgtagaaagccaattaagaagtagtagtatttcccttggttctactttttttttctttttgaaaaaagaaacttcagttacagttttggctgccctggcatcctactttggccctcatggcctcatcgctaagagcttttggtaatctgggctagctgtaacaattaagtgtctgcagatcatctttgtttgactgctgagaacttgtaaataacatgctaaaatttgacataatcacacaaatttcttaaacttggttgattcaatccagattattttctggagttcagacataccgagggataatactgctttggtcctttcagatcccaacttctacagaatctttgctttgcttatctatttgtatacgtgacatgtcttcaatcttacatgtgcaattgtttggattttggaattagactccaccgaagtttagggatatatgtttacctttctgttataagttctaacatatcttcttttcttaggaacctgccatgattcaacaattatcatcctttgatacttaatagcttttatttccgcctctacatctatatttcttttgaaaaaaaatgcaaagaagatgccttcctgagaactttgccatcctactctgcctgttgatgtcttttctggtgtgtttgtgtagtacaggagtaagtactatcattcatctatccaaacactagcatcttcctctgttagagcgccaaatgaaatattagtatcagcagaggaaaatctaccatatgcccctatccaaatatccaatgatgttattgtgatcttttttctgatgattgtttgtgccctcatttttttgggggctactgttgttattgtgcgggtgggattgcttcagtcctatactgttactgtgcaaaaaaaacatcttagggaatagttaattcttgttgggtttgtatgactaattgtcttatattagttctgatgccaaccacaaagaacctaaaacgctgtaacactcataggtcccaatttccctatttgaacaggttttggtggttgatgtgacaactgtattggtggtactttctaatatcatcactagtcattgtacttcaaaatttaattggaatctatcattttgtggctggcttttattgtgaatttgctttcacggtactgtatagtgtattaaacacgtcgtgtgcttttctaaactccttgttcctgaaaattattctgatcaatagtgatgtggtatctctggatctagcagtttccctcattttcctgattctctttcaatcgaaatgtagtttttctatcagtttttagtgtattttaaaaggactatgttttgaattatttttcataccccaaatttagcagcattcgttcccttgttaaaatctccagaaccttctgaagaatctgttactgcatcattgaaatgcatgctgagcatcttctgttgggttgctctcatctttgaaccaaattaatgaggattgtagaatcatctacttattttaggcccctcaatgtaaattggatcggcccatctaaatatgaatggcctgacatacctaactggcccaacacattatgcctcatttggcatggttcttgtactagaagactactaggctgtgatagtgtttcacatgccatagtttgaagaaagaataacttagggaagagatttttcatgttaaatactctgccatatggcggcactgcatgatagttggtgcatgtgtctcttacgagtcgattgaactgagcccatataaccatgttgcagaaacattatatccaagtattattttgcatagtaccttatagaaaggaaagacagtattaacaatcttgtagtcttctctcggtttttatggtttggttaatattgtttttttctactaatgttgtagtagctgttatgcatagccataagtcttcgaaagttaataaatgtcatttgacttggctttataagctactaggccagaatatgaccggcactgcttatttcaagaaaaacgtgcaaagcaaactgcacttgcatgtcccttaggaatgtgtagttgtaccagctaacaaccgtttgacaaggcatactgattgattagtgcttgatgtcatctgaaatcttatcttttgaaaactaaatggaagctggagaaactgtgacaccattagattaccattgtcaaaaacctctggattcaactattttttttttcaaaatggaagctggagaaactgtgacaccatttgattaccattgtcaaacacctctggtttcactatgaaattcatcaaaccatcaagctctttctgttacctgccagtgccctgccccttcttagggtgctctgatttcatttgcacctgtcaggtatctatagagagatttatttggtggaaagtaatttgactagaatttctgtttcgtataatatgatctctctctgtccaatacctcaaccatttaacttacaatgtcaagaatttgatttcccacttaattactaaaccgcatgctctttattctgtgcagctctatattaagtgtttaatttcttaaatttggggatactatgttcatgatgtttcaatattaaaaaaaggcatcttggcatcattcaatgtatatatgcatttatctgggccctatgtattcccaaaattatgaagtaaagtgctttgagtaaagggtgggcatatcacaactcatagaaagctataatctagtgggggcaaactgtactccaatgttccacaaaaggattaccagaagatgttgcattaaaaggtatggtcggctcatgctggtgcctagttcctctgcctaacctgatgtttttagtgttggaatcaagatctgtagtaaaaccttaaatccagtgtagggcacagccacacaaccgctggtctgctatcgccactctttatttttaccacttgtgtccaatatttgctgctatcgccactctttatttttaccacttgtgtccaatatttgcgaagttgttccacctttgcatctggatctttgctgttcatgtgacggttgcatgttatgagcctcacattttttttggctgatggtctcgtacaaaagctctctactatgctggagcacaaaatggaattatccttaatcattctacactttcgtctttgttagatgctcttgtgcagaaagtgcttttcaaaattcaatgaaaatgcctctttttctgcaaataagagagcgagaataaaacctttgatatcaccctttttctatctgtaatcactatgcccgaccattagtaaaaaagaggttgttctgctcaaaagttttgatcgattctctttcacctgcagctgaggttcttttttctagtgggcgtggcccatggaatgcctcaactttgatctttataacagcttagatgcttaacagcgacaaatcctttgcgtcaggcaaaataaaaccagcataccaatttgcgtactaatacagtaaacgtcaagcaatgtacatgtacagcttcaggacgccacatgtaagtatgcatcgatgcattgtcaactcatttttatccgtgtagatcacatttattttatccgtttacttttgtattagcacacatcagctctccctctgtctctcatctgctgatgtctttctgaagactatttatataggaagctttctgaatgctgtagttttcattttctgtgttctttttttctaattgtccagaacatgcatggtacatctctctcgtctatgacagcaaaaaaatgaaataaaatcatatacgtatatctatctatatgaagtgcttgcattttaaccttgattaataataacgctgtctaggatttgcaccatgttttgctgacaacaatattgaacctgttgctcgcagcaaaaccgaaccaaggcagcagcacacgagtggaacctgagcctagggcggagagaattagtatgtccgaatgtcgttactgccgtcctgttgattgtttacagagacaattgtcccatgtttaagggtctcagaacttgttttgccaggaccaggttcttgatccttgaactgtattttaattattgcccttgatatccaagcctgcttccccagctgcatgacaagcgtcctgttccatgatttgaatattgcagactgatccatgttgcctggcttcatttaagattggacaatgtgacacgatgatagcataaccgatgcttcattagcagcatcttatggagatttgacaacgtgaggaccacattccttggcttggatttagcttagcttagctctttctcccaggattaaatattcaaagatcattttactgatttcatgtgccatttcttgagctggcagctggaatttcgcagggtgacatgaccagaggcctggatggaaggacgcccgtgcggcagcgttgtcgcaggtttttttgtcaggattatcccaaccacccaactaatcccgtcatgtgttactctgagttttctcttagcagcataattttgtctttgacgatccatctgggcattatttaggatgtttagtcctaaagaaaagcttagtttgacggccagtatgttgaggtgtttgtcattttctttgtaacgaaatgactactttctccgtctcacattgacacattataatactattaatctttgtctcacaataagttaaattttatactaaatatagcatatcatagtaattatgaacatgaattcattactacgatgatgtatcacatgcagtattagattaattcattgagaaacaggagtacctaccgtttacccttggttgctcttagcttaatttggtggccttgctttttccagggaagaaatgctccattgctagctccctccatcgctttttagctgttaccactactgctactttaaaacctactcccacaactgaagataactgaaagtcacaaagaaatcttgcttaaatgtctagtttttgtcgacaaatatgtatacagtgaacccaatcattacagcatgtcaaatgactcgaattactccatgtttatcatagcgatgagtagggaaaaaatggattgtctaaaggtcagtctagcatgttctttttaagaattaaaacttatagatctacttgtatgaataaaataaataatatatactattaagcgagcaaattatttgaaaaaaaaaatctaagcaaggctgactaagaaagtttccgaaggaattgcagttttagaagcatgtcacgaataattcaattaatagttcgaggttgtaagctaaaagttgggaccttaagattttctaaagtaatttgctatacacctgaattatctcctctctctttattactgaactagcatggtggcccgtgcagattgcgcggctagcatcattatattttctctcatataatagcatatatgttttcttattatattattcaaatatattaaaatgacatcataattttaaattttgcaataactttacgaaactacaaatgtataatattcatattgtattttatatacgtgttagttattaattatttttaatatcaaattttagttatttgtaagttatatatattcctgtatagactctagactcatcttttcatatttctttttttaattctgaattttctgtaaattgtatttctatatagactctaggcacttcttctaatattatttatttttatttctgaatttttattatttctaattgtatttctatgtggactctaaactcatctttcaatattctttaatttttaatttcgaatttcagttacttgtattcctatattgactttaaactctttttcccatgttttttcttaattttgaattttagttatttgtaaattgtatttttatacggactcaaaactctacttttaattttattatgtttattctgaattttagttagttttaaattcctatatggactctatactctacttctaatattcctcattttttaatcccgaatttctatttttttcttaattgtatttctatatggactctatactctacttctaatattccttatttttaattccgaatttatattatttcctaattgtatttctatatggattctatactctacttctaatattccttattttaaattctgaatttcagttatttcctaattgtatttctatatggactctagtctcctcttctaatatttcttattttttaattccgaattttaactatttctaaattgtatttctatatggactctagtcttctcttctaatattacttattttttaattccgaatttcagctatttttaaattgtatttctatatagactctgctttttctttttctccgattaatgtgagaatttccaggctatgagagcgaacgtctaatattccttatttttaatcctgaatttctatttttttcttaattgtatttctatatggactctatactctacttctaatattccttatttttaattccgaatttatattatttcctaattgtatttctatatggattctatactctacttctaatattccttattttaaattccgaatttcagttatttcctaattgtatttctatatggactctagtctcctcttctaatatttcttattttttaattccgaattttaactatttttaaattgtatttctatatggactctagtcttctcttctaatattccttattttttaattccgaatttcagctatttttaaattgtatttctatatggactctgccttttctattcctttaataatataatagatttttcttcctaccatcctcctcaatggtgtagtatccggtgccagtaagacccgccgtaccatgccacccattcctcctcacaacctcggcgatgctagtcgcctccttctttcttgactccgatgaccccgcgtcgtcacctcccattgcctcctaactactctatgaggcttgatgaaccactttgcccccttatactcctccatctatagttaccctcacgccaacgctactgtcctccttcgatggctcctattatcggatctgatgtcaccttttattgtttcctaatcactcaaatgataaggcttttcctaccgtcattcttgcccgtgactgaggcagaaccaccatctcctccttgcattgtcatgtccgctaacccaccgttgggtcactactgcctcggtcatcctaggaacacctcccaccctcttctgccatcctgaccctgaaacctaaccaatcggagactagctaaagttcattagagatgaagacaacacacaaatctcagagaaaaattgcgatgttatgaattcagtgatattgcccacaaaaatgtcaaagtgatgtctaacaaaatcgctttctaaaaaactaaaatgtcatacctcttggcttcgatgacgtcactgctgccaataaggagaagatgcgctcctaattcgtgctccacaacatctgacggccacaaaattgactggttagcaactactccctctgtttcacaatgtaagtcattctagcatttgccacattcatattggtgttaatgaatctagacatatatatctatctagattcattaacattaatatgaatgtgtgaaatgctcgaatgacttacattgtgaaacggaggaagtaattagcagcccgtcaggaaaaaaaaacaacattctattaaaaatttcaagagaaaaagaacagagttttgcaatgagagaaaagagacactgcaggggcaacatggacattgcaccgaacggtccaaggccaaggagaggagacgaccccctatatctgcgccgtgccatgccgtgtagtcccttgcctgctcagcacgctgcactgcactccaaaccacacagcctcctcgtctcgtcttctgtctcgcgcgcgcacgccactcgctgggagctcatggaggtcggctcgctgcagcacctcggcgacagcttctcctaccggtggctcaagcacgcggcgcaggcgccgtcgttcaagcgcctcgtcgacgacgatgtcggcggaagctccaggtacttcatcgacatggaccccgccgacctcttctccatgcggtggacggctccgggcaccgacttcgacttcgacttcgacctgcccggcggcgacgacgatgccgcctctccgatcccgctgctggtcagcgcgagccagatcttccacgatggccgtctacttccccacgagctcgacgacgacggccgcttcggtgcccaagaagacggcgatgccgctcgcgtcgcgcacttgctgagcgagccccggctctcggcctcgtcgccgctgttccactcagcgcagagcacgccggcctcgctgagctcgtcgtccagcgcgaggagcggcgccagcaagaacgccagcgcgccgccgctgctcgccgcggggaggcgtggcggcgggtcatcgccgtggaagatactgctcaggtacctgcggttcctcatgccgctctaccggaaggtcagggcgctgccgccgctgcgtgctccgaggacgagggtctcgccggcgagccccgcgagcgcgagagcaagggcgtccacgtccagcatcgactggtgccacggcattgccgacacggccgtccatgacgccatcctctactgcaagaaatccagtgtaagtgcaccgaaaccatcaaacacaatcaagcaagcatccatgcacattcacacagatgttgattagcatttaatggcagttcttgctcaaatagtttcttgtcatatttctttcagggacaaaatatatagccaggaacaaaggattcacaatctgcaagagcatgagctgatcttgtggcctctcaactcaagatcctctcgttttttccaccattatttttgttgtacatccacataagttatacactgtatatgcatgtgacaagctgcatgaggagtacgtttaacggttgtaaacagctcgtttagggtgtaatagatggctccctttcttgtctttctcgtttgtctttggccatgtgaatcaattgagcatttctgaccattcctgttattaattaagtgaactaacaagaaattcataagttagattaaagcatctagatcatttgttggctcaatcatgtgccttttccgagcataatcgtgtccctactctaacataatccgcgggagtattattgtactagatctcagcaaagaaatcctggtaatactatactgctgatctggtactcatttagcacgttctgttaacttgacgctccagtggtgcctattttgaaattcatttgtaacaattcgatccccatgaattgaattatcctttccatcatatcgatgtgaaagttcaaaaacatcacttttatgagtttttttttctccgtgtggaaagtgcaaatttttagtgaaaatcatcctgactactcagttgtaattttgtgatttttagtcagaactttgttcaattttagcacaaatttaaaattcaaaacttgcaggctgctttaaaattaattttctaagtaggccttccaatcttctacttgaaattagttgcttcaaaatctcccttagaatttgcagtttaattttgaagtcttgaaattcgtggtttcaagttaattaatttcaaaatattgaaaaggcaaaatcctaacatagttaattgttgcgcgctatcatgtttgaacccgcaaaacttcgtcataataaactgtgtgttgcagataggattagacatataaaaattgcaacgatttagacagttagtaccttgtaatgcctccatgtccgtatccttgtttaccaagctcgaatttgaccagcaacaataatatataactagagtcataaattgttcgaagcaaaatcaattgaggtcccgtacacacggcaaccagaccaacaaatatctccaaatataaagcctaaatgcgccattaggatgggccattacgtcgtcgatgaatatatgattagtaccatcagtcgatcgattgggcaggagttgttcgtttttcccaccaacccaagagaaacagaaatgttcaacacaattgttaatttaaattcatgcacgctgtccttgtccaattacacgagaatgtctcaaaaaagagactctgtatacaagccagcgtcagcaacaacatgcatgatctctgcaagaaagcaactctaaattagggcagtaacagtatcatagacttaaaaaaaatgcttgctttgaacgacaacgcaggtaaaatatatattcatgaacagggatattgtttcttaaattaagaaacaggatgcaagaagaagtaaacgaaaggaacccccaatataatgcaaactgatttaattatgaacgcagcaatatgcaaattggattgcgacgcgtgattcgtacaggctaaatgattaaacaagcacgcccaattgcacgccaaaatatagcagaatcatttgtttcccgatggatcagcatagctagctagacacgcacacctgaattgactggctaaacccagaatcagtgagtgcagagccgtttggtgcatcagcgtgaatgcacggttgcagcaggcgtaccaaagccacgcagtcgcacacgtacacgccatgggcgttccaggcgatgccgtgtatatgcagatatatctgtatacgcacgtagatacgtcaaactccagtggatttatcgtctcaaaatggtcgtatcgatcgcgttttaaaatttaaacgtagcggtccatgcgataagatgagcaccgtacatggatacgaatcggccgggaccagtaccagttagcagataattaacgtgctcgcagagttgtcgtattgccgcaacagatgatagtactagttttcgaggcagaacgtacacagaccggaccggttcacatccattaccacataataatagtatcattacagttattaacatgtgagataatagaaggatgagattcatgtatcagtaactataatgatagtgatattatgatagaggctgtgtttagttccactggtaaaaaaaaattgtcgggtctaacatcaggtatacggatacggatacacatttgaagtattaaacgtagactaataacaaaataaattacataatccgcatgtaaactgcgagacaaatttattaagcttaattaattcgtcattagcaaatgtttactgtagcatcacattgtcagatcatggcgtaattagacttaaaagattcctctagcaatttacacgtaaattgtgtaattagttaataaaacagcctacgcgagctggttcgctcagctgcgtttggaacagcagccaacgagcggtcgagcagagtaaggccgaaatgagtagtagtttttgtcacgaggcgggcggaagagaggcgagacgtgcgcgagcagcggggcggcaaggggaatgagctgggcctacgtgcacgggagttgggtgttcggggcgggaccaggtggtgcacgcgtggatgggagcgtgagggggggtccgggtgatgagggggatcgatcggctggctcgaccgatcgaggggatccgcactgcactagcacctgcctgccctgcccgatcgatcagcgattcggtgcccaccgcggatgtactacgtacgtacattgcccttgtcgcaagctacctagcgttgcctcgttaacagcaggcagacggtggacgtttggaagcccacgaacagcggcagctcatcagccgatcaacgcgaggaagctcaaagcttgacgtacgacggcgtcatcgtactgccacacttggttaacggtttctgatgacttccagtcataagcctaccacatctgctccaaaataagttaacctcgtatggaatatgactatgtctaaatttatagtattacaatgagagagactagagaatgaaatctcattaggatgggatactttaagtgactttttcctgatacctgatacccgagtaccggctggtacctggtaccctggtatcgagctggtacctagatatcagaccttggtacctgggtaccaggcatcatacccagagagagagcgaacaagacaccaccgtcggccgcctggtacctgggcatcttgacttcgcttgaggcagagagacgtcgccgcagcacgtggcggcacggcacctggaccacaccttcgagaagctcgcgtcggcgcacctcccgctcatggcggcgtcgcccaccgagccactcacgctcccctgcctcgcccaccgcctcccgctcaggctccaccgacgaggcgcactccacttccttcgcctcttccctcgcgtgtttgacctccgcgccctgctcccgctctccctctcgctcaccgcgcccaccgctgagctcctcgctgtcgccaccttcgccgcctaccctacggcagcggcggcggcggcggcggccggctccggtgagcggtggggcaacgacgaaggggagggctgcacctcgggtgccatctgatttagggaaggagagtgaggtaggaggaggggatccggattagtaccccgtcttcatgggataccgatgtatagattttctctattacaatgtatcatatcccgtacaagattagtttatttggttcggatggagtataagagaagaaagccaaaataaaaactgtctttgtcaccatgcaacgaactactcgatctgcctgatcaaaaccgtcacagctcccggcccaaatagtaaggcgaagcaatacgctacggcctacggtagcgatcagctagtagcaacgcgagagaatgtaagtatgtaacgcgtagagacggatcgatcgctctcgtgccggtcggtcgcgggctcgcggccggtgcgcgctagttcacgtcaatcccacgtgaatgccatgagcggcaagggggtaagcggacaagcgagctatcagaggccctcgcgtcgcgctacccgccgctccggttgcggggggctgtagctgcacgggacaacgccggctttaatgcgcgccttggcgctgcccgcgtccgtcgctctcccggccggctgggatcctgactcctttgcactgcttttctttatctggacgagccaaaacctgtggtttcctaacgttttcagattgattgagatttggaggtttggcatgatggattgtgtttggcagcgtttcgtatcgcttgaaatctactacgtacacggtacacggcccgtccttctggaacaaacatgggaagatggttcagcccgggccattctcctcgcggagaaatcgaaacattaggagttgggccgtgagcccatctgcccatggcagatcaagtaagtggtggcctgtcatgatctcttccaggttaggaataagtctactttgcttttcttaactaggggtcgaatctgatttgtattcctaaaccataataccagatattttgacaccctcgactattaaaaccagtgcaatttaactctctcggcggtttcggaggataattttactgacatggcgtcccagtcatcaaataaattttttaaaatgtggggcccccttgacatctcatccctctaataacctctctctctctccttttttcttcttggcgcacggtggctgacggcacaggcggcgagacaacgacagggagcggcaacggcggcatctggcggcgaggacgttgcggtggggacgacgtgtgaagcccgagggttctcggctccttccatcccagaggcaatgacatccatgtggcaagggcccgacggagggggtgccaactgcggctgttatagtggtgggcgcacagggtgggctgcccgatggcagtagtccagggtgacgaggagggccccgtccccctgatggcggtggtatggggaaacggatgtcgctggcaccgaggaagcggtggcttgtcgtcagggctggatccagggcatcgctgtgcctaaggcgaggtcaaggcgggatatggatggtggcgtgttggcgatgacttgggggctcgaaggatggtgccggcagcgggcatggccaccctctagtggtggcgttgggggtgctccccagtcaacaatggagtcatgggtggcggtgacacaacggggttggcgtggcctggccggcgaatgtgtcgaggagctggagatatccccgcgcccctctccctcattctgttgttgcctgccgtctcgctcctcgtccaccgagtggcccttcatgcacggagcaaagggggatgagagcgggggaagatagcgtcagcaccggcctcgtcgactgcgtctccgccgatgcgagcttgccttcgctccgcgtgtgaaacaacaaaagaaagaaaaacagggagataaggatggtttctgacgtgcggaccccacattttttccctcttatcacttgtcggtcatatgtttattttttaatttatttgatgactggactgccacgtggacgtcacgtcggtgaaaaccactcttaaaacagttgagagagctaaattgagctagttttcatagttaaggggtaaagatatctagtattacggttgagggatatgaatcatattgaaagtatattttgagagagtacaagtggacttaatcctccaggttatggttgcgttcggctgcactagttgtgaatggctgcagctagcagccggtgtgaactctgaacagagcctatgcccatcgcctactttttgaagttatctcgatcaggggccccgggcaacttgtacacgccagccgaaactgtcagcaggcacctggccagctaggcggcagcgtatcatcgtcagcacccggtctatcaccaaacaatcagcgccgaaccgactatacacacgtagtactagtaattgaatcggtacaatgaactcgtactcacgaatccccttaattggtcaatgctcggaacaccaagcacaagtcaatccattgcacatgcaggtagcaggtgttgacacctcttgacacagcacatctgccgtcctgcctccagctcaagtggccaagttccccagaacaaaccaaaaccttgtgaccacaagctcacagcttttattgtcatctcacagtctcacagaccatctagaacgctgctcaaaaaatcaaaatcaggggttaaatccaaaggctccatccaaaacccagtcacaatgcagagctagagattaagcgagtctaatgcaatcataatccgttttaattaagctcctctcttcagagcaaaaggtgccaatagtttgacatcatatcgatcctattcctgagagccgccgtcggcgtcgagacataaaaatcacaaatggatcgtggagcatgtgcttgccgcaggcaatgatgaaggatcagcattctcctcagaacagaaacaacggcagcacaatacaagcatactaccttccagggaacgaagccgccgggatggaggcgagcaagtaaagcttcagggagccgcacagctaagcctagtgtgaacaataatccggcactaagcatagcatcaatttaatacaaatcggcagaaaagcagtgtgagtgtgtgaggctttgagctaccaccactgtgattagcacgagctcaaaagatgatattattcccatccaacgaatatttggtccgagtttaatagtggcacactccaactaaacaactgaaaccactatcacaacttgcagtagcagtataaatagggcactggtcagcaacgcatgctcgtcagacagcccaaaagctgagagagagcacgcatccaaagttccaaactagtctgcagctgctgttcgtgtgcatatccagtgagtgaagtgcaggaagatgaccaaccatggcgccacctccgctgctccgtgcagagatggtcacggatcagcagcaagcaggagacacatgcccaggcgtgggcagatcaaggcgaggattgtgtcggcagccgtgcactcagtcgcctcggtgctcttgaaagccctccacagcagccacatcctggtcagaaaccccttctgatggagctatcagctagtataccgaaattaggcgagttacctgttcggctgtacctggaatcagctggttttcaagtgtaagcatggttcagaaagtgatagcctagatggatgtactcatgtacatttctttctccctccctcgtttcgcatcttgtttgtacactagttttgttattatcaatcacacagtgtggttaaagattaagcaagctcttgctactccgacccgattgcctttctctgctaccaattccgcctgatgatggtgagggacgcgaaccgccgcaccggcgttgccttcctcttgcgctgccggtggagagaatggccgcctcagccttcagtttcgagaattgccttcgcggcctcacgggcggcggagaacggggatgtcgcagactcgtcgggggacggcgcgtgtccgcatctcccaaactcgcatgtagaacggcgggaacgagctctctcggtatgcacaacactgcagcaactccgcacgccggggatgtctgtgttgtaggctcgtagtcgtagccatccaccacggggatttagatccactgcagtcgactgatcatcggcctcacatatcaggcacgatacaatttgctgcagaggatcctgaatttctgatcaccgccacggcgccacatcgtccaacaagagtagcagggccgcgccacaaggctgcagaagaagggggacgaacgggaacgacgggacgtactagtaaaagtcagtaacggaaggcggcggtaggagagggggtttctcgtttagacccgtctggtaagtcgtactggattgcttgggtgtgccacatttagtgggctttctgaaacaaacaccgggttgcaattacggcccatgtaatggagcctacactattcatcctcctcttccttttttttatataactcctctgtcctcggctcaaagatcagaatgtagacaatctcaatcacaattacacccattttccccaccgtttcgaaggcatcccatgctccaattcatgatggcctgggtcatccgtgccaaacctatgacttcatgccaaacaagctttcggtattcgttacaagtcactactcttcttcatccaaaaaatataattaaaaaaatcatctaaacacctgtaagcaaaataaaattatttttaagagcttgttcactttgttgtcaaatcaattttatcaaaatttattatgttttaatgctaccattttttggtaccgttggatatgttcaatttgatgtcttctaaaattttataatgttttttcgagataaaatttttgaaacttctcaattttgttaggatagtattggcaagatcattttaaatttgttaccatactataaatttagtacattcaaagtgaacaatgtctaactccatagacatgtgggccatattctctctccccaagagtcagcttctatgcttaatgcccaatacttttattaggactgctaaaaagatgtctataatgtatagaaaattcacactgtggatgctcttataataaatactcactagtaaggatgcatttatcatgtgtttggtcatagggatatgatgggttgggttggagaaaactagttctttaaagtgtttggatcagggataggtgagatgagatgatcatgattcctgaaaagtaatatttccttcaaataaaaggctccatcccttaaataaaaggacggatcaatctaactcactttctctcttattggcatccgggacacaccctccaaacccttaaaaatagtaccattccaacccttgtggcaaacatatactcccaatcaaacacaagccatcaggcccgccagtccgcaacggcatcatggatggacataagatcgaggaagaagcaaccacgaggaaaagaaaacgaaggattcgccacccacgctagcaattttcttctgtcaattcctttcaccattttcaggctgaattttgtcaggcttccagcccaattaattaattaggagtaggatatggtcagatttttcttctggcaattcatgcctgctcgtggatcagaccgtacaatttacgagtacttcactgtttcctttctagagatgttgtgtttggtcagatttttcttctggcaatcatgccttatccaaacagagaatggcaagatatcatctcacacaaagaaagcaaccagccattagtccacagtggcacagtacgtgttgccttgcactcttcaccttcatcacgccctgcggctcaagattcgcatgctcgtgttgtattcaccttgcaaggcaaaacacatcacgagttgcacagcaaaccttcgcttggacagaacgagtccacagccttaaccgccatgcaatgcaccacctcaaatggcaatgggcattggcagaaagcgagatgtctcggccggttaaaagctccatggacgcagcacacgcaagcagttattgccacgtctattggctcggcaagtttggcatagcaggcagaaagcaatcaataaatagcacgcatttactggggggttaacataggcagggattgatacaggacacacccgtaatatcctccaccggtctaggcactttctgtatctatatatacgtaagcacgtcctgattcttgttgcatttctcgtcctgatttgcgtcctgcagctctctctcatcacagtttcgcaatggccaaaaaaacaatactgcaggtaagtaacgctctccgtctccgtccaatccgatcaattttcgtggcgtcttaggattattattttcttatagaatcaagaaagggaattttggttggttggttggttgcaggtggtttgcgcggtggcgctggtggcgctgtgcgcgtgcggcgtcgcggcgtcaccgtcgtcgccggcgggagcggggtgccggaagcacgtcgcgaggatcacggagtacggcggcgtcggggacgggaggaggtccaacacggcggcgttcgccaaggcggtggcggacctgtcgctgcgcgccggcgacggcggcgcggcgctggtggtgccgaaggggaagtggctgacggggcccttcaacctcaccagccacttcaccctcttcctcgaccacggcgccgagatcctcgcgtctcaggtgatctgagccaccaacaacatcggttgcatgcatcaaccccctctcttattaccatttaccatgattaactgcgccattatctctatctctatctcggctggtgtttcgccgcgaaagtagcgcatgttaaatgtccggttcctactactagctctaattcacctatagctaatctaataaccaatttatatgatagtcatgtcatacacacattgtatcttggagtcgagtccgtgctgcagctgactacatatctgtagctcactgcttttctctctcatcttttatctcattaaaatatattgtagctagctaatagtctgctatttttctctctcatcttttatctcattaaaatatattgtagctagctaatagtctgctattgtcccttctcttaccgtcacacttgtgaccaaacagtcacacgcgaccgccctaaagttggcgggtactagctacttccgttttattggcgtagatgatgctttttgccagggaaaaacgccttttttggtctggggtcccatatctgtcctcccaggctcccatctgttcttgatggaatctcaaactggcaaactgttaatacgaacattaacatgctaaatgccacggttacatgctgtattttttttttgtcgtaatcaaccttatctgattgtcgctctcaagaaatgggaggacaacgtattaaggcggcgcttaaatatgtgccaagagctgtatgttgggagcttgaacccggtgatgtgtcattgcaattgcggtggttgcctattgtaaggatgagctggtggctattgaatacatgtaaatgaaccggttttgatcagatagctgattaattagtttggaccattgaaggtcaatcgatgttaatgtgatccgtttcagttgctaaccgtgccgtactgagagaaagagaatggattgggagtgttaggacaaaagctctgccatgtcatttcagaaatttctactgttatatggttgctccacttttatgctttgaattttgtcagcacataacttgtggacctgctactcttatctgtttttgttcacccgttttcagttactagtgtaactggttcatctctcattatctgaagtgttgacagtctaagctgttcatttcgttcttcagaacttggaagattggcctctgatagctcctctgccatcctacggaagaggaagggacgaaccaggcccaagatacagcaatttcattgctggatccaatctcacagatgtcatcatcactggtacacgaatgaatgcgtgatgaagattgctattttctcaaccttttcgtgtaactgctgtgattgtggtatatgtttagctgtggatatctgaaattgagcaacatttcaggtaggaatggaacgatcaacggccagggccaagtctggtgggacaagttccacgccaaggaactcacctacactcgcggttacctgctcgagctcctctactctaacaatatcatcatctctaatgtcaccttcgtcgactcgccgtcatggaatctccatcccacctactgcacgtaagaatcatcagtactcgcaaccagaattcagtttctgaacggttagatatagatcatgatgctcaccttctttgtgttccgtgctgcgccagcaatgtgaccatcagcggcatcaccattctagcacctctcaactcgcccaacaccgatggaatcgacccaggtataaacatacaagtcacactgcacttgatcaatgctgccatgaggaaagcattggtttgtgctagatgtgatgagctcttgttgtccatggtgcagattcttcctcccatgtcaagatcgaggacagctacatcgtgtccggcgacgactgcatcgccgtgaagagcggctgggaccagtacggcatcaagttcaacatgccgagccagcacatcctcatcaggaggctcacctgcatctccccgacgagcgccatgatcgcgctcggcagcgagatgtccggcggcatccgcgacgtgcgcgccgtggacaacgtcgccatcgacaccgagtcggccgtcaggatcaagtccggcgtggggcgcggcggctacgtcaaggacgtgttcgtccgcggcctcagcctccacaccatgaagtgggtgttctggatgaccggcaactacggccagcacccggacaactcctccgaccccaacgctctgccggaggtcaccggcatcaactacagcgacgtgttcgcggagaacgtcaccatggccggcaggatggaggggattcccaacgacccctacactggcatctgcatgtccaacgtcaccgcgcagctcgcgccggacgccaagaagctgcaatggaactgcaccgatgtcaagggtgtcgcctccgacgtctcgccggtgccgtgcccggagctcggggcggcgggcaagccatgcgccttccctgaagaagagctcgtcatcggtccgcctgaattgccaacgtgtagctactgaaatactgatataggatgatagtatggtgtgggtaatggcctgggctatgagatgcttgggaccaaagagatatatatgatgtggtttagtgagtaaagttaagcagtttgaaaatgctgccggataatctctttacacccaattcatttatgagtgctcatctgcgaatgacctgaccaaagcaaagccttttcattttgtcttctgacagtaaatacagcacgtgacaagataacaaaatcatcaaacttctaaacgaaactttgcaaaaacaatgacaattgacaaagtgagaagcaaagctcaacgtgcctaggcagcggtttgcaatcaccgtcttcccctgcccttgctcatgaagtggtggcgcttcaacctcttcttccggatcaccacggaggacttgatgtgctccgcgaacggcatgccaaggagggtgagcagcctgagagcctcgttgtcggtcttcgcggtggtgacgatgcagacgtccattccattcttcttcccaccgacctcgtacgggatctccgggaacacgccctgatcacgaaggcctatggtgaagttgccatggccatcaaagctgttggggttgacaccaaggaagtccatggtcctaggaagcccaaggttgatgagcctatccaggaagttgaacattacctgcagcaagccaaaataagctcatcgatcaaacatattccctaggttcccaaatacttgtcactggatactattcatatttgaactttgatcacttatattttttagaaaataaaatgcatatacctaaaaatatgccatattattaaaggttgttactccacatagataggtattaaactttcgttcgtccaaccatttaaaatttgtggtcaatgtaaaatactgacggccaacggtgacaataatttggaactggatggagtaattgcaattctcacacatactttaggctattatactgtcatgcaaatcccaaattgatacaacattgcagtccccaatttgtcaatgtctgcatcgcaagtagccagaggtacagaggactcaccctgccgcggagcgtaacggcaataccaatggtgttcccctcgcggatcttgaaactggcgacggacttcttggccttcgtcttgacgggccactggccggtgatcatggcgaggtccttcatggcggattcgagccccttggagttaccggcttcagcccccaacccgcaattcactacaatcttctcaaccttgggcacctgaataaaatcgagaatccaaaacacactcctctaagctcaattattgaacaacaatcgaatttcccgagttccgcaaagaaatggccatgtctatcctataattgcgagaagggagacagaggtcgaacacctggtggacattggtgtagccgaactcctcggtgatgagggggaccaccttctggtcgtatacagccttgaggcggtgcaccttctgtgcctcggtggggtcgacgaggacgatgcccgaaggcgaggtcggcggcggcgccggcttgggtggcgcgtcggccgcggcggaggcggcgacgcggagggctcggcgaggaggcggggagcggaggaggaggcggacgttacgggaggaggaggcggtggtggtgacggggaagggggccggcgaggacggcagggtcacagccgtggccgccattggagcgtgcgcggagacggaggtgggagctgaggagggagctttatgccatggatggattacgggataaggcgagttggctgtggctggctgccgttgctgtccagtgtcgcaggtgggctttctcgtcatggttcggcccatcgaactgttcgacatggtttcaggccttaggcccatcaaaaccgttgatttgggccttaggcccatcaaaaccgttgagttgggggtgaactaaacacggcctaagagaagggtaaagttacatgagtcaacaactgcaagtctgcagtgtgtgaatttcgatatatgccttgttttggtcaaccggtaacagtgtttgagtatgtggcccattctgtattttctaatgcactacaggacatcactagtatagtagtagtatgccattaaacgatgacttcaaacataaaaaacgccgatgaagagcttaaacaagatcaagcaaactctgaacctagcaacagttgctggcagatcagcaggagatctgccacgcttgatcaacattgaaaaatggacggaatatcacgacgaggatcctcgtcacatgcttatgcctaactaatcatgcagtaaccgtaacatgcagttctttataaccaggggacaatcactaggatctgatttgaaaggtcccagatcacaacattgcgcttgccctaccttgttctaccaaggaccagcaatgccacgaccgtgatcctgtgaggatcgacttgacaccaagagtagaaacacaacggacaatatcttccttgtcagtttgcaacctaatcctgataaactacattaacctccttgacctcaagaagtaactgtcagtctgtgaccttgtcacttgtcagggccttaatgaacagccattcagcagtatggaggaaccgcctagtgtgcataagcttcattaattcttcttcacggtcaaaaagtaatcagccatgcatcactttcatatttacatccggcacatctcgtgaacaagagatacagaatgtcggcaaataaagaatataaaagaaagtacacattttatcagtgaacacctcactgtcagcagcacgactcaaccagactaataaattcagaatggtactgattaatatatatcattaccagcagtactagcaaaagcatcagccattcagccccagcacatcatttctaatacctgtgtgctccaccgtccaaatgagcttccaaatatctatctaaattattcttctattaacaggacagaaaagcatattacaaggctacaattgccactgaagcaaaaactaataagagatgacagcaaataaaaagaaaaaaatgtgtgataagtagctctcattggatcgcatctaaggtctctttcctcttaatcctcctcttgatctccttctccagctcctcaatcccacccacctcctccagctcctgtcaaccacataaaacagagacattttagaacatttcagacaatttttccgacgatcacaaatatttgtaatacatcttagaacatttcaaaatttccagtccttttatatcaacacagttcaaattctacattagcttcccaatcacaaattcatgcttgcaataaaggagtactgcaagtatgcaaactactcgacaaatggacaccgttggagcaggagtaagccaacaagcatccatggtagcatggggcacgaggaagcaaagcatgaatagcatgagacacatctcctcaccttgggaccaaggaacagcccatatggcacaccttcgaacttgtccatgtgatgtatctgcaagaatgaatggcaggcaaggatggatcagctcacataaattcagaaccacggcaagagaagctcagagacagggatgcgtggtcggctgcagttaggtggagagcgaccgggccggacctggtgggcggcggcgacccgccggaagtagggcacgttggcgatgggccccaccgggaagcggcggtggaccaggccgtcgtggacgaacatgtacgccatcccgaacagcgtgatcccgagtccctgcggcgaacggacacgtcagcacttggatcatctctgcccagagccccagatcacaaaaattcaaccttggcaatcaaattgaacaaaaagaaacgctgctagcgcttgtattttacttgttccggtgagaccgttgatgggtacctcgcatgggtgaccatggcgccgtcgcaatgcgacaacaatacctattgctttagtacaatctacgttatagggggaactatttaatcattcgagggatgttctctcatttgcttacagaatatccaaaggttatgaaattttttgacaacactcagataacatatctgtgcaactacataaaatcttatattcaaactcaactcacacgttgagatataaaaaattaaattcaatgtatgattagtagcgtaatgttcacatctgaattatcttttcttttattcgtgttgtgtatatggaagttgaacataatttttggtggactgatagatctcactatactctacattattactttttaaaaaaaaaaattcataactatttgtatcgaatttgaaagagaaaaatatacgagataacatccctcaaagatattagaatccattataggtttctctgggaactcatggaggccaggccactccgtttttctaaattttctcgatctcgaatgttcaattttttattgtttatccgatgcagcaaggacatcaagatcttttggagttcgctctacgctttggcttctcttgacagataaattcatttttttttggcaggcggccatggaatgtgaatgtaatcaactgaacatagtactacatcatgcacttttgtcattttaatacggccacgttaagcacgcttggtcaaatcctggtacagtgtgtttgagagaagtgatggggatttggttgaaatggaggaggatcgaccactcaccgcgccgaagcagaggccggggacgaggccgcgggtgaagaagccgtaggcgaggagggacatggccgggacggcgttggtgatggcgaagacgtcgttgagctcgaacggcccgtctcgcgggcggtggtgcgactcgtgcatgtgccacagcgacgcgtgccacagcgcccggtgcgcccaccgcgcccagaactccatccccacctgcgcaaaatggcaaggcaaaaccaacacggttacacgagcgacgcgcggcgtcgtgcggacggtgcgtgtgtgtgcgcttaccgcggcgcccaccgatagcgcgaaggtgccgaacatttccgtgaccgggatctcgccgctgccctggtcgagcacgcggagaaattttagtgctgcggcgaaggaattgccgaattgggtaatggtaagatgcgagcgggagtttggcgatggcgtgttacctacctccatttgccaggcgaagcggtagtagacggcggcggcggccatggacgtgatcccgaggctggacatcaccgctgccaccaggtacgtccgccgctccgactgcttccgcgccgcgcgctccgccaccgccctccgcgcatcctcctccggctccggctcacccaccgccacgcgcaaggggacggccagccgccgcgccgggagcggcgcgaacgccagccgcagcagcgccgggggcgatcggtgtgccgccgccaccgcggcgggggagaggagaggggcccgcgcggccaccagcctcgcgacggccatggatgccgcagccgcagcctacgcgaacgcggacgcggggatggatggacggttttgattgggcgggtgaagcggtccgcgtccgcctcggggagcgagaggcgtcgtccaagacaagtgggtcggatggagtcgccgtcgtcacgagtcaacttgtgattgtgagcatggaaattcgtgaggaacgccggctcggacccggtggcttttatataggagtatcaggggccatgtggaaacagcgacttattcacgttgacactaatttagagtattaaatatagattaattataaaaccaattatataaccttatactaattcacgagacaaatcttttgagcctaattatgtcatgatttgacaatgtgatgctacagtaaattttttataattatagattaattagacttaaaaaattcgtctcacgaattagctctaatttatgaaattagttttttattagcatatttttaacactccaaattagtgtccaaacatccgatgtgacacggactaaaaagtttttagtcccatctaaacagcccctcattactccctctgtttaagatggtataaattataatacaatgtatctggatatacctctgtctatatatgttgtattagaatatgtcacattctattttaggttgttttttttttctggagggagtaggcacgaatgcacgatgcggatgcgagctgagtcatgcatattttggaatggaattattctcagatcatcagcaattggtgtattggagattaaggtctttcctgaagctggggttatctcgttgccgctgggtgattggccaggttgaggccgcttgcctgagctaccgcggcgtcaggggcagtggaaaatgacattgcaggttcagggcacctgattcgccacgtggccgtctcaacgcatccgcgcacgcagcttctggtcagctatacaccgcgccggcgagccgtcctccgctgcgtcgccatcacaacgagttactcctgacccctgatctcaagcgtcggagttcacctttcgattgagcgctcgattctggtctgacttataaaggtgcgacatttttcatcattttcttatcgggaattggctgtttattatatatctaaattcttgaaaactattcaaaatctctttcagcatatactttcatcaagtatccaaacctcaaaaattctgagatttactatcggttttcgtgaaaaaacgtaaaccctaactgagatctgtatgtagttcatgttctagctcatcatcgttctgctccatgcatgccatggccaatgcttgctgggcacaataatttttaccaccacacttcttcttttaggcatagctcctttcctttgtcgttaaaaaattggagaggatagaacatctttctaaagtacgaactccacctgatcatgttcgcttatccagaataggaatgtggctgcctgccctacgaacgccgtaggccatggaaggggtgtgtacgtgtcagggcagcgtcccgacgcgagcgtttgcccggcgaatgctgctgctcgccgccccactacgtggccactggcatgtacccaccgcacttgccgacgcccacgctttcctcccgctgcagtcacgcttcagcagctcagcacctcccactcgtgaattgggcaccccatgaaaaagatggaaaaagaaccaaaccgcttcaacctcaacgatctactattaggggtttacaaaaccacacgattaacacacggttattacgattaccatgcacgataacctttgtagtttttaaaaccacggtatgtcttacggttaccgcgcggtaaccatcttaccgcgggagttcggtaaccgtattaaaaacggtaaggggaaccctactacttttactcagaaccttagatgctactcagatcactataaccactgggctatatgactatttacgaagccctactactatcccccttgattatactcgcaagaagagacatctagatcttttaccttcgccctggtgtagtcaagtctcatcgtttcgctacctgcttacctggtgatcggtggttcggtacaaacacgacggaatatacgagtgctctcgtggtgccgatggcgacgcgcgacgagaggccacctgacggcgacgggagcctcgccgtagtgggggcggccgcgccgcggttgctcgcgctcggcgacacgtacccgacgggggatttaggataactggttttcggaggtggacgtggtggtcaaacgcgcggtgagttttttaattgggggaaacttttggatgatttggatctccaagctgccgtaacagtgccacctattccattttcgcggtagcctgatagcgtgaagtgtgaaccctgaaatggacggataatggaatatggcaatatcgcatacggagtatgcaaatgaccgaatgtgtgtgtgcgggtcgtcgtccacgtttctcacagtctcacctgtctacgacagcaatcgactactactcctccgtctttgattttaatattttgtttgtactatttaatcatttattttattaaaaaaattatacaaatataaaaaataaaaaattgtgtttaaagtactttagataataaagtaagtcacaaataaaataaataataattctaaatttttttaaatgagacgaatgatcaaaacagtacaagcaagttaaaatacgttatattagaggacggaaggagtactacggattgattgatggatcgggatggctttgaggacaaatatctttgctatctgcttagctgcagtcgatcgagcagttaactaattggtttctactccatggagtaaaaggaaaaggaatgaagcatctattgttctctgaaaattgacaacagctcataccactaaacacgctaagcatgtgcaagaaaaataaaagaagagcggcaaaacatatactctctccgtcttaaaatataacaacaatcaatcttgtatgttcagatttattgtattagaatatatcctatccagtacaaagttgctatattttgaaagagatagagtagcagtactaaaagcgctaaagcatgtttttagtaaaagaagaagaaaaaagcgactcaagttctcaaactcatgcttaacacgctaaacatgtatagtaccaacagtacatgttttagcggcacctttgaaaaactaggggcacctttgaaacgtatataatattaaaaaaaatagatgaataaaaaacacataattttaacagaataaaagtacgaaacaaagtccattaacataattaattgagtattaattattacaaagcttgaaagataacttcatttgacttttaaagaaatttctatataaaaaagttatttttagaaaaatcatttagtcgtttagaaaacatgcttatagaagacaaagagttgtaattgctaaacgaaaaaataaacgaggccgaagtgaagctaaacaagctatgaaattaaataaaagaaccaaacatgtactaagtaaagctaaacaatcttttttgtttggcatgaaagctaaacaatctaaaacatgtactgccaagtaaaacaatatagcaaagcaaaaaaaaaaagtaaagctaaacacgctaaaaacatgaactaccaagtcaaaaagctaaacatgcactaagtaaaacaggtacgaagtagaagcacatttcttttacccattcataaaataaatgtactaaaaaaacctgaaccacatgtgttcgctatttaaggttcccaaccagaaccctccgtacggaaaacggagcgatccattagcgcgtgattaattaagtattagctatttttttttttaaaaaaaagattaatttgatttttttaaagaaacttttgtataaaaactttttcaaaaaacgcaccgtttaacagtttaaaaagcgtacgcgcggaaaacgagagagaggggttggaaaaggggtgtccgaacacaccctaagtagaagcaactaaacatgtactagctgagaaaaaaaagtagaaataaactaaacatgtataagtaaaataataagcatgaaattaatacacgtgctaataagtataaaaaagaacaaggtaactaaacatgtactaattaagttaaaaaagtacaaagcagctagacgttgtactactaaataaaataactaacaaacatgtaatcaatacatgtcccaagtaaaaaaaatgcaaagcaactacccctctgtcaaaaaaaaaaaaaggtccaattctaaggacaaatctggattctgaatacatgcaatccagatttatctctagaattaattttttttgacagagcgattaaacttgtagtagaaaaataaaataaaacatgggccaactaataccacctaagtactccatccgtctcaaaataaatatagttttgcactattcatgttcaatgtctgttcatcttacttgaattttttattagtatttttattattattaaatgataaaatatgaatagtactttatacgtgagtcttttttttcataattttttcaaataatacagacagacaaacgttggatacgaatatccatggctacacttatcttggaacgaatgcagtatatactaactccgccccgaacaaatataagtctaggttgtttagcatgtattaagatttgtgaagaaagattattatgcctcgcattaataataggaaataattttaatgataagtaaatgatgggacaattaagaatattttattatgacaaatgttgtaagaaaaattaaatcatagaaatataattattatgagatggaggtagtaatactaggacaataccaaacatgtagcaaaaaaaggtaaaagttgaatggttgttaagggtaaaatagaaaaaaaattaaatgataagtaattgatgagacaattaataatactatattatgacaaatgttgtgggacaaatttaaattaaaaaatactaggacaaaaccatacttaaaaagtagtgggacaaatttaaatataaaaatactaggacaaaaccagacttgtttaaaatataaaaaatactaggacaaaaccatacttaaaaagtagtgggacaaatttaaatataaaaaatactaggacaaaaccatacttaaaaagtagtgggacaaatttaaatataaaaaatactaggacaaaaccagacttgtttaaaaaaatttataagtgtggctgctgggattcgagcccaggtctccacggccacaacgtggaattctcaccactaaactacagccactttattaaacaaggttaattagtcatcatatattgaataaaatatggttaaagcacaagaacaaacttccagagcattttttgcacgcaggggcagccggtagctaaccgtatctgtttgttattgatcgcagggcaaaatttgcagcttggcatgctgaaaccgcgatatacatttgtcgggcagatctcagtgttactctaagtctgaatgataatagacattcgcttcttcagtaattttcctccaccctcccattgtcattgtcgtgttcttcaagttcaatctgaattccaattctcaagcactgatcgttccatgaccccatcggtaggcaaaggagcaacaatttctacagattttcctttccagaaagcgatctatagatttcaccttcaatcaggaaggatactggaaggtagcaataagtgaaccgaacggcccaagacaatccatcacaaggatggcccatgtgaaagaaaacccacccaactgcaaattactaaggcccagcctgggcaaccaatcaccgacctttccagagcccaccgtatagcaactccgggcctatacggcacggcccgttatcgaggctcaccaacccgagcgggaatctccaggcaaaatcatcggctgcctcaaaacccctgagccgtgcatcctagggtttccctctcctcctcccctctctccccgtccggcaacgcagcctcaccgttcaggcggcggcgaaggccgcgtcgaccccgcgcagcgcaggcgccatggccgccccggaggcaccctcctgctacgttgggatcgcgcggcagtccgccgccttccgcctcatgaagcaaatggtgcgtgatactacctaattcaaagttttcctcatgcgttggggcatgcagtatgctattgctagacgtaggtttatgttggttaacatcggttgatcctgtcggatatggagtctgaaggagttgctgttgttgttcctgttgaattgtaactagcaacgtttgttaatgctacggagtggaatttgggaactgccgcaaacgagtgaacttggcttggattttggaaaggagttgaaattcacattcttcacgagttatggctgcacatagattgaatttagtgtagttaatatttctaatcgaaccaaatgagtaacgtgaatggaatggtggtttgcactccataaacaagtttatttcgtcagattatactgatttttctgtaatttagatttgttctctttttactgattttaaagtgtagttagcattttttttttcattatgctttaggggtgggaagaaggtgaaggccttggtaaagataagcaaggcattaaggggcatgttagagtgaaaaacaagcaggacactcttggtatgtttctatatagatcttctactttagaagtctatttgtaaggatatatatccttgttaaccacccgtgggctctcttaaacctaatctgatcgtttctgcaggtgttggtgtagacagtcctcataacaaatgggtatatgacaccacccaatttgacaatatactaaagaaactgaaagtggtatggcgtgtaacaattactttgtttgctctatgtataaattggtcattatttcagttcctaattgtttcctattatctttttcttgtcatttgatcgttgctcccatcttctttggcagcaatccgctactcctgctataaaaggtacctgacggtgtttgtgcgtatagttcttattttcatcttgttaggtgttgtttgataacatttttggtgtagcagaatttgaagatgatgtaagcaattcaccagatagtacaccaaaggaagctaaaccaacaaacaatgaagttaccaaagttacccgaccccaaggaaggttggtttgctcccatagcttcagtatttgtatttctgtatctattttttcttctctttacagtttacgcaatacttatttcagatataagaaaagagagagggggaaaagtgtgagcggttattcagcaaaagatcttgaaggcatacttgtgagttgttattcttatgtgtgcctatttctttcttagctaatctagttactatccatgagcaatttttttcttgtgcacctgtgtaaactgtgtaacttactttattacatgcatgaaatattgtgtttgcacaggttcgcaaaagtgatgacaattgcaaagtggaccaggaagttgaaccaacatgctgtgatgaacctgatcccatcatctgtcaagatacaggtctgtaatttgcatgtttagtttccccatcattgcttcttggtctgagccaggactgaggtgccaaacttttagaactagaatgtgtacacactgcatacaagtcactgaacagctaaatggtaaagctctgctgattatactcatatactgttaattttggttctctactagacgagatctaccatgtcagcatctaagttgctaattgcttaccagagtaaagcacattttatttgctctctaatctttctctcttcactaatggtttgaattgtgactacctgattggttgtactgcacatggtctgatgcttggtttggattgaaatgattctgataaatttgttactctaaatatgtaatcttcttttgagaccatagactaatatcattgagattttactaatagttcatgacaactctctgttcagtatcgcaagctgatgatgtgaactggtgggggcataaatttggattcaagtcaggcggctttctaggagcaaaatcgcgcaagaacaaatcttctgctacaaaaggtacttcaaatgtccgccagacatttggggaagaagaccaagaaaacctatacaatcttgttcaggttggtattaacagtctatcagatctcccataatgtcctataacaagactgtccatttcttaatgtgcttttagagactttttaaccacatataagcaacttgcctttgaattctatatttttcttacagtttggcctgaaattgcaaagtcaatttagacctctgttgattgattatcgaacaaatctgatgtatttaaaaacatatagatatagctgagttctcaataatatccattccatctaaatggtctttgtaactgctgcaggacaaagccacatctggaaagcagggtcttggcattaagggtctgccaattaaagttgccggacaccgttggaaagggaacaaaacttcttttggtgatagcgatgaggaaaattcaacccaatccaatgaattatcagagttggaagaagatggtgatgaggaagaatctgctaacgataatgaactaatagacgccaatgtgaatactgtgaaagaaatgtgcgtggatgttaaacaaaaacataaaaccaaggtcaagaaactttgcaaaacaattcttcgtcaggtatggttgtttaattatcatactctctgtatgtggcttcatgtgttgtgccgtaatcacaacgtttatttacttgtattattcccaggccccagcacaatctatgaaattgaaggaacttaaggtagctgttgaagcacattcagagtctatgttctccaacttctcttgtaggcgtgaagctctattgttcttaaagaggaaggtacgggttttctttttcatttggcagaggctttgcgatctttctctctttcgttatggagtaattagggagcacctactatagaaggtatggtatgtagttgcataaagaaaaacagatagcagatttggttgcaatgtaacttgttgggatcttcaccatagccattgtatcatcagcgtgacctcattgaattagaacagaagctctattgagctacatgttgctactgggcagcggtgtaatagccttatttaacctttttctgtctattttgcagctccaaggaagcagaaaattcaatattgatggcaaacgggttcagcttgtatcgtaaattacgaagccgttcgggtgtgacatgaagccattgtggtcatattaggctattcgtgcttctgatgagtgtacgaaagtacggagcacagtatgctctgcggtatagatgtaagaagtaatacccctcacgcatggggggtcaaattttgcaaaacttacgaacggctgagatgctaattgtgtgtacactgttgagcacatttgattttcatcgttcatttccctacagcaaatgtttggcagccggttctgaataccaatgcacgtcaatattgtaccttagctggtgtattagctggtgtatcttcaattattatacttctgtttggagcgtgtggtatatgattggagctagtttgtgccaacgttcagaggcgctctacttttagaacatgttttttgcacattgattttgttattatctgaaaccggtgccaccccctgatgattttgcctgattaattcgtcatgctagttaaaaatatattttatttgttaaaaaaaatattgttgtattgatatttaaatttactttcataaggttataatatatgagaagttagaaggaaaaagattagttttgaagaccgtatcaactttgatcgagctttgtattatattatggaatagagggagtagtactgttttaatttcaccagataagatatacacaaaccctggtgattgtacatttctactgacctgccacgtggcactttacattcgcatagtcagcttcgttcacagcggtaggcggcggcccggcgtcttgaggcgatgcgcattggtcgggggaattcgggataagcagcgaagtcattcatggtcgcgccagcgacgccgaggccgtcgcggatcctgccgcgagcgtcgcactcccactcccagccggccgccgtcggcctcgcgtccgaccgcgccgccgccgccaccgtctcctcccgccgccgccgcaacttcgtcttcgtcgtcaacccctccggtactcccccctcctccaccccgctacccttaccccctatcctatgcgcgctctcaacgcccttcacgtcgtcgcaggcgccaatggccgcacgggcaaccagtggaagcagctgctcccgcacctccgcacccgcttcgctgaccaatgcgatgtaagactttcgatttctcttagatccctggatcgtagcatcctgaaccggaagctgcaattgctgtatgagaccatatttgggatcagatccccatgctaatttgggggctctacggaatgttctgatttgttggtattgcgtgatcagatttgtgagtgcatcacctcggccccgttcgacgccatagatatcacgagggaggtgtgtatgggcttcctatagctgccagtatccaattgttaatttccccttttggttttcttgttacaatgtgtgtatgatgatgatgatgtaggctgtaaaggatggggctgatgccgtgattgctgttggtggtgatggaacacttcatgaggtattatttgtgttgacttttgcaatatggatacaacctttgtactaaatttgtccagaaacttgatattcaaatacggtaatatttgtggatggaatgtgcaggtcgtcaatggcttcttctgtaagggaagtcctgtccatgctcttgatcaaggacctgatcattccacagcgcttggtgtgagtgtacttagtttctagctattctatccaatcagatcacccttctagcctcttaaattaagcattagactattctgaactgaaatgtttgtttatgcactggaatttgttcggtagtgaagcggattgtttttctctgacagctcattccacttggaactggttcagactttgcaaggacatttggctggtatatttctccagcataatctacatatggtgtttagataacctctactttcactgatgtttctttcttttgtgcaaccaggacaaatgatcctcatgaggcgattgatcgaattgtgagaggttccttctttgattcttcttttatagtgtgtgctgtcagtccatactcgtggtctcatagtggtcattcatctcctggtatatgtatatgaatgcacagtaacattattaaagtaccagttgtcatatgactagccaggtgattgggtttgtcttaaaagatttgaaataaagtttttggaagcataacaatgaaattgctattataaactggccatcttcatgaaaatatacaaaaactagatttatgtctactacgaattcgcaatcataacatatgaggctcacaggtgcatatttttgcaggagtcaaatcaaaactagatataggtatgatggaaggcccagatggaaacccacattattttgttaatgttgctgatatccatttgtaagtcaagcatggctcatttgacctgtgaaattcaatggatggtttgaaaaggaaaaaattgctctgcacctgcaggagtgctaaggcgggttatttttcttctatgtacaagagatttggcaacttatgctatgtttttggagcgctcagagccttttggggacatagtaatcgagatcttagaataaaggtttgcatcgcactggttttagaaggaagcttagttgcaatcttactgatttttttcgtcattatcagtcccacacctcttgaatttactagtgcatataataggtaaatggtggagaatggaaaaccattcgtaaagtcactgcactatgcataggaaatgccaaatacttcggcggtggtatgaagatcactccaacagctgatcctttcgggggtgaccttgaggtgcctaaaaagtcatttttctttatagttttgagtaagcattaagaaaagttagcctttgttaatttatgtgtcatttcataggtcgttattcttcaagatttcaaatggcatgatttcctgctcaagcttcatagattgtatggaggaactcatctatcagtgactggtgtgtcatcgataaggtaaggggactccgctaatgaatcttagtgttgctctacttactttaaacaatgctgagttaagggttgtacttctggttggtttcatccaataacccttcagttgttatttggcatataggtcagatctccggacagattaatcttgttagcatcatcactggtagttttgcaatgacatgatggcaatcaaaattgttgaggaatatttattcgagctctatgcctctattgctttcctcctgatatgtgtctcattagttctaaaacaggattcaatgtttgttaagccttctcaaaatagctaacatcactattaggctgtttaactgggtattctatttggggtcactaagtgacaatatttttgtcgcagagttcagtcgattgaagtagcagaaaaggaagttagtgctgacatctttgtgcaatctgatggggagcattttggttttcttccaaccaaattttcagttcttcccggtgcagttgatttcttctgctagattagtatgcttcttcctgtgggatacaaaggtttcttaatccttgtcaagtcactacgtgtactttgaactagctgtgttattttgaagtgatatcgtaattgaatagttacattcattttctggcaatacatgggataaaatctgttgtcacccgccatgtaatgactataattatatgcaacatttgctaatcaaactaccataaaaatttggtggtgacggtgcactatgaactgtttgaattatactggaccaaactggcatcaatgtaaatgacacaatgacttttaggcttgtaccctgtgtaatttatacttttgccttttgctcaacaacagaaggacatagttagctgcagtttcaatacaaaatttatttaccttcagcttccaacttcgaagttactattcttactcatagtaccttatgaatcagtcacacgatgtactcctatatgagactgatgctgctagaattcaccacccaacgttttctcaagagtaaattgcactttacactggtaaaacgcacctatttttgctttgtactaattttagcacatactttcagtttttatcagttgtactccctccgtctcaataaaaagtgcacttagtattgggtgtgacattttatagaacacttatatgaaatgtcacatccgatcttaggtgcacttatattaggacggagagaatattgaaataagtttcactttatgttaggatacatcatcaaacctatagaaaattcactaacttatataaaatttgaataaaactttgtgaaacatgttctaaatttgaatgggtccataaattccacttgtgttttataagattttctttcaattatgtgctgcaatctagaataatatacctgcatggaagtcaaaatatgtactaaagctggtgcaaagccaaacaaagatatgctctacccaatgctatgtaattcctccgtcccaaaatgtaaagagttttggttgaatgagacatgtcataatactacgaatcttaacagtagtcttacggattaggatgtgtctcatccaactaaaacttcttgtattttgggattgaaggagtacaatatactcttctcttaatttgtttggttcatctattattttttaatgggtatagtattttgttagggggagtactaatcaattacacggccgtacctgtgattatgaagtcgatttaaaatttctttcttgtgaagtgattctcaagcagagtatttgctgtttgttccttccatacgtaaggaataatttctgttgcttgaaaatttaaatggccattgagatactcctagaaagtaccctgtcccctgatgctgcggcaccagactttaaccctgtctatgacttgactttattctcataatctgccatgttctcctgtagccctgtcgcttgaccatgacgacgtcatacttatacgttctgaccttgtaaaacttgtactccctccgtcaaaaaaaaaaaaaagacaaaccctgggtttccgtgtccaactttgactgtccgtcttacatgaaattttttataattcgtattttcattgttgttagatgataaaacatgattaatattttatgtgtgacttgtctttttaatttttttcataatttctttcaaataaaacggacggtcaaacgttgaacacggaaaccagggtttttctttttttgggacggaggtagtacttcctccgtcccaaaataagtacagccatggttttccgcgcccaactttgaccgttcgtcttatctgaaaattttttgaaaaaatttgaaaacataagccacgagtaaagtactattcttgttttatcatctcataacaacaaaaatgctaattataaaaaaaattaaataagacgaacgatcaaagttggtcgcgagacgaaggtagtactacttacagcagctttggtcatgaacagcgtgaaaagaaagtgtgttccttctccgctgccgcctgggcaaagaagacgaaaataatggtagaaactggaaaaaggaaggaaggcttgtccaaagcataatccaataatcctacgtcgtgacaggtacggtatccgttttttccccgtacgtccttcccatgtgatgcgtcaacagttaaaaaattgccctcttttgctcggctcatccgcgcgccgcgcgcgtctcggccaacattggcaaacacgcgacgcagccaccgttccgtccccgcatcctcctgcgtctcctcgtgctcgtgcggctctcgcgctcgctgcgcgcctgcgccgaatcgagcgaacgccgcagccgcaggttgcagcgcgcgcgcgcacgtcgtgtgcccgtggctgcgtgccgcgagtcgcgacgccatgctaaaaagaaaaaaaatatcaccggacgcatcgcgtcgtatcgggcggagcacacgagtcatggacctgtacgacgttgtgggggcgtgagttttactcgtcctcatgtcatgtcgtccgcgagaagcaaaaggaatttacgcacgcgctcgtgggtcgggtcgtggaacgtgaacggcttgtacgtcggggtatatggggacaaaatggccttctgttgcgttgctacaccccgtggttggcgttgcacgtaaggcatccgatcgagcagccggagcgagccggggtccgggggtctgattgtgtgaacgaatcagtgatcgcctgaatggtgatcggagcatatatgctttggctggcccggcgtgatgattactgcgtagcacagtagcaggacgcactggaacagtactagtaagaaggccatgattattatcgtgattagagtacacagcctcgtaattgcacatacgcaacggaggcgctgccaggtgtcgtgtaccattcttttggtattagacttgccatgactatcgtgtgaatgcctgaatggcaattccgagccgtagcttgcgtacatcttaaagaaacccactcatcgcgatgacgctatcagccacatgaacatcaccagccagactgtatcctcagggagcccggccgccaattgagaaaatctgcaaatgggtacgactgctaattactactatgatttaataacacaatagtagaacagtgtgaaggtgatactaccaaatattcgaagccttctctctctatctctccacgagtccatgtcaaatggagaaggaaaagggtggagctcttttttgcttggccctgcatgcgtctgcgtcagagcgcgcacgaccagcacacacacccccacattccgttggtgcagtgcagtgcggtgcgcgcggctcaactttgaaagcggacggccgactgactgacggctcgacgtcgccgtgccgccgagctgtcacgcagctagctgacagccaatgctaatcttggaagcgcacgtcacctaactcctctccagaatccaaatcacaaggggccccggcacacacaagtttgcaacgaggtggtggtcctcactcctgaccgtctgtcctagtaatgcaaggggaaattatcctctgattgttgatttgtctccacatattaggccccgtttagttcccaaaattttttcccaaaaacatcgcatcgaatctttggacatatacataagcattaaatatatataaaaagaaaaactaattgcacagttatggaggaaatcgcgagacgaatcttttaagcctaattagtccgtgattagccataagtgctacagtaaccacatgtgctaatgacggcttaattagtctcaagagattcgtctcgcggtttccaggcgagttctgaaattagttttttcattcgtatccgaaaaccccttccgacatccggtcaaatgttccatgtaacacccaaaaattctcttttccctaactacacatacccttgggagtgttcgttaggtggagataggagagattgtctatcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggcttacctcgttttgcgtatcttcccaatctcctcaatccccttctcttcaaacactccctagtcactttcggatactaaggaagagctacggcttgaacaaaacgcataatttccagtcttatcctctattcaactcctcattgtattaattgctgctcccttcgtttgaagttaaaataattatagctatatattattcagataaaaataactatattttagaatattttagaacagagaaagtagaaaggagctctcacgtttggccataccatctagtaactatgtcaaccaatagatcatacttcctccgtattagccattaaactgatgagtatcggtaaagaagttataaaatctcattacaatgcgtgggatgcgcgatatagtcattactatattttaactcagtgttgtggaagattaagggcggttgcgcaattgtcatgtatctcgtgtactgtcaatcataagtttcaattcatctatacccctttaaaagtctttaatattggttgcaaagaatttgccctcttaccattgcttttgtagtttttagaaattgcatcattatgtttttcatgacaattgctctatccatatttgaatatatgagattattcggttatatctttgaaaatttaaccgtcaatagctctaaaaacagttagtttgaaacacataacaatcatatgggaacatttttatttatatgtagttttacaatataataattttgttacttcctcaatcccaaaatatagctatctattactccaggagtacaactatagatcaggacaacttggtagctatgagccccattggttgtcctaataaatcaaaaccaaagccagaacttgaatttttaagttgaatttaagatattttcaatgtagttttttatattgggttttaagtcgctaataacacatatataaaagtgttacctataaattaactttcattctctaataagttgtttttggcttattatgatatatgtgcaatcgatgaggtcttatattttgggacggagtatttaaatagaaaacaataggtcaaataagtctcagtaacacctgagatcctgggttcgattccccacgggaatgaatttttcaggatttaacggtattgtgctttcagtggtaggcgacgtacctgtcgacagcgagacgcctgtggtgacttcgtcaatcctaatggatttgccggcccagtcttcggagatgctcataggggtagggtttgcgtgtgtttatagaggtgagtgcatgtgcgttgtgagtgtctgtgttgtactgtataatttttttttaaaaaagaaaagatagatatggtttacatgcactcttgctcagagattgaatttcagtggtgctgtagacctgtggtgcacaccatatccaaattaccatcgtccctactacagcactactcctttcttagctcactgtcggtgggtccacatgacaaactgggcccacctgtcatacgagcgtctcaaatcggtaacaacaaactcgctagcctcaccacctcaaaactcaaaagttacccagaacgctccccacgccgctctctcgtcgtcaagtcgcatgcctatgtaaagcagagcgaccaaagaatccaaggaggccaaagcgctctctctctctctctctctctctctctctctgcttcatcagctccccgtggcggcgatggcggctcagaggaggctgctcgccgaggcacctccgcaccagccgcacccctcgcggcaccagcagggcgcgccgtcgtcggtgtggagcgccgggtacctcaacgggtggctgtcgcagcgcacggcggtgttcgggctccgcctctgggtgctcatcggcatcgccgtcggcgccgccatcgtgctcgtcctggtcctcgtcttcgtctgcctctcccgccggcgccggcgccgcgatgacctcgcatccaatctgtacccggccgacaccaagattctcaagcagcatctccagcagcccacgccgccgaaggacatacaggagatcgttcgccggcagcagcggcagcagcagacgccgacgccgacgccgccgcagccgcctccaccggcggcgcaacatggggtgcagctcgccaaagcagagactccgccgccgccgcagcggacgcagccgccggtgctaccggcgggatccacgcggtcgacggcggccagcggcatgtcggccacgacgagcggcgggagcgagcgggacggcgccacgccgaggagcacggcgagcggctcggctgggccggaggtgtcgcacctcgggtggggccattggttcactctccgggagctcgaggaggcaaccgacgggctcgcggaggagaatgtgatcggggaaggcggctacgggattgtttacaagggcacgctgcagaattccgccatggtcgccgtcaagaatctactcaataataggtactaatcctgtgccttctcttggagcttttcgatttgatttggacatctccagcctttccatccttgtatagcctagaattcgtccttgggtgagtagaaaggatggagaatatagttaggaatacccgtttttattttttattttttaaagaaatcaattttccctttctgtttaaactggggtgtgtgatttcgtttgttcgtaaaaatgccactgatttcgtctgtttaaccgtgtttgtgttcttgttcatcggtttctttggctgtttgctccggttgtattcttgttcatcgaattgatacgcagatctctaatcttatcttcttctgcgataatgggttgttggacttggatatgatcagtctgatggaccaggaagtgagctgtcaaaaactgtgaatttccatttgaagaagggaaagatccttttttttttctagtgtatttgatcggattttttgtgcatagaggtgcaacttgtttcagtttattcatgaagcagtggtctgctggtgaacggttgggtcgtggggctcaagaagtttcaaattgctgtcatcatttacctcttctgtgcgcccatctccattccccattcgcctcgatatctgtgacgcaatttaatcctacacggctttctagggactggattaccgtttcattttctcacacattttcttgttctgttttatgacaacaaaaaatcaaattgttttcctgctttgccaggggccaggctgagaaggagttcaaggtggaggttgaagcgatcgggcgtgttcggcataagaatctcgttagattgctcggctactgtgtagagggcgcttataggtacaatgaaatctcttcatcaattttgtgcattattattccctctctgattaatggatgttttactcacattgccgttttggttgaacaggatgctcgtgtatgaatatgtagacaacggcaatcttgatcaatggcttcatggtgatgtaggggaagtgagcccactaacttgggaagtcaggatgaacataattcttggaactgctaaagggtaatgcttctctcactgttgcacgccaattttgccaaagtgggtaccttgaacagtgttatattggtatgccttgcctgattctgtttaatacttcgacattaaagattatgaatattatgggcaaatataggtcatgatcattcagattttagaagacaggtgctagctggcatgggaggcttgttttgttgtgagacatgcatcatagttaggatagtagagtctaattctggtgaaattgattgtcgtaggaattcaggtgctttactcaagtttgttaggttgtgttccttagcatgcacatattcccaaagacagctgattctaacccatgtttagcagatacgaaaaaaaaaacatgtttttttctttgttagcattaggcatcatttggttgttcagaaaacaattagaatttcatgtgcatttaaatagtacaaacgccaaagtaaaggtgtcgaatttcttggacattgcatgtgctcatcttgcattcgtcctttaattgctttcctgttgccagcttgctttattttaatcaaagcacccagtctgagattgttttgattcgctctatagagatttaagatactgcatgtaaataactaaatacttaccttgcacatgcgttcggactagaacattgtgaccctgtttgacagttaaaatctagattaaagcatcatgtgcattgataagcactctaccgataatattctttgcctgaaagcaatattgtcagtggcttgcttaaacaacatcaacagttcttttaaaagatgggtttgatagggaaacacatgaatactgacacccaacttctgctctctaggctggcctatcttcatgaggggctggaaccgaaggttgtccatcgtgacatcaaatctagcaatatccttcttgaccagcaatggaatgctaaagtgtcagattttggtcttgcgaagctattgtgctcagagagaagttatgttactacccgtgttatgggaacctttgggttagtattgacaatccacacacaacctttactgtacataaaagttagtacatcttatcatgactgaaattggctatgttgcagttacgtggcacctgaatacgccagcacggggatgttaaatgagaggagcgatgtttatagctttggagtacttataatggagattataacgggtagatcaccagtagattacaccagggcacctggagaggtcagtatcctacctattctttcatgaatctcttccaggatcgttggcatctgatggagctaaattgtcttcttttcaggtgaacttggttgaatggctgaagaccatggttgctgagaggaaagcagaggaggtagtagaccccaagctgcccgagaagccttctcccaaagcactgaaacgggcacttctggtcgcccttcgctgcgtcgatcctgatggccacaagaggcctaaaatgggacatgtaattcacatgctcgaaatggatgatctactatgccgcgatgtatgttctactcacttatgaactttttgatttcttccatttactaaacagtatagttaactcattttctgattgcaattgttcatcatacaggataagaaacccggaagagatgcgcctcagacatcggacagacacagctcaagggatggcgggaacttcagcaagcgtgagaaccaacggtacagatgacaacagcccagcactacagttgaacatgagtttgtatggattgccattagggattgccaatattaaccatgttgtcattacataattttttcccctctcgttggatctcataaccagctctccttgctcttttgactgtattatactcgagcatcattctatgacacttgacacttataaactacacaagtgtagggtggtgttgtgactgagactgactatgccccagctaatgcttacagtgttaatgtgattctacctaatgcaagtacagttgtctgctctaatgcatcttttaccagtccactcctgataccagctgcctgctttactgcactgggagaagtaatgctttcttcttgtagcctaatggttggtgcctgcttgcacatgatgtcacatgaccattttctgcatctcatctcatctcacacttccatcctgcatctaaccctttgtttatgatcgccattagtagttggctgcagagcttgggacttgtatattctgctggcaaatgcttttgtccactatactgcatctggtgatcagctgcacagcatttgcgccagttcttgtcgcttcgccttgtcttgatctaaatactaatcttcgtttccatgttcagttgctgtgactttttcgtactagtatattcattagttcttttttacagccaaccagctctggatcttgtgctaataaacttgaccgctgacagtactgattaattagcaggtgatgatcctaccatcacgtgaatacgtgatcgaacaactactgtgcaatcaccatgtatgcaatgaatggtcaagtactaacatgataccatgccacaaattagtttgatcatgctgattcatttatttgacactgtacagtctgtactactgaagtggaatagcatgagagaagtttctttcatttttcaacggttagcttggagctactgtgccctggaaatgttcagagatggattcttccattagaaaaaggttgagttatgacttgtgagttgagagagtagtgcaggacacagcacactagtggccaaaaaaacggcttggaggattcatgaaccgatggcagaaaaaaacaagaggaaaaaaaagcacagcgaaaggttatccggcacaggctgccgcaaatactaaatcttgttggacagagacatttttgggtgatatctgacgcgttcttcaccctttccccactttattcgatagaataattgaataaacattcacctatcttgataatgcttaatgccttagtctaattattgcacaaagtctctcaacaacctgaaagacgcagctaagcctgccactgccgttgtgatgacttgtgaacagctgctgctgcttcatcaagctgataatgcacaatcatatgccatggtacaggtacacgcattgtcgaggtctacgtccacatagcttcaggcgatctccgtcctgtagcgtagcgacctcgtgaacacctgagctgttccgaaatggacgcgagcaatatccacaaggcaccaggttgtcgggttgccgccgttggggttttcccggtgggccagtcgacggcggcaacgccacatggaatagaaccagcccgacgtactagaagaaggcacgggcgccagtctgttgcggctagctcgccccccatggcctctggtccagcctttaactcgtcgtgttcacctcgcggttcgattcgattcttcttctgccagcagcccagccttcaccgtgagtgctactatactgatacgttgtgtagccatcgatatgcaccgtccgattagtgaccagacggccggaattacatcgatttcgatcatgtttgatgaagcttaacattctaaaaagacaatcggttggtagtcagtttatagaaatatgaatctactagtttttttttaattatgcaattgcaacttcttaaatttcaaataaaaagctgaattgtttcgaaaggttttgttttaggagaagtttcagctaccagaaactctctcaaatatgcccatagcccatccgcagttggccgctgccgttgttacggctcccgtcacgcgcggtgtctctcacgtcctctgcggcggccgctgctgcttagctggatagcaaacgccgagccgtgcacgctccgctgccatggacagcgactcgcgtcgcgcagcacggcgccacgagcgcacaacgcgccgggccagcctcacgcgcgcgcggacgacggcgttccactggaactcggtctttctcacgagacgccgacgccgtcgtctactcgtcttcgttcacagatggatagggaaaaaaagggaaacaaaaagggcgacgcgcgtgagcttgcatgattgatatgtaccatactaatataatctgacaaaagaaggtaatgctaagagataagagaggcaatgatcactttcagcctttggaaagctgacgctgaggcaattatgtagggaaaaatggtttcatcaagttgtgctagtgtcggcataaaagactgcaatagtgctagttccgtatcaaaggtgccgcactgacactgaggatgagggtgtatgtacatgcatggggagctcttttgatcaatcacacaagagagatgatgacactactagtaagcatatgcctgaacaagcacacacacatacatacaggtagtatgacatgcatgctgtcagttcagcagcacaagagatgccggagagaacaacagctgcgttttagcttctaccacttgcagttgcctggctaccaccaccatcagagagagggcctcttggttgtttgccgttgttctgtggggtcaggttgtctggtgcagctctctttggcctcaactacagtcaagataaagcgttgataaatagatgttccatactgatttatgtaacctttgtgagagtcttaggctcttagcagcgcaccttttcctcggatttttgataaaaatgcctcaacaggatgttcttggggtctgttgttatcactgcgattccagacacaaacggtcagggaaatagtgaaaatagcaacaaaaaaaaaagaggtgatttctgtacagtaaaaaagaaaacttggaatagttggggtagttctggtaggaatggacgagagcccagaaagaaccaaaacgaggtaaagagagcgagcaactatcgagtctgatcgactacgaaaatatctaagagcaggtacaatagcaggctattagccagctgtaaacatattttaatgagagaaaggatgagagagaagagcagcgggctatagatctgtagccagctgcatcgcggactctaagacgcaatgtatgtatgacaggtgtgaccatatattaatagtatagtaagcaactattgtatgaattggctattagattggctatagatgaattggagttagcagtgggctatactattaaacttgctctaatgaactaaagcactcaagaattcaccactatcagaagcaatatcccatgcacaggaaattcaagagggaataggcagcaaaaatacggaggggctgttcagattgttgccaaaataaaccttacctaaaattttagcaagttgacaatattaccaaaattttggcaggatttcttatgtatttaccaaaatttggcaacaaaccaaatgtaggcacatttttggcaactttgccaaaaaatgatatggttgaaaatggcatcaatctgaacagcccctgaataaactggaaactaaggaactagctccatgcctgcaacggaccaatgaagtacaatgtttacatagaatatctaaaaacaatgttctttttttttagataatggaaatggtttacatctttggcctctgccaacaggcacacgggcaatgagtcgagaagaaaaactgtgttctataaatgtaaccatccaaatcatattggcaatatggcataaacagaacacttcaataaaactatgttggcagcactagaggaagatgactaatatgagaggttgctttggttggccagttcatttgctccttactaataaattgcccagcttgcctatagttttctttcatttttcttttgtggagatggtaagcagcatgcaatcaattttttactgaatacctgtacctgaaatctggagatagttcagtggacaggcctgaaagcaaccaggatgtttggtggttcggcctggcctgccaaaagattaggctaggaggaaaaaaaggacttaacagaatgctcatacaaaattgtaataggtacacatagtgggtcagagcaaagtctctgaggcgaaaatactaaattatgttgattcatcattaggaaactccaacctctagtccaaatagatgttgctctagcatgtgttattccaaaatttgattgctaaaattataaaagcatttaacttatcaaatcaattcaaggggactcaactatgaaggtgtaagatcaggtttagttggtctttccagtttgccggctaggccctggctctctgactctcaaccttttctgctctccctcataaagtcatactccaagagaaaagtttgctttgaagctataaaaaatgtaccagaacaaaggtcgtaagggaactacttgaaagtaagctgggcaaattagccataatgtatgtgagttacatatcaagaagccaaaactacagtcctagggaatgcaaaaaatattgactttgaagacatatctaacagtccaacagaatctattcatggatctatcactcagaagatactaaagaggctgcattactgaaaacagtatagatgattggagttaaatatgccagccatgaaaggcaagatagtcactttttggctcagaccaaacaactcagaggatctgctatgccatgtagagtactactgtaaaaggaatttgatgcaatgtgaatgagcagtcacattcaactatacacatttgaacgtttaggaaccacacactcagaagtgaggagcagcacagggaaatcagcattggtaaaagaaacaagggagcaagataccttgaccgggaggtggatccgtcctgtgtgttgcaatgtaagtggctggtacgacattctgaaacacaaaaaaaatagggataagtattggcagtttcgcaccaatgcaacatgtccggactccagagaataagttaccagcttgatactctgacgagaaacacaaatatgacaaactgaatatatgctttgcaaattacaatgcaagtggctgcctggaatgacattcggagcaaaaaccgactagtaattcatcaccacaactgaaaccttaaagggcgttggccatgagagaaaccaaatcctaaatgtataatccatgattcacaaatacctcccaaatgagatattatgatccaactatttggcattgggacttagaaacaaatagtactaaccaccttttgttaatcatgcgcactggaatttcagacacacgctctgacacacaataggactgactagaggtaaagctccggcgtgagggatcaggcacacaattcatggcatcatcaacacaatcaacctaattctgaattgtacttggcggtcggaggcatgagatcacgacagctaagcacagagatcgatcgcgagtgaggggggacagagtcacagaggggctgaccgaccaagggctgcgcggaggggtcggcggggacgacctggctgaagttttgcgggttgtaggacggccagccgcccagggagctctccatcgccgccgcggagctcgccgtgacgtctccgactccgactccggcgacgccccctcttggtttctccacccttttccagcgaccatggattcgtggaggactataatggagcacacagagtcaacattaacttttgggtttcggcccattattgctatcttttgggccttagatttcactggccaaatgggctttaaggcccattttctacctatacatttgtgcttagcgttgtcttgtgtaattgtgttattatcagataataccacgattatacgaatgaattaattcttttagataatggaatgtaacattccagtctttactcaaagagttacagccaattattacagaactcacacagaacaaaactcacatagaaagttcacgatagcacaaacaaagctaagcaaacataaactaatacacaccaacagaagaaaaatatgccataactattgaattgtattagagaaccgccacccgaagttggcaaatatatgcataattgtcgtcaaacgaatgaattaatgaattaagacagacaatagtacaagattcataagttctttttttcgaaaaaaacaaaacacaatacaaccacgcacgttcaattacatacgagcccacttaccaaatgcatacatatatacataccctatccgtataaccacctttaaaagtatgtcttaataatgacaaagtcaccacaagcttctcgcactcatcgaatgtgcaggtaaaaacgcattcgaggattggaccggtatattttaaaattgataaaatcatcaccgacgttttcctatcaacgtatagattgtctatcactaaaatagtatatgtactaagtttgcaacttgaattcagatggtgggttcaaaggaccttgccacaaccacaacccacaagggacaacaaggttacccgaaaatgtgagttctttaaaagcaatgagttttgtttctgtaaataggggtgatagatccatgatctattgttgcaagtaaaccgcaagataagattcgtgcaggagccgtatccttagacagatactaaatcaagtcagggctagctcagagtctcgatcattaagaagggacaattgccgctaatccgacagcgatcagtagcctgtcctttctgttaccagtcgtgggagagttcggattctccacaatttgtccaaatggagtggtatatcaaggtaagctgaagagagaggccggcgtttcatcatccattgttttttttcctgctgtatcgaatcgtacaaagaaacaaggagacggtctctttctagtatcgattaggctgtgacctcccataagtgatacaagaaccggcatgctgacatttcaagaggatgcagatgcagactgaaaactgaattattgacatatatgacgacatctatgtacgaaaaccttgagcaaattggctaagtgaaacagcgaaatctaagatctttttcggcggattgatggcgtttcgagggtggccaagggcccgtctttgctgttggttacggtcaaggtataactgcttgcgagacatcatggactattctgtggccatcgatgtgggggtgtttgtgtgagtgatgtgaagatgctggcgaaagccttgccgggtcttgggccggttcgacgacgacggcgcccatgggcgccgtttcccttcttggaggcgttgtcatggcattctttcatatccccacaaatttctaggtgaaaacctccttccgactttcgaacgagcggcggtggcgttacacgttgtgtcctccttgggggcgtcacttcggagaagttctaacgcatcgacgactgtcgatagtctttttcggttcaaaagctttcataccttttgttcggtgaggccttcgccttcttgggtccgcttctttcttgtggtgggcaacacgctcttcggttgtttctgctaatgaagtcgaagctgcttgctgatgggggtgcggcgacgctcggcaatgatgacatgttgcagtctcttccaaggagctctggtgctggccgtgtgaaggaagttgctcttcggtggcttggctgacgtccattgttggatgtcggagctacttttcgctttggtgactttcgtggcttcagtgttgctgcagttgtggagtcggcgctgctaggtcgcttgggcggctagcttagcaatggtaacacctcttctgcaatgtgggagctgttgtgtcgcttttgtgtttagtttggcagtgacgtcctacgattaggctccgccgtcgttgttagttgtgtagagcggaaggttttagctggttttcctgtaattaaccgtgcagctgtatggtttttgggcccggttttccttataaactgggtcaattttttttttctaagtataacagtggaacaaagttcggcattaggttaaaaaaagatcttttttggggcttgcgaggtttggacaaattttaacttataagaatgtatttacatattaatctgtaataattttcaggaggcttttccctcctaatgtagatagagttaccctcattattatttgatggcacatactgcactagtatatatgataataaatgcagacatgcaaataaacagttaaatgtgaagtgtatagcacatgtaagtaaagtaaaaaaaaaactcaaacctgcactagtaaatgtagtagaacaagtatgtaggagcaaagtatgaaagttaaaatgatatgtatacatgagaacagggggagtagtagtggctcaataaaacctccatgtttagtccttaattagaagcagatgttgtttgagagagataccaatcacaataactttaataacattttaatcctgaataacttatacagtttcatgctgtatatcttgcacgactggagcgatgaggactatgtgaagatcttgacagtgtgcaaaaatgctatttgttaaaaaaaagcaccatgaaaaattaatatgtatgaagctatgccgaaacaataaacctaaataaatgcatgcctatccatataaattttaacccgctgacaacccgacaatgagttactgcatctatcctaaaatataaaaaaattaggattaaatacatgtattacgaaagtaggcagaataccaataataagttatcatctcatccaaaaatataagaactttaggattgagcacatgtattatgaaagtatgtagaattaagtaagagaaagttgtgattcattgagaaaacgaagtaggtagagaaattaaattaggaaatgttattattggttaaaaagagtagaactactattaggagcgctagagcgtggaatattgttcatagcgccaaacatgcgttagcccaggcccaccccaccccacgtcccgtcatcccactcctaccgatccgagtaaattgtttactccgatcgggtgcctctaccacccacctttatttgagtaaacaatttacttcgataataaaaacaacttccatgctttcgatctcaccccatgtcccgcatcgtgcacccaccattatcggagtaaatgatttactacgataaaaacaacttctctgcttccggtatatattctatttttcccgtacccaaccaaccactctcgcccccactccgttttttccttttttttggatctgaatcgatccaccatcccagcccacagatcggcgacacaccatgaaggacgacgacgacaccgtggtggttgatggcggtggccggcgagcagtggccggcggcggttgaggtgaaggcactacttcaggcctcgctgctggacgctaggcagcaccataaccagcaaggaggtgttcacctgagccaatagcaacaaccagcggctactccacgtcggcgacattgatagaacaagcaagtaaggaaatgacactctaatttgcatctgcatactctctttcaacttcacgcatgaagccctaattttttttgcaaatcaaattaacatgtaatctccaatattacctgatctcaattgataggctgcacaggtcctacatttgcacatcgtgctccatgtagctggccgcagaggttaaggtggagtccaccggtgatggagattgtttgctatttttcttttgctcgtcatctgtattgacatgaacgagaatatttttacatttttttgtgcttgttagatgatggatggctgctactgtgcaacgtcaagctcaactctataccacaccgctacattcttccatgattccatgatggatttttggctgaatcattttttttcttttctagtttgattcacctgtgagtaattttatcgcttgtgtgtgattgagcctgtaatttttttcattcatacaactattttgtgatacagatcaacaatactcttagtaccagtttttattcttatactgtatattgaacacatcagtaaacatattactacatggtggctatgagatcatggctatatcgagaggaatgtggaaattgttttactcgcagaccacaaaatctaaataatattggtaaaagaattactagcgttgtaagcttgtagtaattcttttacgaccatttaggtatggcgtcatacgatgtggagacattcatgagaataaatttgttactttagaatgagcagatgtgggaggctgggagtaaatgaaaaattccacggagtaaattcgttacttttcaaacgtgcggagatactagaaaaacggaaaactcggaaagaaaaactagacggtaaatattttactaaaacgcgaaaacagaaaaactatagagaaggaatgaataacagaaaaatctggatggttaatattttacctggaccattgatgaagcacatataagatggaaaagagaaaaaaagaaacacggaaggtggggtgttaaaaaacgaaaaaaaacgacccgagaaaaggtgggatgcggaggaaaggtggggtggtaaaaaacgaaaaaaccggaagtagaaggcggtgtgcagcgctcgaattattattccgcgctgtagcgcgtggaatagcgctaccgtaaaagagagtataagtgaagatgttgcaatattttaaggtaaattttaaatgctagaagttgttatattttagatagagagagtagctaaagttatttcctttatgtaactatacattgagagcgttcatattagccacaatatatcttttattaagagaggtcaaagatgattcatcacaatctctttaaagacctatagatgtcagaacaaaaataagaaaaaattaccctgtaagatcatggtgagttcatattataacggtatagattcatctctataggtgtacaagtataattgtatctaaataaagacatgctaatagctgcatatcaaacttaattcttttttatatattttatctatataacatgagttaagagttgtttatctccgattcaattttaaaggtatattcctgtgtaaaattgtgtgaaaaaaagctagtttgccaaaatggagcacatggggctaagctgacgggggatcctctagagtcggccagcattttcatcctctactattttccaggtcttttgaatcgtgcgaagaaaaaaggggatcgtctttttccatggatctgtaagtcttccatatacgcaccgtcatgctgacattttcagtgatcggatgaatggcggcatatatctgggaccaaataaaacctggtgcaaattggctccacgaaagccaagatcttattcagagagtaatcgccatggaacatggtgagattggcatatactatgtaagttggacagttggtcgatcaagtcatcaaacaacttacagagaagataaggtgcgaatcgatgaagctgaaccatgagtgcaaaaacgttcgtaaagtgtattgacgtacattcattgaattttcaggggaaatttgtctctaaaattgatgaatcaaacatttgaaaatttcagagaaattttccagggaataattttctctaaacttaactgccaacgtttggacagttggtcgatcaaacaacttccagagaagataagatgcgaatcgattaatctgaaccatgcgtgctaaggtttgtaaaatgtattgtcaaggattaattgctaacctataacgtacattcattgaattttcagggaataattttctctgcttgcagacagtcagtaaacccatttatgaatacttgatgtacatgtcctgattcgttctcttctctgtcaatgtggatgatgtattgatgtatatgtaagtataacagggtcagtctaaaattaaacacaagacgactttcccgacacgcttacgcgcgtcgcgttgaaaggattcaccgacttattgactcatagtgcaaatctaagtggcatctgccttttattttcaaattagtttggcagctgaagataaagcttccggctaactgctaggttatggggctaataacacacgagaagataatataactgaacagacaccactaactacagaaaaggttgcacatatgcaaatggaaaatgacatgccccattaccagcactgtgcgtgataaccttaatatacccacttatccctctatttctttcctgcttcaacgtggaattgggccatgcacgttgttttcatggcctaatatgtttcctgatttgttaatcgtgactcaatcgctgaccaagctcaactctgatattgaccaagttaggtaaagtagggtagtatatcttagatacactcgataatacagtaatacaccgataagtggaatgtgatttcaaccctaaaatttcgtatttaattctcaacacgcttataatttcttcgtgaaacccttccaaatctcattttaggtaaagtagtgtatcaagtaaaaaacaagccaaaaggaaaacacttgttttttttagtttgttcgttcgatgatgaagtacccacgttccactccaacagaagaggccaaactaaagatcaggcatgctgtcctaagagaaaatcgaaggtcagactgagtcctacacaccaagggtagcttctgaaacggctgggatgatgaacaaaagggtgtcttttgtgcgcagcatctaccggccaatattcctttgcaggcgtgcgcctggtgattcaccaccagcagccaccggattctccgccttgcaacccatgcaatctcgagaatatgctgcatcatgaaactattcttaatgccgagaacaacgagagaatcattcagagttcagacatcttttcgacagtcatatgctagctcctgctattagagcaaatttaatagtatagtccactgcaagcttaaaatcatctatagtcaatctaatagtcaattcatacaatggttatctagaaatgtatactacactattaatatttggtcctatccgtcatacacacattgcgtattggagtccgtgctgcagctggctacaaatctgtaagagcaagtttaatagtatagctcaatacaagctcaaaatcatctatagccaatgtaatagccaattcatacaatagttgcttaatatactattaatacctgattctacttgtcatacatacattacgtcttggagtccgtgctgcaactggctacaaatttatagccagctgttcttctctcttcctttatctctttaaaatatatttatagctggcttatagcctgctattgtacctgctctaagagtaagtataatagtaggctataaggtggctaaatgctgaggtggaggagagagaagagagaggagaagtgggctgtaaacttacagccggcttggatacaagaaccaagaaactctgtgagagagacaagcgggctctgtattaattgtaaagagctaactattatataggcaggctaagagaaggctacaaataaccttatagccaacatgtcggctgtattattagagcaagtacaatagcaggctataagcaatctataaccacatatcaagaagaaaagagaagagagagaagaaagcggactacagatttatagccagttgcaacacggactcaaagacattacgtgtgtatgagatatgagaccgggtattaatggtatgatatatttttatagttaactattgtatgaatgagctattagattagtaatagatgatttggagtcagtagttagctacactattgaagttgctcttagccttgctctaacccgctttcttttctctcttatcttttcttctcgatacgtggttatagctggtttatagtctgctattgtacctgctgttagaagtattctatccatgttcacgtgtgctggtggtgatcatgtccgatcccagctcagatgggcctaaatgagcgtgcaattcttggtcctcggaataggagctgtgcattgtccataggagtacttcatgattagagagtattgggcgtgatcgaccaaaaaactacacaatctggggcatccttttcttttattagaccgatataattaaccatgcatcatgcaatgccaagtgcccaagtatattgctttcaccacaacgagggttcacgctttagcttttgtcgcgctcattcaagtagcaccatccacaataatcaaagtaactttccttttgactgaacctgtcgagagtagtaaaaaacagagaccgtcacgctgacgaccagcgggacagcaaccgccacgtgggcccccacgatgccggtcggtcagcagatcgggcaggcgagatttgcccgcacgttttgccctcaaacccctgatagtacgtgcctttgacagcaaaagaagccgtggcagatcgacccaacaatgtgtcatcctcctgcccccatcgcacacagaaccccccttgcgtgaattgcatcgcgagaacccgaaacgcctcgtcggtttagctgcaacgtagattcaccgatcgatcgatcccttccaccacgctccactccaccgggggaggtaaatccacgggaaaacgggtgtagtgaagcgagcgaggcgcgcaccaaccgcagtcaccaccaccggcacccaacacccagacgcgcggctccccggttgcgccgcactcgggctgtttggatggtatacgaagtttatcatcattcatcatactttttacgtcacatttgtttaagttgtggcttacaagtgtcacactttagggagttaatgacatgtgaggtcataatagatgagaagaaatcttgtcataagtgtggctataaaccaaacaatagactaacttaatcaatcttgtctactggtgtggtaatctttagtaacctttaggaattaggatcaaaccaaacagcccctctggggagaggccgttacgttatcccacgggggaaaaatacgagaaaccgcaaccgaaaagagaggaggaaaagggagccgcgcgccgtcgacgccgtgccacttaaccaaccagccaactcaagccccgcccgtaataaagcgagccccccgccgcacgcacgcacgcagccgagaccaccctgctgcagctgctgtgctgcgcgggttaaaaagagagagatctattaactggccctcctctcccacagcaaacacactcgtgtcgtactgagcatctgagctcggtggttgccgaggaggattcgccggcggcggcggcgggggggagatgtcgcagcatgcggtgtgctgcggggcgatgttctgggtgtacctgatgtcgtgcgtggggctggtgatgttcgccgggctcatgtcggggctcaccctcggcctcatgtcgctcagcctcgtcgacctcgaggtcctcgccaaggccggcaccccgacggacaaggacaacgccggtacgtcctcctctctctctctctctctgccccccctagctctactgctgctgctgatcgctgcgtgtgcgcgcgcgcgcgcagccaggatcctgccggtcgtcaagaaccagcacttgctcctctgcaccctcctcatcggcaactccctcgccatggaggtacaaatctctcctgctgtttttcgatcccctgtatgcacgtatccagattggagctgatggctttgtggcggcggcgtgtgcgcaggcgctgccgatatttctggactcgctcgtcccgtccttcggcgccatcctcatctccgtcacgctcatcctcgccttcggtgaggtgaggcattgatccatctcgcgtgtccatggactatgggttgctcacttggggtttggctggctgattcggtttctcctgtggtcgcagatcatgccgcaggccatctgcacgcgctacgggctcagcgtcggggccaaggcggcgcccgttgtccgggtactcctcatcgtcttcttcccggtcgcctacccaatcagcaaggtgcgcctgctggcttagcctgtttcgttgctcttgtttgcttgcaaagaatttgggggaggaattggaaccttgtagttggtcacttggccggggtgtgctcacaatttggatttggatgggacactacaagtggctgaccgcgactaggacgcagatcggttacttactgattcattaattaattttccaatcaagggacttgtcccattctcatttagtcatctgtctacaaaattctttgtagccggtgactaattaattagtaaatgtaatctgtcccattccccattgaaccagaataagcaatcatagccgtgaagcaagaaccctgttttagtgttcttttttcctttgccagactaggaaaaatgccttcataagcgtgtttgattgctcctgaataattttagatgaagcaattcaattcgcttcttagtttaattatttcctgctaaactaattgttttctgaatcatattttacaaagaaaaaagaacagaatttaattggggctgaaacacagcgaactacttattgtcgcagatgaatgttttgagttgcattcaactaaccatttccttgtttctaatgcaaaattagctataattagaggatgcatagatatgcttgtgttttccactaatgccatgtcttaatttgattcatgtccatctttccagttgttggattgggtactcggaaagggccatgttgcacttatgaggagagctgagctaaagactttagtcgatatgcatggtaatgaggtaggttttattcttattctcttatgcatttctggtaagttgtagctctttacactatgtagtttgcatcaatagtggttttttttggttgcaacagctgtgtgcggcgtccaagagttgatctcaagaggccatgttctatatagattctagacaactttttatgacatgttatagcaccttaaatgagtccggttataatatttgctgctatatggacaatatgattgggcatttctacatgccttgaatattttcttctggctctaatatacatatattctctgggctacttgtgtttgcaatagctattggtgctttcctcagacaaatatgaataccattaaacttctgctggttcacttgttcttaggctggcaaaggtggagagctgactcatgatgaaaccactatcattacaggagctttggagatgactcaaaagactgcaaaagatgccatgactcccatatctgaaaccttctcacttgatataaacgctaagctggacctgtaagaatattccaactattgtacgtgttttgaatgacacattctattgatgctactgttctcttcttgataggcacacaatgggtatgataatgaccaaagggcatagtcgtgttccaatatactctgggactccaaacaatattattggccttatattggtaggctaaactttatgtattattaacttttttggtgccaaaaatcctgttccctagaaacttatgactttcatgttatttactcttggatgcatgttgtcaatgatcaatctttgtggcttgagttgccggttctaactgctgtgtcagtcacactttttattgtgaataagatagcacattacagatattcgatactgaatctgctagcccatttcagttttaatagataaatacttgaattagagaagaatgtttttgttgtgatgaaatatattttataaattcattaatgatattctagttctctggttaaaggaagcctttgcagcagtcattcaaccatgacacgtcggtaataaaattgtcataaaataattgttttcagttgattgtgggatcacatactctaacgaaatacagatatgagtgactaatttggcagagtcttgtgtacttccactcaagctgcccttagttattcaaaacctgaggcaacattcacaaatttaagcctttctaaacatgcccttatgattgcttatatttttgccgggtcggccgaaagatttggtcgaccaatttcattaagtgggggaaaagatttaattgcctataagtaattcacttttggaaaaataacaacaataactttcccgatccttccattactgtcacttcctggacatcctatatcccaatgaaatagccaatcttgccactttactttcatgtgtttgttatttactatttgaccaataagcaaagaccatctcattttcaggttaaaaacttaattacttgccaacctgaggatgaagtgcccattcgaaatgttactatcagaaaaatcccaaggtatgatcttttattgctttatcaaattggctgtttgccccctaggcccctactgttcctccctaaaaagctactactatgttttcattggcttgattaaaaaatgtacccactattaactttctctgagtctgagttggaagtcaaaatctcgtgcagatacattaggcatgcttcaagaaagctcaaggctacgcatatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagagacgacgccgccacctctcccgcccccgtcggaccgcagccgcctccatgccgccgaatctggcggaggcgaggtccggcccgccgcccctcccacccccgccgggctgcagctgcctccacactgccggatctggcggaggcgaggcccgaccggcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgcgggaagaggggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtataactaaagttgacaagttaagattatttccatggcttaaactgagggcacccaaggttgctacatactgtgatatgctttggaattgattcaaatatgcacttctgaatacttaatgcttctatgctcttcataacaagagaactattctcagatatttggaatctcttatttaaggaagctatactccatgttgccttgtaatttgcgtgtatctatctccatacaaaatgttcgtttgtcatcttctaattttcctttggtgttgctgctttttggtatatcagggtgtctgatgatcttcctctctacgacattctaaacgagtttcagaaaggtcacagtcacatggctgtggtggtcagacgcataaaagaaccaggagcatccattgaaaagacttatagtgacagatcagattacaaaactaacagcgacagatcagattacaaaattaaccacagagatgcccatgctgatggtacatactttccattagccatgatgatcacttgtttttccaggaataaatatttgtttggctgtctgatcatttgaaaataccctcaggtttgtcaccctctcgtgtcagcattgctggaagtcgtcgaagtaacattgaaaagaatggagaggtgcgcttatataagaaatcagaaaaaaagcgggacaatattcttgattttaatagcggtccacttccaagctattcattggatcaagaagcagtggggataatcacaatggaagatgttatggaacaattgctacaggttggagatattcttaaatacagcttgttcttaatttatatttttatttgaaaacaaagtcttgcatttttcacatcctgatgcttttttgaggacaccattattttttctccatttatactcttgtttgttgtataaagattttagtgttctccaacctatgggagcaacacgtttaattcagcatgatgttgcatttttttagagtcatctagtgttttccaatagttagaaaagaaactagaaatttttcatagatgtatcgttctttgtaaaatattttcgcttatacatgcaaactggcataaacttctcttggcaggaagatatcttggatgaaacagatgaatatgttgatgtacataacaagtaagtggcttgaaccctgttactttttactcttaacagaacctccaaatgatgagagaactaacatttctttgttttgcaggattaaaataaacatgctacctctgggcaaatcattatcaccaactatatctccaagtaatgggccccattcccaaggactcaggaggacccctatgacttctccattgtcatcataccatcatggtggctccatcttacgttcccctgcttcaaacaatcctcagtctcctgggactttgccgacaataatttctcctgaaagatcgcctgcttctcaagcaccttcgcgtagttcacctaattcaactcaggtgagtagtcactttgtgtctatgcgggttatataggctatttgtgacacatcacatcacatattattttattttcattttatttcgcctaaattgcaaggaacttattttcatctacctgtaaagatttaggttgtattttccccttgaatgtgaaacagttgttggtggcctacatcataccatgctcattgttcttctgtttccttcataggtctcaaggaattcgtaaaacggcgttgagagctaaagagctctaaggacaacgtttcctgagaaatggtaaaatgtcaacataaacagattaagacattttgagcttaggactgaattatacagatcagcatatctcttgtactgttgatgcttatttgttgattacatgcttgtatatacgtatggcttagcatctggacatcgctatagatggaagtctcactacctactgtagatgtatttttgtcagcttgcaattaccattgcagaggaaagcttgaagataaaaatgtaaaaggaatgcactagtatgcatttgtgctgttcttgtatgcatgcccccatcattttaatgatcagcaagcagatgttggtgcattcactgatggctatccacaccatttaagcactgtacaagtcctctcatattgtatcagaaattcagattagtgataaggcgcaagcttatgtttgtgatgctagtttggtgatattgagcagagtgttgtgactaaagtcaaagttacataatgagatcagatcataagattgcaaagggcaaacctcataattatcgagtgggccatcaagagagaagctagtggatcagccggaccatcaaggacagttttacctgaaaagataaagggaaatgtagggcagagaaatccacttcaaccttaaaaaaaaatgtaccagacacatgctccttccgtaaaaaaaaaacaatatagaaggagacgtgacctctcctagtataacggtgatctctcctaggttgcttttttttttcttaggacggagagtgtgtatataagtgacagatccgagacgtggttctcgatccgacgaccctcggtgatcgcagttcgctccttctatacttttacggttttaccctgttgtatatgaacagaggacgaacatgtaaataaatactacttccgtttttttaatagatgacgccgttgattttttctcacatgtttgaccattcgtcttattcaaaaaatttacataattataaattattttgttatgagttgttttatcactcatagtactttaattgtgatttatatcttatacatttgcataaatttttttaaataagacgaatggtcaaacatatgagaaaaaattaatggcgtcatctattaaaaaaacgaagaaagtacaaaatattcaatgcgtgcaaccgaaggcatggatgaggtcaggatcatccatccggaaaaacaaaaggacaaaaaagagaagaagagcttctagattccaacgctacgtatccaaccgcgatcgcttcgtcaaatccgcgcgcgcgtcgtgtcgcgtacgcgcccacgcccactcccacgccttcgcgcgcgcgcgcgcgcgtcgtcgtctccctcaccactcgccccgatcgatcgatcgatcgagtcgtcgtcgtcgacccgttttctctcctcttctcgatcgttatatcgcgaccagtacgcgctactacttctcactctttgccgctcgtttcgctcggagtagccatgctccaggcgagctcggagttgcagcagcagccggcggcggcggcggcggcggccgggatgtgggtgcccgggatgagcccgcaggcggtggacgccgggctgtcggcgagggcgcaggagatcgcgcggaggcgggaggagatgctcgggatgctgcatgacctccccgagtccgagtacgagctctcgctcacggacctcgtcgagaaggccggcggtgtcggcgtggcgccgccttcgccttcgccgtcggaggggaaggcagagccgggcccggcgcggacggcgtccggcaggcagtcggagcagcagcagcaggcggcggcggcggcggggaggccggagaggagggggtcggcgaggcggtgggacagcgcgggcggcagcagcttccgcagcagcagcgacggcgtcctgctcaacttctacatgccacgctccttcacccgcagcttcaccgcgccgcgcaccactggccccggccggccgccgtcggtctccggcggccggaccgccagtgtctgctccgatcgcaacaagaggtaatcaatcaattctgactccaactaacactccatctctatgttctccatcagtttgattgcaaattaaggagattaattagtactagatcacgaagaacacacagaaattcgttagaagaaccaactttttcaacacaaatattgtactatttagtaaattcgtttttattcagctagcgataatatagtactcccacagcataggaccaatcaaacccgtacatagacagtcaacaaaagcaaaacgtataagcatcaaagccggcacggcaattccaaaggtaaagtaaaacgagtctacatagaaatggtcctactctagatgccgcctgctgatccgcgcaatctgtaaaacgaagatcaacctgcttgactgcttgtacgttccccacatcattccacctgttactgtttggtatatccagtagtacatgctacagattactgttttacacgagtagtacgagttactgtaaatgcgacgacctactccgatggagaaagcaagggaagcgagtgtcgtacaaacggatagatggttaccacgcaaccacatgagtcgggacaaggggacgcgtccttgtctcactgaattcgtggaccagatagcgtgcgcagcgtctggtttaatgccggcaattctgagatcgacttgctaatcgcgacgtgaaacgaactgatgatgacgatgatgcagggagagagatggcgagaccgtgcggtgctggtcgctgctgtgggatcggcggtggcgcaagtcgagccggggagatcacggcaacgagtccgccatccgggccgcgatcctcaaggcggcgaaacacaacgcttcttccccaaagaaaatctgaatgctgctgctagcgtccatcgttttggtcttagatagctagcgcagacttatctgcctgccaccactgggtgtatcaatactaatgtatggttttgtacatacttatgagtgtccattttgtgcttgtgaactgattgtgtgtgaaaaactgaagataggcatattggaaatgattccataattgcgtgcacatccagggtatcgttgtgaactcaagttcagtttataatgggaggcagtcgagatgaatcatatgtattgtttctgaagcattttacaaaattgagatgcaacattgaacagatatactgtatagctccgttttccttccacgccttgcactagcacataatgtaacgggcactaccaagatctctaaacaagagtcatctatctctaaatagactagaaaagaagctacaatcccaaccataaccttataatctcaccccagatggcacttggaacgaacatacataaatatgtcactatggacaaagataacctaaaataatccttatttgccatcattcctcaggtcttattgaagaatcccttttttttctttggtgaggatcttatcgaggaattctgttggccaaccaacatcagtctcagcaactctgtatcaacaattttccggagggcgtcagattcatatttagctgacagacaaaatgtgctttgcaaatattaattatcagaagtacttacattggaaatctttatccaggattcaagtgtgttgatggcctccccggagcgttgtgtttcctgtgctaacgctacaccatcatgcaaagtatttactttaccactgacaagaagagatgctgcagcattcagcacctatgaagaaaaaaagattgattaatgttttgcatagcaaagcaactcaacgtgtgcaaggtaataattaagtgtcatatatgatttgtgaaaaaaaatctaaacaaaattaaatcctatcatgacaaggatcggtaagctgtttatgacagggcgcactgcaaacccccatctattgaagaacttcctatgaaatattcgtatgttaaagataggctaaccactgcagaattctgagttcattgtaaaaaaatgcattacaagaagtttagaaggtagaaagtagaagtaactagaaagagaggataactgtaatgattaacttacgagagcatcagcaattgaacctctttgaccagcaagaacatcctggagaacttttgcgttgaacgctggatcacctccttttagatcttccagcgtgcagcggggtataccaaaatccactggattgtaacataattttaaaaagtgagactaaaaaaaaagtgtatcatatcgtcataatgtatttcagaagttagcatgcataattagaaataagtataatgtgcataaaacatgcaattgatgagactaaactcgaagactcgctcaaattacacaagtgagtccaataaacagtctctgtttctaaaaattctgagaaaaacatagaaaaaaaaactcgtacatggatcgaagagcattttttcaatctttcttggtgtgacatcaaggatatatccaggccctacagcattgataaaagaaattctcagttaaatgcagaacacttagttttaatattccaaggtatttttttgaggaatcatggaattttagcagcagtgtagcacagtggtgaaatggatacattagtatgtgtccgtaccaagtgggcttatttcatccaaacccttcgaatggacaaccaatgctctcttcattccaaatttctgagctgccttagccatcttggtaacctgagtaaaacaaaatatgttcattagggatgaacaatgaacactagatggaaaaccagcaactgcaatatagcttttagcggggctgacatctcaagaaaaaaagctttataaccatgtatctgcaagtcaagtaacacaatatttgctaaagatgaagttcactaaaaattggaaaaggagaatcttatatctgaactctgaattgagcaacatcggttcaacagctcaacagtagatgtctgatgcttgcctttaaggtctttaatataaactcgcatcatttgtcaacttaaaaactgccctacacctactttaagtataaaaccaagacaatagtggtgatgatgacgatcatgtgggtcaacgaaatattaaattgtcactttaaaaaatcttttcttgcatatcatactatttatgctttgatgatttactagaagaaaagaagaaatgaataaggaacttactatgttctcgtggtaaacaccaataacagcataaggcacccttgctggatttaagagaggaccaaggatattgaaaactgtctttattttcagcttcttcctcacaggtttcacgattttcattgctggatgatagtttgcagacatcatgaatccaacacccacctcattgacacatcgtttaataccctgaaaaaagaaaatacaataatatatataaaccccaccaggtttctgatgccataagatgcatataatagtgaataatgtaaaatttgaaaagccaggggcaaccagcctttctgtgcttagaagaaacagccacattataaataaatggagcgactacatctagaattcctaactactccctttgtccacaaatatctagagacgagtctaaatatgtaacaccattcagcctcagtttgtgactacaagaacaagctatgtgtatctgcacacagtaacttcaaatgttgatgttcataatccaattactggaatccaacaattcaattgtgcctttttacaccgataagcaaacctaaacaaatgatagaaccataaagaggctgatctacacatctatgtagtagatctgagatgtcaactagacaaatggggcgtgcttcgcacctcagtcagatgaaggttggaggtaccaacctcagtggtcagcacaaattttcagtaagctatatctgcttgcagtggcagagagacagaggactggcaggggccgtggctacccctatccccaagtatcgtactattttacgcggtacacaatttagcactagaatgagtatagatctatcatttggaacatgcttatataattcctactgcatggcctgctctacaaaattttctagttccgctaccagcagcttggtggatgtgcagctctgcagtcagcaccctcagtgttggagcaaaggtttgaattgggttatgtattatgggtatggatactggtgttgtagttctaatgtagaatctctccctctgtttatgtatctcatgaacagaccaaaccacttgtactggaactttgtgatccactgagatgcaggtggcctgcttttgtagcctaaccttttattcccagaaaaaaaaatacacatgctgtaaacatcacacgtgtctttagacgaaagggagctatggtcttcgactactcttcatagccttcttttctttgggtggcttgcaaagggaccatgctgtttcagcttccatttcatatgtacgattatgtacttgacagagaaaaaaaaagtcaaacacagaaattacttcaccaaactaaaggttaaaaccacacgggtgatctaggcctgcaacccacatcatattttagaggtattcacgaggtaatatcacttgccagttgccatgaagcatgaatagtgctcctactagtgctacagagtacaggagtacaatataaatgcatgaatataagatcctaaaggcaatactagctcacaggaccaggcagaaagcaatcagtggtcaatcaggcaaaggcaactacctcgggtcccaactcgatgttgacaccaaacgcctccagcacatcggcgctgccgcaggccgacgagctagctctgctcccttgctgcacaaaacgcaagcgagaacacattattgcatcaccactagtagtactactacctaaatccaattggagcacaaactgaagggaaaatggcatgcgcatgtataatctcccataaacaaatgaaaggggcgaggagccagtaccttggcgactttggcacccgccgcggcggcgaggatggtggagccggtggagatgttgacggtgtccgcgccgtccccgccggtgccgacaatgtcgacggcgtcatcgagcccgtcgacccggacgcagcagcctatcatcgccttcgccaaccccacgatctgagaacaaggcggagaaatctctcactcccatctctggaccagaacgaaatcaaaattagcgccgcggctgaggcggcgcacccacctcttcgtaggtctcgcccttggccctgaggagcacgaggaaggcggcgatgcgcgcctcgttctcctcctccagcagcagccgcagcgtcgcctccgcctcctcctccgagaagtggtcaccgccgatcagcgtctccagcacctgacgtcaccaccaccacaacaaacaaacaaacaaacaaacaaacaaacggctgagacgagccccggaccagatgaggacgaagagggggagaagcgacgagacattgcggggcgcaccttgtcgaaggaggcggtgcggggggaggcatcggaggcccgcgcggcggtgtgttgcacggcgacgcggggcggcggcgggaggcgcgcggggagcggccgcgcgtggtgcgcgcggagggggaggaggtgggagaccggcgcgggggcgaggggcttggcggaggaggagagcttgatcgacgccgccgccattggtgcggcgaggcgacgcgaggggcgagtggattcgtgcgggttgggggtggggttcagacttcagaggaagagagaagccagcccagtgttccgtgtgttggtgtgaggcggagacctgcgagcgagcggattttgtagggatggctgcgaaactgaaacagatctgctcgccaccaacctcacttttcttttccacttttgggtgtgtttggatctaaagtttgcaaaattccatcacatcaacatgtcatacacacacaacttttcagtcacatcatctccaatttcaatcaaaatccaaactttggacggaactaaacgcagccttgttgcataggatgagtactccctccgtcccaaaaaaagacaaaccctcgtttccgtgtccaatgtttgaccgtccgtcttatttgaaaaaattatgaaaaaaaattaaaaagataagtcacgcataaagtattcatcatgttttatcatctaacaacaatgaaaatactaattataaaaaaatttcatataagacgaacagtcaaacgttggcacgcaaacccgcggtttgccttttttttggacggagggagtatgcaggaataataataatctgtactacagttattgaaagtttgaaactacagtatctgaatatctgatctactgccgtactaactctttttattaggcaactatttccttaaatggttaaccccctttaaaacgtattataggaataaagaaataaaggataggaaaaacatataaattgaagtagcgtgtttctttaatcctataatatggagtagaaaacacagacaaggttctaagatatctaacctctcacttaattctctttagaattgattataggaatgtaatactatacaaagtttaacgtccttttcctataaatcaaaggatatgggaactaaatgttgattggttggatagcattaccgtcgtgcacgtagcccatccaggttggatcctaagcgctcgcaaaactggcatgttccatcaatagctgtgttactgtgtatatctgatttatatatagaggccggatatatccatttttttttaaaaaaatcatagggtatataggaagaaaaatcctaagaaaattattcctatgattattttttttaccaatccttcgtgggcccttagtatagaattacaacatggtgtaatttaatgcctctccaaaatgcatttggtacaatcactttgatacttttatcttataagaaaaaccgtgtaatttgatgtttgggagtaggttgcagtcgatgagtgctttagagcaagtttaatagtatagtccactactagctccaaatcatctataaccaacgcaatagccaattcatacaatagttgcttactatactattaatacctagtctcactagtcatacacatattacgtcttgaaatccgtgctgcagctgactatatgtagcccgctgctcttctctctcttcttttatctctttaaaatatgtttatagctggcttgtagcctgctattgtacctgctcttataggactatgcagcatatgtgccatacatcctacactatcatcggattattccaaaaaagaagaagattattataggatgaattattgcgcacgtggaaatcgcgatgtttctacgctttggttgttggagagacaggacgaaaaactcgttctcgtgagctcgtcctgctgatggtactctccctgcttcttccgtggcgaccttttccaacgatctggctgtaagattttgctgattcgttgcacaaacaccacaaatccaacttgctcatatcttttgtcgcgaccacgatatactatgttatgtttgaattgatgaaactgatgagactggaagattaagttaacgcatgtaaaatgaaaaaaaaatcatcaacatacgactaattatgatttaatcattataaatttgacaaatagatatttgatattttaaagcaaattccgtagaaaaatttcgcaccaatcacatcatttagtagttactccatacatctcattttaagtgtgctgtggacctctgtatccaatatttgatcattcatcttatttaaaaaatttataaaaatattagaaaaataaatcacgtgtaaaatattatacatgttttatcatctaatatcaatgtaaatactaattaaaaaaaatttaaaataaaacaaacaatcgaacgttagacgtaattcgacagctacaaggaggagagagtatgtgctaacgaaaatggacataaaatctagtaatctttaactagaaaaggacagttgctcgaccggttccctatctcgcgtgcgtatcacatggcttgttttcaattcgagagatttcgttttgacgagacaggcatgacatgacagcacccgtgtttagatttaaaatttagatactcctttttcatcacatcaatatgtcatatacacaatttcttagtcacatcatctttaattttaaccaaaatctaaactttacgttgaactagacataaacacagcctccattaatccggtcagagaggacagcgagatagaattattttttgccagccaccagtacgtgcaagcggttcggtacaaactacaaagtcagataatgctcgcaattgcgtaatgttggattaaaaataggctacgacttctgcagatagtacaacatttcttttctcccttggtgacaagcgcggggagccggggaggacgagtagtacggctgcacggcaccgcgcttggatgtagatgaatggaacttgactactaggtgtactcctacctctcttccgttcagctccggttccgggcaagataggttgtttgctgtgcgttcgtagtgttgttgcctgcgatggggacatggggtcacggcagaattttcctccagtggttggtagatttcaggttgccggtgtttgcccggcgcctgtggattaccaataacatcagggagggatatcagaactggatgttgattttttttatataaatagatttaaaaaaatcctattttaagaatagatctttttcctcaacatcagttcattaacacgaaagttcaatgcctcgacgccaataataactggcaccctaccatagccctctgtaaaagcaaagtcaaatagtcaatgatgcaaatgggatcggtaccaagaatattagcaccaaggacctactccgtatttataaaataaactagggctcggtttagattttaacttttttttttaaactttcaactttttccgtcacatcgaactttcctatacatttaaacttttaacttttctatcgaatcatttcaatttcttcaaactttcaattttaaggtgaaactaaacgcagcctaggtcctcaagcgccgactcctctacatctcggctgctagagagcaagggtgtcagtgtcaaaacattggatcttggtgccagttgtcctgttgccaagactatttatgaaatatttttttctaggggtttatttataaaataaaatttaaaaaggaccagaccaaaatgtcttggtgacgtgtgcttccgctattacacataccgatcacgtgtgcgcatccggattcccaagaaagaaaaacattgcataatactccctggattctagggagcttcgacacgaggaaatctgcaaaggacaatggctaacagcagttcacactgccgtcgaagagtcgaaggcttccccatggggaatacgagcatcaaacgtgcaaggataaaaatcaaaacttactacagtgttgaaggtcaggtttagcaagacaacacgtacaatcatacactctgtgcccacaaggttcctgtactacaaaagcgaaaattgaatactttaggcagaaaaagagagttggcaacaaaccaaaccaagcaacaagaacgagtcagtccatttttctgtccccagcggcctaatctagccaccgagtaactccatcttcttcactcgcagctgcaaggatctcgatacagacgtccaatacagcctacagaacatgcaaacagtaggaagctgagtacattagcttaagtgcttgcacatgggataggacacaatgtgactgtttcatttcgtggttggacgcatagtgtgctactgttttatacagaaaaagagcagtaacctacttaaacaacgttattgaagagggggcaaggggggaggagatgcatgaaataatagaaatcctctttttagaagcaaatggaaaagttcataccgatgaatttctgcaattgataagtttgcaaccctccaacaaggacccctccagcatccagctctcccaaacatcaaatgtatgacttgcaaacacaaactccatcctcctattaatcttcagcacatttaaaaaagttaaatgttagaacattagcaaccctgggtgtcgataagaaatcaaaacacttctgtttctcaacccattttactactggaaatggaaaagttgcactagtagccctataaatgttgcgcatttgagcaatcaaacttattacttttggttgggtgtatctgcttgtacagtgcaacttgtacaagtagaggtataaaacctaagcattaaatagaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaaggatccaaccaccaccaccagcaagtctctgtcttgcaacatggaaccctgaattatcttttgttctcaaggctacaacaaaaccatctttgagtgtatcaggatatttccttctgagaactgtaggcaacttcgtctcagaagttatttccattggggattcagcaggagatttctgcttgtattttgagtcctcaggagacgcaaatcgtgaactggaactcaatacctggtcccttccactcattgcagtatcatcatctctgcgtgaggaataattactgccactctctacagcagataattcatctgttttctgttgagatctgcggcgagcaggtctctttttccctttctttccagaacggctgcgccttccttctgatcgggggacaatatgttgagatctagcagatgcttgaggctctttatgctgggatatggctctcctcttttcgtactccatttttaactgactttcatctgtctgctgctcagaataaaaaacttgtgaactgctaaccttttcttctagctgatcatcttcatttccagcttcgctaatttcctcatcttcatcagatattgcactacttggaacagcaccatcaaagaaaaaggactgcaatatcgtgattgctttctctcttatttccatccacacttcttcactgtagtctgcacttcgaggaagaattaaaacatttggcatctcccttacctatgtcaaataaatagtatccatcattttgctgaacaacaagttctttttttataagatggatgatgaacaagtggcaccaccatagcaatgcagaaaagggcacagttgtttgtcctctactactagcatattggttgttgctcttctgtacaatatgcagaatcaagagagttcaaagttatccctaaaatagtaagagctcaacaggtggagtgcagggaacttgaaatacttgatgctaaactaaattaaatatttactcattttccatatgtttttcctagagattccttttcaacatccggaagagcagagcattctaaatggtgatgttttgatcttagatgaatttcatccatcgcaaatggccacttatcaacaaaaaaacacatcaaaagctgatggacgtacccacgcttccatccattgtggaccttcagcaccatccaatgcacaaccagctattgtaccatcaatcaatagctgtttgagtgcacaatcatctataagttggcaacttccagtatttactatgaatgctcctgtgagataaacaagaaaattatactgtgttttacggctgaactaaaggcatgataagcattatttcggaatatataatgcataaagcagaagaaagaaaggggttgaagataaaccttaccaggttttacatgctgcagacagtcagcattaagtatatgcatcgtgtcatttgttaatgtgcagtgcagtgaaacaaggtcacttgctgccaacaaatcattgagagtatccattctcctggcggcagaaggaaatacaatggaaggccgctttgcttttccattagccttcagtagacatgctaattcagttagaatagtcaaaataatactttaccgcctagcatttcttaaaatcagtaggtaattgcatacaagtgcgacaagatatatatcatgaactttggacataaataatgtgaactgaacatgaatttggggagatttcttaatgtaacagaaagttaatagcccatgaaaactttgggggggggggggggtaataggttagaaccagataagatatacccatcaagatgttcttgtcacaatgtcatcccctcctttgcattttagcataagttactactccctccgttccgaaatataagcacttctagcattttaaatttgtaccaaaatatagcccttctggtgtactacttgtcccatcaccccccccccccccccgaacacacacacaccaaaaaaaaaaaagcttcccatattacccccaaggccccaaccatacctcatctatgagggggcatcatagtttcttttctattcacttaatctttgctaaaaccctagaaatgcttatattttggaatggagggagtattgttcttacttctttatccaacagctagcattcgtaccacagcttacagagaatatatagttgtctcattcagaaagctgaagaattttgctaaaatacagggaatgagatcattcagctcacaacattacaaagggacgtctcatcataggcagaagcagtgagatcatttaagtcataacattccaaatctttggactgtctaactgttcaatcacctattccaacttaatatgttcaaagaagtttgttcatagcagaacattactaatcagaaaacaactcattctagaattgggggtgaaactgttccagtcggttgctaggtgtatgaccaaatgaaattaccacaacaacaatgcgcggattaagatccagagttttagagctgtgcaagtatacgtagaacagtagtaagaagaggaaactacaggagcgtagcaagtcgtagatccagtaccgaatggcgcggatcgaagtagaggacgtccatccggaaggcgaggctgcgagtggcgaggcagcgggcggcggcggatcgaccaatgatgccgagcacgaggccgcggcagcgcctcatgccgcgacacatcggctggacggagcctagccacccagcggcgacagcggccggggccgacgaggcgtggcgcgagagcaggtgggtccggcggagcagcccgaggaagagcgccatgacggtgtcggccacctcctcggctcggttggcgtcgacgtggaccaggcggaggcccagctccgcggcgagggcggcgtccgcggcgcggtcgggcgacccgaggcagagcaggagctgccacgggcggaggcgccgctgcgcggcccgcgggaggaaggcgagcgagggcaggagcacggccgcggccgcctccacgcgcccggaggcgacggcggagagggggacgtgctccacccccgccacgccggccagcccctcctgctccagcgacgggtcgtcgaggcagttcagtgacaccaccagcggctggcccccgccgccgccgccggaggccgccgagcgggccatccctgcgcctccctctcggcgctcggatcgggagcgtcgcgtggcgcgggttttggtgcgggcctcccgtctccgggccgaggggggctttttgtcccgtgcaaagggaagaggaagaagagggaagaaatgctctgctgctactacgcttgtcagagtggtgggccgcacgggggccaccactcaccagctcacgagggaacggtgcgttgcaaaccgtcagattcgcattgttaattgtttgcagcttgtgcttgtgtctctcgcgccactgccagtgactgagcagatgcaaacaaatcttgaattatttctttaattcattgtgatgattcgaaaacattatttagcatggcaatatttatgaagatctagtagctaaagtccagaaaagatcagttggcatatccatcaaaataagagaagtttgtttcttcgtacttaatcatggagttttgggtaccaagtaaagcactctctgcttttcttccctccaagcaaagcctggtttagttcccaattttttctttaaacttccaactttttcatcacatcaaaacgttcttatacacacaaacttttaacttttccgtcacatcattttaatttcaatcaaactttcaattttaacgtgtattaaacacaccccgagagaaagattgcctcacatcatttagctgccaaggatagacagctgcccgccgcctgtgtacattgtaacaaaaatgccggactgaactcaagtgaagagttaaaagatagagacatagagttccatgatttccatcaagtaacccaacaagttagcacaacaagatcatgccatcgagcatcatcattcattatagtgcatgcgcttaataccctgaacatttaccaggcatgtgatatatcgtcacaatcaatctagaacagaaaaaagtatgcagagcgcaaccggcatggaggcatgttactcctccggtgcattgattctgctcaatcacacaagcagcagtacagcatggttgctttcttcagagccctcatgaagggggaagtaccatccatgcatctatcagtgaaagctactaacgaacagtatttgtcagtgaaagctactggacagctgttcagacaaaccaatttgtcactttacgaagctgacatggatttttccttcaaacaaaaatgcatgaatattaacagtaagagatgacaaaactgtcgtgtagtatgttctgaacttcgtgctgcttgtttgtcttgacaaccttccaacattcgcacattcactgagttcaacttatgcttcacttcgctatgctacttaacttcagaaacaaaatttgagtgtggctcaattaccttgcacttctattccttgaacatttcagtgttgcatcagaggcatatgcctaaaacacactttgaacaaataaccaagtcagcatggtattaaagttttttaatcaatcagacaggcacatagtacccctagagctaataatcgagtgttgttacgttaacggtacataatactgtctgcagctaccagctactactcaccagaaagagagccatcaacagagggggcacacaagttgttgaagcaaatagggtacatctagaagaaattgttcattctcaacctcaagcaagttcgcaaggtacccactgtttcacttttgtgctcatctcactaggaactgaggtagaccactcatccaagtttggaagaggacccgtcaatgcaacgtaatttacactctctttctctgatagtctcttccagttgagctgtaattcaggtttacgtcaggtgggcattctaacaacagtgacatggcattgctcgtatacgtagcaacccaaaacagttaaacaattaccattccatattttattgttttaaacttttccatcatctagtactagaaactatacaactacagcagtcaaaatatggatatttctgtggttcatgtataatcttacctgccccggaaatgcagcacagagtgccttaattgtggaattctgaacccaggacgaaaggcccgtatcattagcaagagatacagcagcatcagctccaccacagttaacaatgatccgtccatctggcattagctttttcgcgatttccaaccaggtttcaacctgtaacaatgttgaaattaaatccagtagaaaataaaaaactgtggaagtgttccaaaaagttaaaagaatatagatatacaaaagtagcgtccaggaattttctctcagctgcacttttacatgttttgaaaaattgttcaaattatttcaattgcagagaatcatatcagccatttggtcaattaggcttgaaaggaagggtcgcaaaggagagtaatccatggatgccgaagacactaaggtcacgtaaggttttttgttaagaacactaaggtcacacaagtagcttacttttgttggtgtatccaaagcaccctctattgatattgggatgcataagattttttgtcgacaaattcacatatcactatagcaagccagccaaactaagggtaataaatcaacacatcatgagataaattaaaatttattacaaacttcaagatatgtagatatcaagtaatttcatccatgcttgaccatgcattcaactgatccaaggaataagaaatacatgctcaaaagcatgaaatctgatgcaaccaacgtagcatatagactggtaaaaaatgaatagaaagagatgcagaggaaatttacttcttgtagctgaggtatgatcttcccatcagcaaacaaatcaacaacaatacctgtacacattaactagatgttgttaggccagaaaactttgagatgcacttgatggtgaagttgcaaggagtgtgtggtttcaaccccgacgttttttgttcaatctccaacacgctcacaatttcttcttaaaaattgtttggagagatgtctcttcctccaaactcttattttttaggccagaaaactttcaaagcctttgaaaactcaaaaagaaaaacattaatctaacagtacatgctttccaatatactacagataatccaactagcatactccaaaaatgcatcatccaagagcgttgtataattaaatagtaacaagagagtaaagcatgtattccatttgcatcaggtagtaagcactcaccagcaaaccctccttcaattgtcagcgttgtataattaaatagtaacaagagagtaaagcatgtattccatttgcatcaggtagtaagcactcaccagcaaaccctccttcaattgtagctgacggagaaagtgcatcaccaatgcgcacagaaagtgaaccacctgattctgttgccttttctaaatcagataaaccaaaataatcccttgacagttcaattatctgtcattcagtaatgcaaactgagagtaagaaatgggcatatgaaaatggatgcgtggagcacaagggataagtctaaagaaaaataatgcaaagaggtgcttgagctagcttaacagccttaactaggaatatattactgaatttctttttgcaacacaataagtaacaatgtgaaaatatttcactaccatctgtgagcctgtggtcaccaaacaattaaaaagagagagaacaatgaaaagagtgttcaccttaggatcaatctcccatccaacaagttgcaaccaaggataaaattttagcatcagatgtgctgcagtcccagcaccctgaaaaagaaacaggggaaaagacaggaatcataatgtgcattgaatatccacaagcgtgtgaagaggtaagttgcccgtgaaaaaaatagaagtgagttgttcaaatgaaaagcctccgtaatgcttgtggatgtatgctggaattgtgatgtgtgctgataatctaattgcaattggtcggtaagacatccattcaggccttcccaaaccctctaagcatggcaggaattttgctttttatgcatagtagttatgcagaacaatgaagtatgatgaacaagataataggtgaatcatgcaccaagtgatttaccaatcctagaagagcaacaggaccacgtggaacaacagctggtaggctcacgaactcatcctgtacaataggaaaagcacaccgtattaagcatttacattgagcagccatttttaaaggatgaaaaacatcatttcaaacagaatagttggcgtagaaataggatgcgttttgcaaagaaaccaacccatcacatagataacaagtacctatatgagcatattatagtctttttttttttttggtactaaactgctatccaactaccaggagcctattactgtccttctcaaaaacttgtttatcatggatagttgacgggatagagcgtcaaattcctaatgcatacaaggcgctcaacaatattatgcttgtatgtcaaaatggcacattagtaatctaaattcaactcgatcagttcagattactcatacgataaatgcataccctgtcagcactcccgattgaaatcgctctcaaatctcacactcaactcaaactttcaactggatcaatttgggaacactggacgaacagcttgtaggcatgaaccttggtagacaaaggttttcgtgctttgctagttaatctgcagcttttcggttttcttccctccgttttgaacgacaattacaacaaggttagggccacgatcccatggtgcgctccgtgaccggttagtggtgaatgctatcccatacgccccgggtcacggcgcacgacggcacgacgcgctcgccggctcaacggattcagcaaaagcaggcgaaacaaaacagcaaacacctcacatgcaatctaaactacgctataaagattagaagcaaaggattacagttctatacccaatatgagttggtccagactccggtcttggggagaacgctgtgaacattccctgcacgatacaaccaatcgggagcacgaactcaccaaacgaatccaatttcgaggcggaggaagaaatcgcagtgtgcagcgcaatacgtacggttggtgtcgaggaggaggtagcgggtggcgggcgagtcgatgatcatgatgacctcgttgaagtcgctaccggtgatggcgaggagcgtgtactcctcctcctcctccttcgccgcttgctcctgctgctcggtggctggaggggcggagacttcgccgccgccaccgggggcgcagtacagcggccgccgcgccgaggccgctccccgtcgagggaggagggagactcgggtggcggagcggcgttggggcttggcttcgcggcggcggtggcggtggaggaggcgaggcggggagaaggttagcggcatggtggccattgctgatgagatagaatgctaatgcacggcgagggattgggttcccacgatttcaagccgttgatggagatggcgggttaggaattcccttttgataactgcaaagcgtattagcgtaatcggttcttctcttaaaccatgattatttcttaagaggccttttcggatgaggcccgataagagaaaatttcagaggcccagcagatatagtcttacaatgttatgggccataattgggcctgagtattctagtgtggttggtttcatctgaaatcaaactgcgaagcaagcaagcagtaaactcccagaataatagcatttcaaacctgtacaagacaaacaatcttgatgtgttgtattgattcgaaacttcgaacggctgtttcagaatatgagcaattttttttgggacaggaagaatatgaccatagtacttaactttctcgcaggtaccacctactccaggtgattgtgcatgataaaatgaatctgcagctaacaacctagcctctccccaacttccaatcagtttggtcaattggagcctttggacacatgcatcggacgccaattgacctgtcgccggccgccgggagacacgccgcgacaggggccacgacgccgccatgacatccgtaaaaccagcaaagctgcaaagacatcgcggccgacactgacgcacgcaacggcgcacgtcagatgagcccacgttccttgagatcgccggcaaatacactgggaattcgatgtttcaccgatccgccggcgccgtctcgcgcaccgacgcagtttctatcaaccactctctccatccaccaaattagccaaaagaaaaaggttcggttggtacttggtaggctaagctttctagctcgttttctttgtgctttggctcgctatcaacgagcagcctcccgcacttcacggcctaatctccatcaaattgcagtgacaataatgtactcttaaacgtatttaatgacacgtacacatgcagcgaatcccgaggacgtggatttatactgcaactgtagttaacgtgtcagcgcagtgcgtgcatgcgtgcgtgcaagcgtgcaaggtgcaactgtactgcatgcagcatgcgtggacaagacgtacattagctagttggtagtggcgctgtacgggagaggtttcgttggccggcggcgagggcggtggtggttgtgttcgccggcgccggcgaagagctcctcacagacgtcggcgaaggcgcggaggatgaggtggtggtggcgcgacgagttgagcgagaggaagcgatgcagcagctcccgcagctcgggggtggccgtgatctcgttctccacgatcatctgcgccatcgaccgccggaagtcgcccagcgggtcgtccgactccgtcaccaccggcacgctctcctcctccagccgcccgcgccgccgcctgccgcctgacgatgcatcgctcgcgctcctcctgtgccgcggcggcggcggcgtcgccggcctgatcccgcggtcttcccggacgcccagcgcgcgcacgccgcgctccagctcgcgcagctgcagcaggagcgtgcccacgctcggcgtgccatccgcgtcgtgcacggtgttcggcgcgggcgtgggcacggtcaccctcgtcgtcttcgccgacgtcgcggtagcacttgacgtcatcgtcggtggcgtggtcgtggcgggcgagatattgccggcggcggagagccgggacacgacggacaccgacttggcgccgccgcagccgcacatgaagccgcgcgcggccgctgcgctcgaacccttcttcttcttcttcttcgatggtaggccctgatcggccatgccgcgacgtgtcgtcgctttcatgtccttgggttgagagcaagtgagcttgtgcgctgtttgttgtggactagctacaccagctatagtggggagctagggggacagacttcttaaagcctgggcttaacaagagccagctaggtgaatttcagacatgctgatgcagtagcagcaattactcaactacagacacatttataattccaagtcattaaccaaaaaattagtatcacgctatccgttgttaggaggtcagtgtcagattctggtcgatttaccagcggtaatcttgggtcaatccagggtgaaaacaacattgacttacaaagtatagctcaatactatttctgaccgttcagttaatcggttactactcctatttgtttcagacttatacgcttaccattctgttcgtgtacagatgtactgatgctttcagattttgcataactctatttgcaagggaagttattacaaaacgcacgcaaggttgtactgctacgtcagaaacagggcaaagaacacatcagacaaatgaaaaactaacataccatttcccaagcttgcgcgcgatttgcgcaactaaatcccagcgaatagaacaaaagagcagatgacacgagacagaggaaaatccaagggatgtcaaagcgaagtgacgggagatttggatgggcctaattaacagatttcctttcaaggtcagagaccctactgcaaacagcaagattacactacagagtacagtacagtgcagaggaggagagatgccttggaagaaacactgtgctgggcctggacgtttgtttgcttgcttgtcacatgcatcttctgctggtaatacattccggccacgctaggcaaagtgctccccgtgctctgctgctcatgatcatgatcatgtcctcaacagaaggccaccaaacttacatgcttgctgtccctgcagctaaccgagattgaactagtgaagtgaatcagactgtcaggaggtaattgatgcagtaggaacaccaaacagcaggtgtaacagacaagtgtgtcttctttagagatactgatcattagatgatggtaatgtggcatacatcaaaacgaaaaaaatgcttcattagactgctggcctattctgcaaaaaataaataaataaataaatcgcattctttttaaattggcatgtcctgcctttttgagttttgactctagcacaggcacttggtactcgatcaaacatgttgtctcctgataaaaggtggcaactcctgtatcagatgcatcctggggtgattgattggaaacaagaatagttgtcttcgatcgttgtgatggacaaatggtgtggaatctcaatgatgtcttgattggcttcatggctgacggctcatgtctacctgggtatcaggcatggagcattacgaccggactcaaatgatggtatcagcgccggcgaaggcaatgggccaaactagggtcatatccagagaagtctagccaaacactgatcttaactcagcccaactgattcttggcccagtactacatatcatttctcagcccatctagcataaattggtagaaacagcccaaatacccgcaaaaaacagaaagcagcccaacatctgccttgtgaaaattgggcctgaaatactaacaagcccattatatccacttacaaaggccctaagtggaataaataaggaataagttcatctgaggtcccttaacttgtcaatgaatccgatttccgtccctcatccggaaaaccagacacaacgggtccctcaactatcaaaaccggtgcagattagttcattcggtggttttgaaagcggttttagctgacgtggcgcctacgtggctaatttaactcggtcttcatttgacgtggcattaacgtggcgattacgtggcaattcgatccggaaaaataataaaacccgtaagacccacgtgtaagtctcacacagaaaataataaaaaaaagtggtgggacccacagtcagtccaactcacctctcctcttcttcctcctctctccccatctccctatcttcatctctctctcctctcctctcctctcttcaggcgacggagaggcagcggcacgcggcggcagtgcggccggacaacggtgcctatgcggaggagctcggccgagcgacggctcggcgcgagcgtggccgtgtggcggcgccggccccggcacgggtcgcggcctcggcggtgcggacgggcagcggtgccgatgcggaggagctcggccgagggacggcggcaccatttctggcttccctgcctcctccctccccgcccacctcgccggccgccgcgcgccgcccgtctcccgtctccgccgcgcgctgctttgctgctggtgaggtgagagaaaaagaaacagtgagagagatgaccagttcgctcgcgctgcccgcaactttctcctacctccggccgtccaactcctcttccctctcacaggctcacacacttggcgcgccccttgatcaattcgttccccttctttttcttcccccttgcttgcagatgggggcaactagaggaagcggctgagacaggcagaggcggcgggcatggtggcgccgcatgcagaagtgtcgttgcagccgcaggcgcaggggcaaggggcacaaggtagtgagcctcgcgcagctgcacaagcggccggcggtgacggtgctcagtctcgagttagacgatggcgggtcggagcacgtgtcgacgacggcctcctccgcatcgtctctcctctccgagacgagctcgtcacgcaattcgaccagtacgagaacgagatggtgcatctgtttcaggatcatgtgagggtcgtcgttgatcgtgttgttttgttattgctatgttgttcagcgatgtttttctgatggttgtggtgtagctctgcttgcttgttgtagacggagaggctccatcgcgtgctcggcaaggcgaggcggcggcaataccagtcgctgctcggcgcggcggaggcgcgcaggatgagggataaggaggcagaggcctcgaatgcggcgcgacacatcggcgagctagaggagcgtgtcgcgcggctgagggcggaggcggcggcgcggcaggcgaaggcgcttgccgaccagttccccgcgcgccgctccgcccaccacacgccgccactccgcttcgccccgccgcccgccatcgctccgcccaccgcccccctctgcgccgccgctcgccgttctgtaggggagagagagagggggatagagagaaaagggggctgacatgtgggaccacatgggccccaccttttcttattatttttttatagctgacatgtgggtcccatggtttttaattatttttccaggatccaattgccacataagtgacacgtcaatgccacatgggacgaggatctagtcaaagggagccacgtaggcgccacgtcatccaaaaccggacataatactgccgagggacattttctgcacggttttgtaagttaagggatgcgttgtatccggttttctagactgaggatgaaaatcaaactgggtgacaaattgagggaccgaaagtgaacttattccaataaataaacattcctgcttaacaatcctccagaaatagtttttctccgtggtactgggattgtagtcgtcatgctggttgtcatcctgggagcgaactcttgtgtttggaggtgttcgttctcgctcggtggtcgggttgtgactacggttttccaaaccctagtcacaattgtggccggagccggaataccatacggtaaccgtggtaattgtggcaaaccgtataaaatttatcaaaatttaaattatttttaaaatttatttaaatttaaggaggtttaccgcggtttttcttttaacgcaccccgtggtaagcgcgataactacgataaccacgtgcttaccggcggtttgggaaaacttggttgtgaccaaggtgttttttctctgttttcagaattgtgctgtcttgaactgtgtcttggaaaagctggttttcccagtgaatgatgccgtgatagctttctgtaaaaaccgggtcatatgacctactacacagtacgtatgttttatcgtttgtcttatttaaaaaaatatgttattattatttattttattgtgagttattttattgctaaaagtactctaaacatcgcttatatcttatgtatttagaaaaaaagtttaaataaaacgaatggttaaacctgtatacaaaagtaaactgcgtcatttattaaaaaaggaaggaggtgctttctaaaaagaacaatcttacagaaaagaaaataaatacggaccagctaaatatgttttagcagcccgccagtattcatggagtgcaacatcctacctgtataactatagccttgaatcttgatgtgaaaatggatgttctggccttacttagtttcaaattttttcttcaaattttcaacttttctatcacatcaaaacttttctacacatataaacttccaactttttcatcacatcgttctaatttcaactaaacttctaattttagcgtgaactaaacacaccctctgttcagaagagaaaacaggagttttgggacttagtaatgtctttccaacgccagcgccagcgtcaccatctttcttttccgatcacacggtcatcactcggtcaggttctcgtcttgcaaatccgctcgtctgctagctcacattcggtcaggctcctgccgttggaaaacgacacgacccaacgttccaacaagggggcagcagagtcgctccagttgggctgggagtctctgagcaaggcaaatcagtcttagctaactaaccagcagagacgtcaagcaattggtctcatctctttcagtttcataccaatctgttatcccccaaaaaacaagaagtttcataccaatcgagacgttttgtttgatgtcgcaacaatagtagcccggctcatgttctcccctgttggatgtttgcacatgaacatgctctgcttagcgatgccttggggagttgggatttttggcgatgtgggtttcgtacaccggcaggtgacgggtcgtgtccacccgatcgtataccgtcaccagcacgtccgcgtgccgatcgtgtccaccgaaacaacaacaactactactactactgtagcccaagtcgcagtcgcagccgcagcaggccatcgaccaccactacgccggtggcccaagtgatagtatttaggacgctttcgtcgcattgcattgcccgctcgcccctctgcttttgctgctgttgcgttgcgtgatacgctcgcctaactttggctaattctgctgatatttgctcttcttctgtcatatcaccttgccgctgcttctgatcatctcccgttcttgcattcttcttcttcttcttcttctccggcgtggtgtgctgctgacggctgacgctggctggtcgtggacatgtcgaaggtgaggctctgtcttttgctcttggattctcatcctgattactgtagtagcttctgtgggataaaatgatctctgcttctgaatccagtaaaatatacatgttgtttttgtccgttacacattgcgagcgttcgtataccatggtggtgcgtaaactaacactgatgtttcacatgttcctctgctgcagaagattgtggtgaagctggatctccatgacaacaaggacaagcagaaggccatgaaggtcgtctccacgcttgccggtacgcatcgtgttcgatccatcaaccgttctgcccgtgttcagaaacgatcaagagaaatgactgctgttcgtttatgcatgtcactcatgtcaggcatcgacgccatttccatggacatggcgtcgcgcaagatgacggtgatcggcacggttgacccggtgaacgtggtgagcaagctgcgcaaggcgtcctggccggcctacatcgagtccctcggcccggccaaggagccggagaagaagaaggagggcggcggcgatgccaagaaggatggcggcgatggcaagaaggagggaggaggagacggcaagaaggaaggcggcgatgggaagaaggaaggtgacggcaagaagggtgaggcggcgg

SEQ ID NO: 58191 - DNA, 15098 bp, Oryza sativa
atatatatatatatatatatatatatatatatatatatatatatatatatatatatatatatatatatatatatatatatatatatatatatagggagcgtatcctatgtacacaggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttgttacggctaaaatataatgaatttgatgttaagattttaaccctaggtgtaagacaattgaaattatgtgtatgattttttctagattttttggtgatattttttagttggtgtgcacgtgtgtacacgtaagggcctgtgtgcataggatatgttgccatacatatatatatatatatatataaaagttgctttctattcattcataatgctctgaggtgattgcttttattatttttttagttaattccataatttgtgctgattaatttaatttctagatagaatcatgtttttatctctacaacagatttacttcaaatgacatgctaaagttaccttcttttgttttaagttacttctataatatatataaattacttttaggttttactgaatttacttttatatatctaagaagtaaattagtgaaatctaaaagtaatttagacatatcataaaagtaatttgtgatttttcatcaaaatataatcatgtgagatcttgttgtaaagatttaattgttacgaacacaacggtgtaatcggatcatagatcggataagtagtttaagagaaaattgtatttgaagtatagatggatgatacctcttatagatggagtggtagctagtttagacaaaccagctaccactagctatgtagttacgtccaacccggagacagtggcagtggggacaagagctcaagctagagagacgacggcagatccgggaggacgacgcctcccctgctgcgagtgacggcggcagcagcgtcctcctggggcttccacaggcggatcaagcggtgtcgtgcggcttcccgcgagcggatctggcagcgacggcggagtcgacggcgccgcgggctgatctagcggcgactgcggcttcccaccggtggatccgatggcaacagtggcatcggtggcttcccgtgagcggattcgacggtgacgaagatcaagataagatctctgtggtttttataatttttcctgttcgttttctctttggattgttggattggattttgtatatatctttgaatttgtgttttatccgtcttacgcgatgtgttactcgttcgtgtgagaacggatgccatcattcgatcggacttacagatggaaaattgatgtgacgaacggaaagtaacaaattatgtaagtaggtatatgatatgtgcaatcctttcgtacgctatacaattatatgtggtgcgagcctttctaatgtggcacacatgtatataaggcctaatttatagtctgtatttgtatttgtcacggttattcgtcgaatctctactattataaaaatggaagatatttttgccggtactttagtacgtcatccgtatttgaacatgcttttaagttacttgcttttggaaatatagatccgtgtttgggttggtttttaagttcattcgctttttgaaatacgaaagaagtcatataagaaatctcttaaaaaaactcgcatgctaacttgagactatatatagcacttctaattgaagctcatgattttgttaaaaaaaatatccaagcgaattcccacagcaaacttcaccttagctaaaccggttaataataataagattaaaatggcttcacccgtcgcaatgcacgggtatttttttagtcaacaaatatacatgaaaaggttgccgacaccgcctgcgtggcatctcggccgaaaacttcccacctgcagcacagccgcactccaccacagtgctgtctccttccaactcggaagctctaggcggagctaagcacaaacccaaggtcatcgtcgcctcccgctacctcttgtttcctccttcaaatccacttccctagccattggccccaccacgacctcgacgatgatgacctgcggcactgcgtgtctgcgtccccggctgacttgaggcagccgacgctattgctgaagggcgacgcacaagctgacgctgcatcagatcaggccgggttccggggcgcagtggcgctgtcgcattaatttggttgtggttgataattgggcttaatcagattgctcgagcagatcgccatgacgtcgcctcgatgcatccgcggactccatcacacagacatccttgcagagggcaagcgaggtgtgcgatgttgtgcaaggccggctggctggggcgcgcaatgcgaagagacaatgtaccaaaccacgcactcgatggatgaagcggcaagcggatagatacgacgatggaaaaggtatcgaatttttaagtaggtcagattagattttggaagggacgcgagagtaaaggggaaacccttcccattattttgactgccctatccatagttgtgacgattaattctgcagcaatggaagtgatgggctagaactctctgattttctcttatgtctctgtaatgcaacttctgcatgcaaatcttatattatagctacttaaaaattataacttatcgatcgtcaactattttttcttcgtcaatcacctatttttctgtccaccaatcactttttttttgttgtgtgcatctatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttaattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctatatatatatatatatatatatatatatatatatatataggatacccatatgagactccatggtgcccgggcttcaaggtataaaacacacaaattctcttaaatttttaaaaatttacaaattgtaaatagatatctaggtatatgaatttgattcatacaaatacctaacaacaaaacaactcaaactcaactttatttcacaattcattattacatacctaacgaattatatgtttagatgttatatacctagaaccaaaatgtaacaaaaaaaaagttcaaactcagtttaaacttgtttgaacttgttagtacagaagttaatgttcatatttaaatatttaaaaaaaattcatactcattcaaattgggtatttcttggagcccatactccatgtagcacatatatatatatatatatatatatatatatatctagaaaaaaatgcccgtgcgttgcaacgagtaaaaatattttgaaattgatatacattatctagcttgcttggtttttttagttgaatactccttggttttaggctgaaagtcccattcatttcttttcaaccctcagccttgttcgctagctccatccgctcggcttgcctctttggcacggccagtgttggactcaggatgttgcggatgaaaaaatttaggtaaggacggacgaatccttacatacttttttattactagcaaaaatgcccgtgcgttgcaacgggtgaaaaaattctaatgataatatacgtttttcataaataatcatgtcaatggcaatgtttgtattttaatgagcggcttgttttttacaaacggtgtttttttcttgcgcgattttctcaaaccattcagaaatgacgcatttctttctaaaagatttttctaacatgatctttttgcttttttatttacaatgaaaaccatatttttctccattttttgcttttcttttctcgtgtgtttttttgcctttttttgccaattattttctcgcgtgtttttttgcttgttttttttcaaatgttatttttgttgctttttttaaaaacaagagaatatagacgaaataaaagccgtgtagtaggtggcaaaaaatcgatggatcctatccgactcggagcgatttttttaatagacggtgtttttttcttgcgcggttttttaaaaccatttgttaaaatggcgcgttttttctgacagttttttccttgcatgttttattttttaaaaaagttaccgatgatggaaataattttcctcgcgcgtttttttatttatttatggaagatggaaaacctttttagcgtgtttttttgcgctttttctgacttttttctcacgcgtttgtttgaaccgtttctattctctcgtgcatttttttaaaaaaatagttagattatattagagatagagaagagatatatattgattagaaatttcgccctttccatttttttcctgtgtgcattttttattttatacgaacaagcgttttattttttacgaaccttttttttcgccactttcttatggaatcggacaaacttttttagattttttttctgttttttttcgcctttataggaatccgactttttttcctgtttttaacggaatcgaatctagtattttttttttcacttttttttgccttttataggaatcagattttttttcgttcggatctacggttttttttttgccacataggggaaacggaacttttgttgttgttgtttttctttttttttttgcagctttcctttttctttttatgcacctttctgcttttgttctctcttttattattatttttaacaaaaacggcctcaagtaccttattgcaagattataggaactcaaatataaatataaaaattatagggactcaaaagcaaaagtacaaacccaaaaattaaaatcatataaaaatggaatgctctcgacctgtaggttctgttttattaaacagatctctaatccggcacatcattttgtttcaccaagatatgtgagatatcacggtatagattaagaatcggatctatagtcggactttttttctgtttctgagagggaatcggataggagtcggaccttttttttttagcttttttttacagacgaaggaaacatcttttattattttttaagtagtagagacagagatagagatagagatttttttcgcttttttgacatggaatcggattattttttcgccctttttttgggatcggacatttacggttttttttctcgctcgtccgtttttttggggcagtttttttgtcgccctttttcacagaatcggactttttttttcccttttttattggacagttacggtttttttcatttggtttttttcgccggttttttgtcgccctttttttcacggaatcgaattatttttttcgccggacagttacggtttttttttgcccggtttttttcctcgctcgcccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgattttttttttctatagtcagattttttttatgttatgctgaaccttttttagatggaaacttgttttttttgtcatggtggggtatcgaatcgattttcaaaggcggttaatttttttccgtgttgaatagaaataggacttttttttttgctgcgcctcttttttttttgcatttttctgccctttttttaaattttatggtacgataggaataggaatcagatgattttttggggcgcttcttttttttttttttgccttttttacgttttttttgccgcgtcggaatcggtctttttttgccgcttttttttttctcgccgccctttttttcacccttcctattttttttcgcgctggcctttttttttttacagtcggactttttttacacggacgaaggaaacactttgtatttttaatagtatatatatatatatttttgcccttttttattggacagttacggtttttttcatccggtttttttcgacggttttttgtcgccatttttttcacagaatcgaattatttttttcgccggacagttacggtttttttggcccggtttttttcctcgctcgccctgttttggtttttttcctcgctcgcccggttttttttcgccggtttttttgacggacgatggaagcacctcttattttttaagtagtagtagattaggtacatattaacaccataaaaagtgatcgtgggtcctttgcatgtgcagcaaccttttgtttctttcatggaaagaaagggcattaattttgtatacttgaatatgtattacatcctatatatcggtaagcatatatttatatatatttttgtgtatataatatgattatctttacttttcaaattaaaaaatggttcattataagatttcagaatcaataatttcgaattaaaaaatggttcattataagatttcagaatcaatctgttgaagaaagaggtgcaatagttttgatttttcagcaatgggatgtgcatggtaatatgatttgacacgaaggaaggaaagtagacttattctaggatgggcccatagacatagtgccagcaataataggtgaaaaaatgcgggagatttgacacgagggagggaaagtagacttattctaggaggggcccattagcccataggcatagtgctagcaataataggtgaaaaaatgcgggagaggaaggtgggaatcgaaccctggtcgccgggatgaaaactttcgatgttaaccatgtaagcagattactatatgtgctacgagattacatggaacttacatatagtatataaaccttggttttggagtagattgaaaattgtccgatccgtctattaatcagattaaaacggatttagctacacgtgtgggacggacgaaaaaaacgcccggaatccttacatattttttaattatatattaggtgtatatatatatatatatatatatatatatatatatatatatatatatatataaggaggagttgccccctccaatcctactggtgaaatcactcggatcatccctaccgtccatccacatctatctactaatctggaccgtccatcttcttctatcataatccgtttcgtcgtcctcctgatgagcggtggtcctcgcgcggctcttcctatcctactgccaactcccgcgatgaccgcgcgctgaccacgcctcgctcctctcgcgccgctcctcctcgctgattccaacagcgacggcgattccactgattccaccaattctgccgctgttggatctccactgattccatcgattccaccaatttcgccccgaagcggtgactccgccgtgcgcatcctctctcgctcgctcctcactcgaccagtgccgacccactggtgcaccgccacaacgccggatcagcgccgagccaccaccgcacaactgcatccccttccgccggtgccacgcccgggactgcccccgacgacgacggacgcacgctcccattgctcctccgcaaatagctcctgagcttcacgcgaagcccgtgctggcccggccccacgaaagcctctcctccgcgaatccctccccatggaagccctaagctcctctctcttcctcagggagcgtcgccgatccgtgggtcgctgctcaccctcccgtcatcggctgccacccggcgtctatcgccgtcgctgttggatgcaggtcgttgtccggcgttgactgctctcgctattggatcaaggttgtcgcccatcgtcaggcatcatccactgccaccgccgctcgccggctcgccgcccgatcgagcaggccagcacccatctccagtgcccaccaggtgagttcccacccttgcactgcagccaccctagccaccatgtccaattacgatgaaacattctcttttttccctctttcatgttctttgtaggtgaaccaggtatagaggatgtggtggaggcgtgggggctaatcactatcagtcagattttcgtggatcgagcttattacctgagttttctcctcttcgctgatggaaccggttcaggtgcgctgcaaaggtaatagttcaagcacccccagaaatcaagtagtttaaatacttatgtgttgaataaactagcataaacgacataacggtgattcagtagtttttgttgtaatagttgctatcgttgttttcttgcagatgaatgtgctcttatcctgatacggcatatagtgaatcattgtggaatgactgaaatctgttttactgtggaatgagcaaaaaatgtttacttgcgttgatgtcgagaaggttatataagtcgggagctgtttggaaagggttttatcggagcaacattattgggaaagtattttgcggagcagtttggaaagggttttatcagagcaattctggaaattgtacttttattggatcaataatgattggaaaggattttatcggagaaatcttgattaggaaggtatatgtacgtgtggtcagaaatttatccctttgcaattcaatagatgcattctctattttgctaacaggaattaatttgcatttctttggtaagaaaacagacgatgtgcattgaaagaattattgttctttgagatcttgataatatgtttcttgtccaggcattcccatgagttgcaaatccaaggaagttaataacacgacctgtctacagtattacaagctaatcgatttatcccattacaagctaaagcccactggtatgtttttgtttctctgccattcaccattgaaatatggaatgccatattcttttttccttcgatgcactcttaattgtctgttccaatttcttcgaccacttataatttgcagtttgatattgctttatcccgctgctttgccattagaaccaacaaaaggagaaatgcctttagctgaagtcctcagattcaataccaaagttgattgtttgattctaaacataattatcatggtttcttgtggtcctttaatggtgatattaagatttgggcaaaattggtacaaaagcaacatgtctaaaataccttggtagcttccccatttctattatctctccaatttactcttaaattgtatgatacaacattatcaaatttcatagtagttattttggactcacctcttcaaagtacctgtcatctgggttgggaggtaatttctaaatctcagctctactatgtgatgatctgacattcatattttactatatacttcttgtgactagaattcctgctgcatattacgtactagctaggtatttcctcttacaataatggttgtcagaattagcagcatgaaactgatcagctcaactccatgcttgaacaatttgtgagtttttctttactccagaacacctgatcagttgacatctatgatatatttaacagattatgttgattgcgcataaagaagtagcccaacatatttctgctatgcacatgaacatattggtacatatttacaattctttatttttacgaggcactatgctactgatagtctattgatgggctatagctgaatttagtttaaaaacaactactggtttttttttcacctacgttgccattcctccgttcctgcatgtccactttgttgcaaatctagaattgtggagaaactcttgatgttcatcatatgccagttcatacttttctaaattgccaaattgaaaagagggttacatatttattcagtcctatctgcaggttggaaattgtatgcagctagctagatcactttcttatcacaactcacaagattgccactttattagctatagtttgaatctaggatggtctgccataaggagctttaattacttctatgaattttgttaaatcaaaattgatccatttgtggcttttattgtttgagattgaaaaaaaaatcaggttgctgctcaagagcaaaaggcaataacatggggcagtgataaaactatttttgggcacagttagtctgtgactatgtcttcatgggcataaatgaaagagaaactcattgttaaaaaactgaaatggaaacaacttttccatggtgatccgattgaccatcgctcggatcttggatatcaatactgtaattcataaagtacagaatacatgattcagatggagaaaggcaatacatgaggaagatgttttgaacaatatattatcttaggttaaactaatgttttttttcacatctggtgttttgtacccttactaataataaatttgatactataaattctatctcattatatgcttggcaaaacatatatcttattttggttgtttgatttgtattactaaataatttctgtagcgttatcacggacagattactagttttatataaaggccggaggtaactcgtgtatcatcttgatataattaactgagtctaaagctttcattatctaaaaaaatcacctatttttcattcgtacgagctgtttttacacatccggttccgaactttccgatcggagaagttaatgggtcaagagagaggaagagagggaggctgggccaagatcggtgggccgtatttaggccgggccattttagctgggcagcctgggctggcgcgggtcaacgtggacccacgcatccgaggtggcaaggggcgggtcctttgggccgacgtggcaccaccacatgggtgtggaccgggtcttttgatggtgacagcggcttctggagggaactccggctcggacgtctgatgtttggaaaaaaattggacactgacgtcagcatgacgtcaatgtccgatttacgtgcaaaaactactttaaactgattttcctcttaaattacttatccaaatcatgattcgattgcaccattaaattcgttgcaattaaatcttcaaaaaaaagaccgcacatggatatattccgacgaaattttttttagcttattattgaattatttttaaatgttgcacgatgttccactaggtatatcgtaattgtttcactaaatagatcgaaaatgtttcactcgtttaaatcgggtgttgtttcaccctatataaaaataatgtttcagcaaatagcgaaagaatgtttcagttcactgcaacatttgatccatatatagtgaaacattataagtacactaggtgaagcatttttcggtggaaaaaaatgaaacgtattcccttgtagggggtttccaaaatatgtgggtttttttattgcaatggaatatttcagttcactacaacattagatctgtacacagtgaaagattatgagtacactagataaaacattttttgtaaaataaaaaataaaccaaattcccttaataggggtttccaaaatatgtaggtgatttgttacaacggcgtgttccataatatcaaaatccactgcaacatttgatcatcatatgcaacattaaaaaaatatcaatagagaagctaaaatatttttttgtcgaaatataattatgtgtggtcttgttgtaaagatttaattgcaatgaatataacggtgtgattggatcgtagattggataattagtttaagagagaaatcgttttaaaactagagctgcaggaggcgcgggagccgaggcgtccgattttttctttgacgtccgaggcgccggagccgaggcgtccgattttttctctgacgtcggacgtcaggcgcgcagcattttccgtggcttccgggaacagccgcgacatcgacatgggatgagcagaaacgttaccggcgtttggattgcatgcaaagccaaaacagagctaagagattctatcttatacccaagaaaataagttccaaaaaataaaaggaatagaagaaaagacatattatagtcagaaatatgttggtgttaggggctgtttggatgcttgcttcagtttatcaaagttctatagctaaagtgttggtaaagatatgtgtctataataagtgggatcataaaatcaaaaagtgtgacatgataaaaatgtggcaaccaagcaaacacactaagatggtcaaaatagcttaccaaagttatgggaaagtatagtcaccatccaaacaacctctaacagtaaacattctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctttaatctctggattatatatctaccaatcaattatacattatacctattggactgactaattttttacgtgaggaagttgcagtaggcgagtagctattagaagtaattgcttcgtttttaacgtataaagttgttcgacattttacatggtattttactatttgttgtattcagaaaaattatataaatagctttttttaagtatgacatatattgtatcatatttacaatatttttgtaataaaaaatatgttcaaacgttatttaaaagtttatggaattatctatgtaagaacgttaatactacagtaccatacatcatcgagaaatgtatattatacttactagttactaggccaccttattattcgattctccggtggatgagcatggatcactcggtggctctagtagacaaagttacctaaaatgaaatttcaaattctaagtttacttggttaaatcagtcagccagtggataccggcaagtgacgtaatgacgtgcgtgtgctcgtcgcaagaaataactaagcttacgaacttaatatatatactgattttgaacgcttgactaagaactagtcaagtaataagcgaagtggttatttcaagatagtggaaatatctggtttagttcaatgaatggcaaaaaaaaaaaaaacgaccacgcaacgaactctctccattccagaattaccttttctccatatacatcatcagaaaattattactatattttaggatttctctatatacataatcagaaattaaaattattatatattagtacggaggcagtagctcggtatatacagatatggtcggaaaatacatgtacaaatctaataggatgagaaaaagagagattgaaattaagacgaaaaagaaagaaacgtcagattgaacaatattagcccactgtactaactgaagatcgatcagacgcagttctgaaacacaaacccaaccgccgacgccgacgccggctgatcgttcacgaacggcggcatcgccgggtgccaccaccacgccggtaacctcgtcttctccacggcgacgcaccgcccgccgccggcgaccacctccgtcagatggcgcgcagtacggccgccggacacctgatcggacgccgccggcgccgcagggacggcatggagcggcgtgagcagcgggattacctcggcggcggcggcgacggcgtcgtggcagtactccgacgcggcgctcccgtcgccggcgccgccggctcgcacgtcgatggatcccggcgcgagggcgcgcagccgcaggctcccttgccttctgatcggctgcctcgccgccgccggcttgacgacatcctccgctgcatcaacgacgccggcgacgtcctccatcaagaatcacggtcaattcaaagaaaccaatcacacactcgcacactgatgactgatcttgctggttaattgcaacagcttctactgaatatgcaatacatatataggtagatgattaattatgcagataaagcagccacgcagacgcagcagtgtgttggtcgttgggtaggtacgtgtcgacagtcgacacaaatggtctcacaggatgcttgcagttgctgcaggtggtgtccagacttatccagtagctttgactttgttgaccagcagagagaaaacaagcggcgtggcagcaaccagtgagcagtaaccagtgggctcgatcaggctacggtattaactagattccacacctacaattatatggtgtttatatcttagaggtaaaattttagcttgttacattgctatgatatggtataaaattttagtgtgagatctaaacatgcccttatatgtagtaaagtgttaagttacagctatatgcaatacaagaaattttcagttacagcagaattttttttccttccctgtttctgcacaacttttagttcaatctccgcacaaattttgggtcagcttcaacagaaatttagttcagttacagcagaattttttttccctctctcagctcaaattttggttcagattcagaagaaattcagttcagtatcagaagaaaaatttggggggaaggtttattttctgtatgtaatggcatgatatattcagaacatgttaacaaaaaggtcttcttttcttcactgcaaagttacgtatttatacgcatggatagataatactccgtccgtttcaaaatgtttgattcattgttaattatttattctttttatatcatttgattcattgttaaatatactttcatgtacccatatagttttacgtatttcacaatttttttattaagacaaacggtcaaacatgtgctaaaaagtcaacggtgtcaaacattttgaaacggagggagtagtctttaatatatactccctctgtcccataatataagggattttgagtttttgattgtaacg

SEQ ID NO: 58192 - DNA, 647 bp, Oryza sativa
ttatcttgaaggtctgcagttagtgttatatattctagtgcaacaagtaagtaataaaattagcagtggcattaactcgatcgatgatggctaaactgatccttccaaaggactgccctataaatcaatagtgagagagagaggtcataattaagcagaacagtagcaattagtaagacagtagcttgtggtagagcttgtaaagtgtgtagtgtacgtagatagcaatataatggctgcatcagtgaagatggccggcgtggcgtgcgtgttggtggtgggcgtgctgtggctgagcgccgggcagtcggcggcgtgcgacgggcacccatgcccgacgccggcggggaagtgcccgataaacacggtgaagctgggggtgtgcgccgacgtgctggacgggctcatccacgcgtccacgccgcccaaggagccctgctgcccgctcatcgccggccttgccgacctggacgccgccgtctgcgtctgcctcgccatcaacgccaaccttctcggcctcaacctcgacgtccccgtcgacctctccctcctcctcaactactgcggctgcaagctccctgctggcttcaagtgtgcctaattacaattaattactctctctatacaataagagaagctcttattac

SEQ ID NO: 58193 - DNA, 1121 bp, Oryza sativa
tggtataaccacattgccatacataatacggcagacaaggaccttgctggtctccaggcaggcaaccacaggctcctaaagtctcattgacaactgagtgatcaaaaccctctacatctttaaggctgctacggctcctccataagtcctgcagtactttaattcacgaaaatgaaaactgacagtttttttccgcaaaagaaaacgatgttgaagaaacataacagaaaggtgagcatgtgaaaatctgaccggaagtgacattgcacatagctttagtattcctttacaaggcatgatgaatgcatcctcagataacatcgagtcaagtagggtcctcacactcctagtgttaaaacatcagggatatatatttttaagtcttaccttaaaaatacaattgaaatcaatataaaaatacataaaaggtgatttcaaataaaaaaaatgtttgcattttttacttgtcctccctgggtttgatgaatcttaaaacaatatggatgtgtggtgcttgataaatgcaacagaaacaaggaaaccaggtgtatcactaccagacaagtccagtctgcgcaaacactactagtaactcttattccagcttttgcttgaaagattaacctggttgtgcaaattgttcccaaggtttatacttcatatgcaactataaccaaagagatggtactccaaataatttcacaccaaacatgggttaagtaatactagtgagttgtttggtttgaggaatcaaaccatcaaccatgagttgattcatgatgacatcatcccattcctgatttttctagtaagcatgtgtctttgagggataaggtggcgacgtactgatctaaactctattccattccttaacaaacaagttgtacaggatcaagtggtcaattgcatgttctattgtgaatctgtgatggattgtgaatctgtgatggacatactgcaggctacggagtaccatacaatatcgaaaattattggcttcactgttaggaaatctttgaaaagcagcatgcactagcagagtgtagaaatctctaacatcaatcagcaatggcttcatcttatcaaactgggggtagttttccccttgtacagaaatatgc

SEQ ID NO: 58194 - DNA, 1331 bp, Oryza sativa
actagtatgccttttaccataaataaatttttatggaagaaattctgtggtgaactttcataagttaatttgtgttttcagaacaaactgagatttattgttagtttgtggagtattaactattgcatcaaatcttgcaatacgtaggctagattttacttttacaatcatttcttggaatatatatttcggacgaaaccgaggagcggccggagtggagagcgatgctgcgatgtcgggggaggagatggcgacgtcagccagtgcaccggcgaggaacagtggacggccagagggttcgggatactggacaccgctccggctttacggtgtatttgagagaagaggaaagaaagattaagaagatacgtaacatgaggcgagatattagagcataattaattgagtattaattatttaaacttaaaaatagattaatatgtttttaaagcaactttgttataacttatttttaaaaatgcacatgctgtttagccgtttagtaagcgtgtgcttgaaaaatgagagtatatcttctttatcattgaaacaaacgaagctatgattaagaggatgatgttataaaaaatatcctactttgatactcccttcgatttcataattcttgacattttaaacactgacatggtctttaaaaatatctttcaccttgtttttttattataatatatctttacctattataaaaatttaaaatgtttttgcctagggatttcatacgtcgcttgtccgattttttttcaccctcgcgcacgattttttccgcaggtgcgtacgtattttcgttagattcctttactaccctacgtagtgtccgtattcctttcctatattgttgagatgtccaggttcgcttttatccaggcctatgtcgctttgcattcaggcccaggcccttgataattccaatatatttacaccaaacagctacaagcgtatccgctttcagtgtttaaaaaacatctcaaggacaaataaactcctatatctatatgtatatttctatctctatctctattattataaaaattgaaaatatttttgttggtacttttgtaagatctctatatctactattataaaaattgaagatgtttttacccgtactttgattagtcatccgtgtttgagtcagttttaatttcttgttttggtttcaatctctaatcctcaaaatccgtaatttaaaaaagggtgaaaaaatcacacgaaaaaagaaaacgcccataaaaatgcgaaagaaaaacagtgaaataagtctgattcataccggaacggaaaaaataggcaaaaatgctaggtaaaaacaa

SEQ ID NO: 58195 - DNA, 35800 bp, Oryza sativa
gccattgcctcgtctcctctctcccgccgcatcgaagcaaggctccaccgccggcgtcgccctgaagagagatgagaaagagaaggggggcatatgtcatgtgtttgcctttttcttgactagaataccacatcagctaaaacaacccttaatattatcatggaccatgatttagacggtttggttaagattagatgaactcttgtattacgatttaggctgtgttcaggacccctccttcctagcacgcaaaacgaaactcgtattattgcatgattagttaagtattaactattttttttaaaaaaaatcgattgatatgatttttttaaaacaattttcatatacaaatattttatataaattacactatttagcagtttaaaaaacgtgcacgcggaaaacaagaaaggtgggttgggaggggagggggagaacacagcctgtgtaaatgaaagtggacgtaaagatgaagacgtgactcccgctcgagcgtcccatgggaggaggttaaaatcggacactgacgtccgatttacgtgtaaaactattttaaactgatttatctcttaaattacttcaaatcatgattcgattgcactattaaattcgttgcaattaaatcttcaaaataagaccacacatggatatattccgacgaaaaaaattagcttattattgaattatttttaaatgttgcacgatgtttcaccaagcatatcggaattatttcactaagtagatcgaaaatgtttcactcgtttaaatcgggtgttgtttcaccttatataaaaacaatgtttcagcaaatagcaaaagaatgtttcagttcactgcaatattggatctatacatagtgaaacattgtgagtacactaggtgaaacatttttaggtgaaacaaaaaataaaccaaattcccttactagggggttccaaaatatgttggttttttttgttgcaatggaatatttcattcactgcaacattagatctatacatagtgaaacattgtgagtacactaggtgaaacatttttggtggagcaaaaactaaacgaaattctcttaatagagagtttccaaaatatgtgggtttttttgttgcaaaagaatattttaattcactgcaacattatatctatttaaaatagtaaaacattataagtacactagctgaaacatttttgtgaaaaaagaggagagataagttggtgggcccaacaggtgcgcgcatgtggggagggaagcgactgattttcccacctcctccggtcgaccgatgttgggcattctcctaaagatgagggatgagaagtgaacttgggccctagcccatagagccattcggctctaacataaatagatgggccaagcctccatttcctcctcttcttcttcccccgcgaccgccaccgttgcagccttctcccctctccgccctccttccgccgcaagccacacgaatcaaggtatgcgcgcttctcttcccctcgccctcctcctcctcctccggtcgccgccgccgccgcttcttcctccgcgacgcgtgcgtgctggtcgaggcgggcgagcggattcgagaacaccgatccggatcacttggattggttcgatgtttcgttcgatttgttgattgatcaggagtgaactgcctgcttgcttgggtttgcgctcctcgactgctgcttgatgtggggaatcgaattgagcccgaattgctagtgctaatcctttagtagtttagttgttctctccggctcagttaattttgtcgccgatttattcgatcgctgcgtgttgattggagtgccttagttactgatccaaagcttgtttccaacagaaatttgctggccgcgcttcctccgagcttttgttccctaatttgcttcattttttgcggatttgttcaattgctgcgtgttgaagtaaccagttattcagttactaatccatgtttatttccaacgaatagttgttgctagagttcacaaactcgcttctctgttatgctagctgttgatatgaaggtccttagatggtacatttcaccttggaagatttgattgccgaaaattgatctggttacaacatgtggattgtttgattgaacatgtcaaaccatttttgcttatgaggaacagtttttgcttgctgattttgataaatcgagcataaactgtgtatatcttcctctcgttgttagctacttgctgtggagcagtaatgatcttcctctgaacaacttttgggttggtttcagtatttcgtgtcctgcttaatttccttgtatttctgtttgttaattagtaatggccaattaggccagaatcgactagcaactgtgtgtacttctttgttgtgatatctccatgcaagagtcgtaaaaaaaccatctgcacagagcaagctatttatgcatacatagtgtttgcaactgtaatctgtacatacaaattaaactggaaatgcttagaagtatatcatcttcctaatatgatgattggaaatgcttgcacaggctaatctctgctcgaagcatgtcaaacgatcagcatcggtcatgccgttgcgtcaagtcgaactgtgtcaagctgtatgcacacatacttcgatggatctgaaatacattccattaattagtttattgtgaagttttgttcttactgtgtaacgtctattttctgtactgtgttatatgcagctattgcccgtgtttcagcgcgtacggctattgttcacagaactgccgttgcactaactgtaagaacagagagtactatgaggactttgtggaggagcgtgtggacatgatcaagatgaaaaatccgagagcatttgatcccaagattgttagggttcaagatgcaagtgagattgaaccccagagctctaatgcagtgccggtaatgcattcttctttcttggagcacccccaaataattaatcttatgctgttttgatttcaaattttcaataatggtttgtagtgagaactcatgcacataaagtaaatttcaggaaaatgagcatggatgtatgctaatgggtgcagatgccagaagtccaagtgcctcgtacattcgtgtgaatgcctcaaggtgtgcataccatacatatttgttttgacttacaacctatatttactactagaagtaatcatgcgcgtgctaagcatgtgtttgccaatatgataaaacaacatattgcaagcacaataatttgtgttttttttaattgcattcatcacagcagtcaattaacattgaaaggggaacattccagcagtgttcataatacataataaataatcaaatctctttctatgcaattggaggtgatttgacatttgttttattctaggagttttatttagtttcaattaatttatattaaatttggatgtccacatgatcgcgttaactagaataatacttaaactgataatgtagaattttttatgcatagataaatagagatatgattaattattccaaacaacttatgttgagaagttgagatgtttcatgtgactagcgttttgtgcatcctactattaatgatctgatcttgtcctgaatctgatatgtgtgattgcaaacaacattgaaatgactaagttatgagccctactcttgagaaaatgaaatcaagtagtatcttgtgtctgtttaagccagagagtagaggaatatttgggtgtgcctctgcacatcagattgaaaaagatttttaagttcgcaaatgcagttgagggtgcgatacaaataaaaatacccaagtattattacttggaatgattagatgatgatatggctgttttgtctcttacagcacgaggtgaggtgcacttcaaaatgccagtgtatagattgcggtaacggccccagaacaaagtgtgagtatactagactgttatttctgtttccttgtcttatgacatccaagtgtgtaatcaattgctttggaatagcttggaagcatcgtattttgattttgttcttcacccatgtcattttctttgtcttgaatatatttatctgacttactttatacaaaacagatgattcaaacatcggaaaagatcagagtgatgttagtggcctaacctatgaagagcccacgatggacaccatgcaatctgagcacactctgaatccaaacaaacgcccaaaatattttgcaagtttttggctccttcacacttcgttaacataatttaccagtgtagaatgtaaatgtaatttcaaagtgttggaaattttcaaaggaaacactgatgatctgctcttttatgcagtgatatctctcgcagatcgtgatgctttaccatcctcaagacaatagccactttcttccaaaaatgcaactgtaaatacaaacaggtttgagtatcccttgtaacgaaatcttaaagcacggtgatcggtgaggccttgaactccatgatacttcaaatcttgtcgtccatttggtagtctcagtgggttcagttgaccttgcgcttgatcaagaactacgaagacagttcccacctatagctaatatcatccatactgttaccaaagggccggggtgtatacatttcatcccaatatggaattagttgttttggcatgcaaatgttcctgcttcttaatctctcatgttcttggggatattttgatcatgcctgaatctgtgaatccttcagtgatgagagcacaagtattatgaggtatgatgatgattgcaagtataagtagcctcgattgtattattgacgcagagcatcgactgatctctcatattcctgtaggattcaacctcatccactgcaagaacacacataatttagaacagaaacggcacatgaatcagtaggagtaatagttagtgactactagtaagtatactgttcctgaagggatggttacatggattaatagcttaatctgatacctcttccatgacattgtaagatatgcagggaggcagctcttcttgcagccaatgtgtgagctctccatcttgctcctcaggatcctagaacaaacattagtcaaggaaaaagtagtctcaacaagtgttttggcagaataataatcctgcattggatatcgaagtgtttacaaaattttgaacgaatttacactagagaagagttaaggaggcttatttgtaacttatcggagggagggcagcatcaactaacacaaaccgaccagccagtgatatcccttttttctgttttagtaaaaggattaattgttttgacacgaacacgtgagatatcaattcaccaatttgtgatgatgcggaactaagggcctgtttgaaatagcatattaacagtatgcaaaacgacgcttcttattagcatataattaattaagtgttaactactatagtttaaattacataaaatgtactgtttagcagtttaaaaaatatgctaacttaaaaagatgaagttgtaatttggagtccaagtttagaattcagcttataatttgtttatttgtggaggtaccccactaggctacgttttgcagataaggatcgggagaaaaaaaatatctcgttctctgtgcgcacgtttctcaaacagctaaacgatataattttttttctaaaaaaatctataagaaagttgttttaaaaactcatatgaatcctttctcaaattgaaaataatcaatactcaattattagttacctcattttgcatatctatctttgtttacctttcctctcaaacaataacaagataatccttctgtgccttccaagcgggccgggccgggtaaaaagattatttgggccgcagcccactctgccattcggccctaaagtacatgggccacgcacgcctccatgtcctcctcttcctcgtgagcgcgagcgccgattgccttctccggccgcctcttcgtctccgccgcatgccgccgccgcctcggctccctcaaggtacgcgcgcttcgctccccctcgccctcctcatcctccccctcctgcgctcgactgctgtttgatgtggggaatcgaatcgagcccaaattgtttagtattttggtgctgatttgttcgatcgctgcgtgttggagtgcctagttagttacggattcaagtttgtttcgagcaaaaattttgttcgttagggttccttcccgcgagctttgcttccctacttctccccaatcctcgttgttacggattttgttcagtcgctgcgtgtttatttccaccgaagaaagttgccgctagtgttgttcctgggcttgattccctgttatatgctactacgaagtagttggcacgcgggtcctcgggttgtgcattttacctaggacgatttcattatcgagaattgatctggtacaaagtttgggggtgtttgattgcacatcgcaaatcattttggatagggcaatcgatgcaagggcgccaacaggacagctagaacttgtgagaaacagtttttgcttttgataaaagtggtagaacagacactgcagtagtaatcttcctcttaaaaacttttgggttggtttcagtattttgggatctgcttaatttccttgtatttctgtttattaatcctatgctattttaatttcaataatggtttgtagtggcttgagaactaatgcacattgaggaaatttccgggagatgagcaatggatgtatgccaaagggtgcacaggtgcaggaagtccaagcgcctggaacttgtgtgtcagtgtgtgaatgcctcaaggtgtgcatactgcatatctattgacatacaacctataattactattattagtaatcattgcatgtacaaagcatgtcatggtcaatatgatcaaacaatatattgtaagcacaagaattaatgtttcttagaattgctttgttagtaatcatgcatgtgcaaagcatgccatggtcaataatatcaaaaaatatattgcatggacaagaattcacgtttctttgaattgcattattagagcatctccaacaatctctctaaatcccactctccaaatatctattttgccaactctatctaatttagctagtcaaacagtcttttactccaacagccttcccattcatcctctctattctgagtctatgacagtagggcccacatgtcagtctctaccactttcttcttcctccccttctctccaaatccccttccctctcccctctgttaccgccgccccatccctattcgcccatcgccaatgctcgggctccgtctgccggtgcccttctagccgagctctcaccggccgcctcgtctccctcaacctcgccgtcgagcaacgccgccaccgccactccctcccatctccaacccacccggcggatgaggcggcggcaggtctccggcgtgcgcggtaacgacgctctagcgcgagtcgacggccggcggggcggcggccgcgggccttcctgctcccttgtgcggcgagacaggtagcggccgtgggtttccggcacgacgaagacaggcggcggtcgcgggggtcctgacgcggcgaaggcaggcggcggccgcagggttccgacatggtgaaggtaggtggcggcggcggggctcccggcgcagcgagtcaagcggcagctaggcttccggcgcggcaaggtaagcagtggcccgggccttctggcgccttgccagccttcctcgttcctccctcgccgtcgagccgccccgtcgccctcgtcatgccgccgatggccgacgccgaagaaggactcatgcgtcgtcaagccgccccgtcgacgacagcaacggcaacctcggggacgacggcagtggatggcgatgactggcgacagcggctggcgacctcgacgatgatggtggcgcttcggcgtgggttcaagatgcacggcgcctgcgtcggtggcagcgtcgaggtcgtggctgcctgcgccattgtagagaagagccgaaggagatggggggggggggggggaatctgtgtgggtctcatggttggccagtgatttttgggctggccaaatttggctagtggaggggggttttgggcagccgcggatggctgcttagccatccggttggagaggctgttggagcttttttttttttttttttttactagaatggctaaaatttggcttggagagtgggatggagagactgttggagatgctcttacagcagtcaaataacattgaaggtacaacgtactctctgaatatttcagttgctttcattgtataaacaataattaactaaatctcttcgtacgcaatgggagaacattatcacactgatgttcctgctgcaaaacaaagagacataacattttagtcttctagtaaaccagaaggaccagaaacggaaaaaaaaagaattcagtttattagtttagaaattcgaactctgatagaatgatattttctaattcatgaaatccaaaaaaatgtacttgacatacaagtcaagattcttgatttttgaaggggtgatacctgttctggaacgaagggggaaaaagggattcattatggcaacagcccacataacttatttctagattctgttatttttcattcctcttcattaggtatatatgatgatatggctgtttttttgtcttacaacacaaggtgagatgcactgcaaaatgccggtgtatagaatgcagaaacggccctggaataaagagtgagtactgtaagctgttatttttgtttcctcgtctcatcacatcataagtgtgtagtgtgtactcaattgattttggagtaacttgggaaggaccccattttgttcttcacccatgtcatttgttttatcttgcctatatttatctgacctgacaaaacaggtgattcaaacactgaaacagatcattgtgatgctagtggcctaacctatgaagaatctatcgtggaaaacaccacacaatatgaggggacttcgaatcgaaacaaacgcccaagaaattttgtaagttctctactcttttacacttcacttacatagtttgccagtagaaactgtaaatgtaatcaataactgcattgcgttaaaaaaattataacatgttcaaacaaaacactgatggtctgctcttctgtgcagtgataacaaccttcagatcgtgttaccttaccatcctcaacctcaagacaatagccactttctgccaaaaatgcaactgtaaacacaatcatcccttgcaaaatctcaaagcacggtaaggccttcatactccatgacccttcaaacctttgcgaaatctcaaagcatggtaagaccttcatactccatggcccttcaaaccttgtcacccactcgatagtctcagtgggttcagttgacgttgcacctgatcaaaaactatggggacagttgtcaccttcggttagtatcaaccatacttttgccgaagaggtatataaacatttcactcatatatgaaatgcttttttttgtcatgcaaaggttatattcttgggtatccagaatctttgaattcttcagtgatgagagagcacaagtagtatgaagtataaacatgattgcaagtacaagtagcctcaacagcattatttttagggaaagtatcaaacaagtactaggtcacatatgcccacttcttacaagtagcagagcacaatactagaagtacactagcacaacgacagcaaaagccaccattaaggtgagcatgttgtattacaagctaccaagccaacattcacctctacatagtaaaacactcttccatgtactgttgcgacttccattagcgtgatctgtcgaggccaagccttgagctgagccatttgccgacatcgtccatctcttcagggatggtatagtggcctagcctgcatcatcatataacttgttaatactgctataattttgggagagtaaaaaaggtgttttgtaatgtgttatgtatgcatatgcatttgtacccattgtaggatttgaaattcagatacaagaaccccgagttacgcagagtgtcgactgatctctcagcattcctgtaggatacaacctcatccactgcaagaacatacagaatttagaacagactgatgcattgactaggagtaataattaactagtaaattatactgtttctggagggaaggcttttcatggatcaacagcttaatgtgttacctcttccatgacttagtaagataggcaaggaggaagctcttcttgcagccatgtgtgagctctccgtcttgctcctcagggtcctagaacaaacattggagtcatgaaaaagtagagacaacgtgtttggattaatatttctgcattattggatatcaaagtggcacctggagcaagggagccagccactcaagctgatgaccgcactgagtgtgattggatatggcatgctattcgcgaatttgccgtgagcgtagcacgctgcggagtggagggcagcagctgcacccatgctgaaaccgccgatcccaagcttcactgcactcgcaaaatatgaaaatcaatggaaggaatgatcaccagggggattctgtagagtcactgaagaacattatcttacttggtgctaattcggtacaaataaggatcactttaaaaagaaaaggaagaaaaaccaattaataggatggtaatatatcttggtagctgcacttaggagtaacatgggtgattagattgaagtggtactggaactagtaccgtcaggtggctctgacgacaacaggtttgcaatatgtgcagctgaagcatccagtccttcaatgtcatcacggccatccactgaaatgtcctccacatcaaaccctatttcagttccatagaaacgttaaccaatcagatttcagacttaagagtaatggtaatgcctcctaagtttgcagattttagagagatggtagcatagtgatgatgaagaagaagctcacacgcagtgcaagggaatccgccgaatgccgtgacaggccgggttgctgcagttgggcaaatccacttgatctacatgacataagctttaaggtgaataaactattttgcagtaagaatcgtttctagttgctgctgaacatgataagctacagtgatctggagacagttacaggcttacagctgttgaaagagaccgttgtgtatcactagtggaataaggaaaatgtatatgtcatgtctatctacatctatcatctgtgtatgcgtgtctgaagtacaaagtatcgatgcttacatttggcaatgaaagagaatccaggagctgggaccagctgaaaagttcagaatgaacaaaacagagaaaagggaaacatatcagtgcactatatcaggaaaagcattgcagctgcaagcaactagtaaagatattctgttccagattctctgaaatttatggattaacacatcatatatatgtataaacagaaaacgtcggctaaaagtatccaagagaaaagagaataggggagagtggagataggaacatctggaactgcaaattggaatatatataagatcaaacagaagaggaaacagaacagtagtgaacaacttttttttttcaacaagttgagcaagttgcctgaatttcatagcttatctgaagggaataaacgattagcttcctttcaaagaagataataataatgtgtaagtagaccagttgttgatcttttcagttactggagataaaggggactaagtggaaaaagaatgagcaatgggtatctgcagctgaggactgagggctgaggttaacttggtaaatgcatggtaccaaacgaaaacgacactcagctagttacttttcattttgtttgcacccggagccagtacttaccattaaaaaaactctactccctccaccccaaaatataagaatctaggactagatgagacattttctagtattacgaatccggacaggctacctgtccggattcgtagtactaggagatgtcccatccgatcttaggttcttatattttgggatggagggagtaatttttaatcgagtgatacttcaatttagtgatttatcataaatatggtgttctttacatgctttgtgcagaccttgggacaggaaattaggcatctttcatgagcgacctacttttatgcaatattcatataccattagcccacatcaattagaagtacttgacattcctctccacttctggatggaaagtgagagcattatctatgtccttggtggcgcagaaggatattaggtgtgttgtgtgaagaaggacaaggaaaacatttactttgggtaaagcaatactaggaatatatgcatgcttggacacacaaaaaggagggcacttcaatcatttctagcagaaagaaacaagggaataaagtgtttgtatccacaattaccatgatctagctctcctcctagcttgctttccaagtatagtttatttgttattcttttgcatttgcagaagatagcattgctcttttttttttcaggaacgcgcaaaaggtagaaggtaccatgcttgaaggagcatgagtaaacaagcaaagtttggaacgaagaggcagtggctgtatatcaagctagccactatataataccttgcaccattgtcacctagaccatggagccacacaatggtggcttggtgccttccctttggcctcactatataggtcctcccatactcgactctccgactgccccatccacctgaatcaaaaatcacatcatgctcagcattgttctttggcacctgtggttatcatgaggacttgaggttagaatggagtagtcagattaccagaagagctgcttccataatagctcatgatgttttctgcaccaagtgctctgtttactgatgctgctaaggtatagaactagttgtgtatgcactgaatttatcgaagagtatgaagtgcacaaccccagttggtctgtatttatagtgaagctctgaagagggaatatatgtcggacaatcccttgaatctgcatcgcaggacagtgcggcttttcgcactgtgctcgctgcaagctgtcatgggatgagcatcttgagtctggaatgctcaagggatgggcaggataaaaaggatttgaggcatttttctctggagctaagaatcctatgcaatgctgacaaaccttgcacacagagatacacacatggtgacagatgcctaaagttcccatgcaagcaaactaaggcgatcgatttatattgcacacagatttatcatgatgcatctttggcagtggagagggaaccataatatataaatgttgtttcctgtcttttttaatctcattttgtgtccaccaagcatttctatgcttattgcatggagtactaatgcccactgccttctgcccacaaattggtgcaactccgtatgggacaaccttagataaaatgcaaggaataatcataaacaaacttattgtccggccattgagcttttcttttgacatctagtttccagttactgctagatggaactgataagttattgctagaggtatcgtgcataaatccgtggactttcagaaagacagaaaacttattccaatggaggaaattcgacgcggaagaaaaagcagaaagaattgttttttgggaatacatagaagaattgtgcatcgttgcactaagattaggagaaagcaaagcaggaagaattatataccacaacttgtgtcggtataccatcacaattacatcgatagaaatatctatcaggtgtcgacaccaaatcaacatggatatgggaaccaaatcaggtagaaatgaaagtccacttgcaggttgcagcatgaacgtggtgcactcttcatgaaggtacagatactaacttgcaacaaatgttcttaccgtgttgctgctacagttaaatcaactgctaaatgcaaacccttgaattagtctaggcgcttattaggaacaccatctgattctttttcttttgtaaaaaaggaaatactccccacatcaataagaagagtacagtggtgaaatacaaatcagaaatgttcctgattttgtgtaaaaagaaattgtctcagccatgatacaatatttcctagtgaaattggtcctgtttacatgtttagctatgtgaatgaatgctactaaaccagtatggaaactataatcttttttttcctcatttgaggtgagtgtgcttttctctaggtttacttgccaataaaggcgggtacctttgccagtatgcttgatgcttttgtaatatggagcacagttgataccttctcaacaatacaaaataaagatgggggtagagaaaatcaaaagtcaactaaaactgacctctaatgaaaaacgtttgcatctcttttttatttaagaaaaaggtttgcctctggggttctactgtgatagccccactacaaacagtaagaaccatatgccattctcctttttgttttttaatgattgggatgggtaatgtggggggcagctcaagccaaaatatgtgatgtatatgtcattcttgtctctatcttagctagcatcagaggtttgaggctgcagcaagctagatgaatctatttcatcagattgggtcattagccacctgatcttgctttctcaactgcaaattataggcctatgattgtgttgtgccctagtactaggagcctgcacattccttcctatgcttatagtccatttctttattgcacatgcttatatgaagagcaatgttttatgtaaagtcagaaaaaaatattctcaaaaaggccatgcacaaaatatgggatttgttgttactaaaaaaggcatacagttaaggaagatatgagaacaggaaaggatatattgtgctttacgtgttctccatttcattcatgcttaactgagtttacataatcggtatgctcactcctgtactactgctgttaagaggaggatacagatggcagtagccaagaattcttgtgactacagttccttgcgatcgggtttcttattgcagattcagttaggtaggatctcctgattcagcacccactaaggtcaattcactgaacaaagcaggcaaatattattcactgtaataagaagtccacatcaacgcttaacagaagtcaacttacaggatgctaagagggaatgttcctacatgaaagatcgcggctgccattaggtgaggaattaatgccttttaaagtactgggtcattctgtatgcttctaactgccttgctttgatctctgctgaaattatttggtaaaatctcatcctctcatttctatttcatactttttttgagataacattttctatctcataccactgatggttcaagtaataatatattttcttaatttttaggtgtgattttccatgtacatgttattctcccatgctcttttaaccttttagacttctgaaaagtactttggaagagagaaaaggttaaaaaaaaagcaaaactgatgttaccatcaccaactcaccatagtgtagaattaatccctttgtcaaccttaggcaatccaaaacaaaaggggatattgtttggttgttggtttgaattttgagatagagcatatataatccatgtcctatgggctagagaatcaaagacttgatattgcaaccttttcacaataactagtgaatgaagtcgcacgttcgcgcgacaataaccttcctatctattaatcgttattgtaattaacaataaaatttccaccattcagttaaatcaataattagatgttaattttctaaaattatttaattagtcatctagtctaaggaccgtttgggttgattggccaagccaagcctgtttgggaggccaacatgagattacaatgagaggcaatgagtggctcaaactcttccttctctatgtattttaccacttctagaagattcctcatttcaatggctaggatttttccttgctattttatcattttgtgaatccaacggctattatttgacggatgatgtggctaattctggttgctttttgagttttacttttcacttagatagatagatatgatcatccataggttaaaatagaaatttccttcatggattgcttactattctgtttttttatggtgctaaccacaatgctatgttctcatcaggaaaatgaaaagagaaagaggctgaacgtaatctgagttactgacttaccaagtggagaatcttccaggacgaagccgtgcaggaagcccaactcgcaattttaatccgatgcagtctggtgcactttgagttggtaaacagttaatcatcatcagggataatcttgtcttgcttgttgtttgccacttttgtcggatgtactacagtagcttcttggtttattttgttttcttgaatacatggagatctgcatattttaatactaataagaagaaaacaatgaggaaaagaaccatgtacaacacacgctaagttccaagaaccatgcgtttattttttcttctgttacacaacatttctagcttgcacttcgatatggaatcgtaagaatggaagagaaacaaagaattcagtttattattttcacttctttcttaattctatatgaatactatagattctattaatacatggattgaaagattacacctagaaatctctcaaccatttccctcataatagaaagggcagaactccagccattctttttcaaaacagaaattaccaacttaccatatagtttcatgactataatatgcaaaacatcactttcggcatcagaagcaattctgttccctggtgcgtgcgttgcacctgtaaaagaatagaatatttatgattgaagcaattgctttctatcgttgttctgtttaaaggaatgtgcatatatgatttgcagcttcagcatccaaaacaagttaatctaccatgtgatcatcttaggctctatttagatctcctggcaaaaattttcaccctgttacatcgaatgtttggacacatatatagagtattaaatataaatgaaaaaataactaattatacagattgcgtgtaaattgcgagacgaatcttttaagcctaattgctccatgatatgacaatgtggtgctacagtaaatatttgctaatgacggattaattaggcttaataaattcgtctcacagtttacagacggattctgtaatttgttttgttattagtctatgtttaatacttcaaatatgtatccgtatatccgatgtgacacgtcaaaactttacaaccctatatctaaacagagccttattgttctcacatgacttgtcttagaagcaagcttgcatgttaatttaatcacttcctgtttgaaggaaactgtgagcaggcataaaagcgaagatgggatatatggaatttatcacatcattcaatcaacatatgggtgctctagaaaacgtgattactagacgagagtttatgtattcattacttgttttttcggttgaagtttttaatttgagcttacatcatcatcccaacatatgtctaaaagacaaactatttaggttggctacataaaacaagtgtactaaaagattgtttctgatgaggacacgattagctcggatataaccatgactaccttatgtattaatcaatcaaaagtgcatataatctatattagatttacttgttatatatttgaataaacgttgctacataatgagttttgtgtgttttcgtttgcagaggtacttgtttgggcgaaagaaaagagaccgagtgtaaggaatgcatagatgattgaagaagttttacacgttttggattcggattcgggccttctgacagcatcaacttcaaatggacctagccgctgatctagaagaaatttcagggcccataagtacttattggaaagcttatggagtctactttcagatgattttggtcccacgtcaaaattcctaccaagctgccaggaatctgcaaaacaagccacgtatctcatctccagtccgaatctgatttgggttttgggccttgtaattgtgtcgtgggcttagcccaagggggtgtgcatcctagggcaaccctaggatgtccctaatcatacttaatcagtagccgtcatcgcctaggacatccctaatcatacttaatcagtagtcgtcatcgtttaaagtagggttttgcttagattaatctgtcaagaacagtttcgccgctagatcggtttgtagaagcccaaattagagtgcttaattattcatatgcaattgtgttgcaatctatcttgttcttgcttgtgttcttcgattcgcatgtagggaaccttctcggcgaggccaaccaggtttcggcacggttgataaccagaggagacgtggtgctgcgattgcagggctcagtagcgtgttcgttcagaaaccggatcgagttgtgtcgcgactccgcccaaatcgactgtttattagtacctatcggaagatcaggacataacaccctcattagtttccatagtactagaaatgtatgttttacactaatacaatttttgggtaaattttataatactacaaatactttgcctaaactatagcaaaactacatagttaagttaagttagtgtatcaaaaactacaaatatcatgaaactaaatattgatgcatctaagctatcatagaactatagattttagagtcacccctagcaagaattatttcaagattttggtaaaatttatgctaaatctgtaattttgcgatactatgcttcaaatatgtagttccatgataaatttggtgctaaatatataattttattatacattgtcttaaatctatcatttagttatagtttagttaaaatatctatagttttgtgaaattcactccattcaataaccaaatgatacttgggagaccataaaaacgaataatatcaagtacaaaagagtatccacccaaatctaagatgttggaaaacatgctcatagttgaaaaagtaaaagaatcagaccattatctctaagatgtggcctataagcttagagttactagcatgtaaaatgtcaagtgcatagcttgaaggaagaggcagctccaataggatgtccaatagtcactcttgaaaatgtggtgcctgattcatcttgcacatagacaaaaatacaatggaaataactgcatcataattttcttctctctagggccgtgttctttttagctactttgccaggttattcctatggatcatttgctccatgcctctaaaggtatttttgtaaagaaaaaaaatatttctaccgcattatatagaccacttgttctaagatatttgtcaagtttatttttttaaaatatttaatttatccatgtaatcaagtagataatccatactaataataaattaaataatctattttaagtagggccttagtacatttaacgctcataagcagagaatataaagcaaacttagattttactagggataataaaaaataaaatacaaaataaactgtacatttataagcaagaaaatgtatattttctgttcttaaactattgacctgagttaattagttttcatttctcacctacaaaacaaagtaaaccccatccataaattctcaaatcatgtaaaactcgtactttatgaatttgatcattgttttgatccatatatatatggtgatgctaaacctgtcatacgaatggtacagccatatgaatatatgaatatatgataattatcatatgaatatatgataatttgtgtaatatataatggagaatgattgtccatagatgagaaagcttgttctctacgacaagcaggttatacgccctatgtagttcaaaatatcaatcaaattggtcgatttatttggttggaaaatgatacaagtacaaacaaattcttacaaaattttttaaaaaactgatgtggtacactatgattgcatcttgacttgaataaatcaaatggctaagatctttgtttggtaaaagttttataagaattttttagtacgtgcagtattaatctatctcattgtactatagttgatggatgggttttaccaggttgtaattgaaggacaatactaccgactagggtgcgttttaaagcttgtttatcatgtttatcgtttaaagcttgtttttcgaaaaaaaaagaaaaaaaaactaactagccaggaccagcgatagatgggcctccctctaaatgggcccagaaagcccactaatcccatcgcattcgccatttcgcctccactgtggcggaaatatctcctccgcttaaacccccacatcgccctagccgccgccttccccttcctacctcgccgccgccgccaccgccgccgccatggccgccgccgccgccgccatccgccgcccgctcctccgctccgtcgccttctcctcctccaggtcccgctccctcctccacctcctctcccgccccctctcctactcctaccccccttccgcctcccccaaccatctccaccacccccaccagcagcagtggcagccatcgcctccgcctccgcctccgccgccgcaaggacctcctccccagtggtctcctcccggaaactaccaccagcagcaggcccctccccctgcgcgccactactacggccccccgcagcatcagcctcgctacaactacggccctccgcagccacaggcgccgccgccgccgcgcaacgactacgggccaccgccgccgccgccgcagcagcagcagcagcagcgggaggctgtggtggggccaggggagctgatcgggctcggacgggaggggcgagtcaaggaggcggtggagaagctcgacaagggggcgcgcgccgacccgcaggccttctacgagctcgccgcggcttgctccaaccccaagctgctcgaggagctcagaaagatccacgacttcttcctccgctcgcccttccgcgccgacctccaggtcaacaacaagatgctcgagatgtacgccaagtgcgccgccatgaaccacgcccgcaggacgttcgaccatatgcctgaccggaacatggactcctggcacatcatgatcgatggctacgcggtgaacgggctcggggacgttgcgctgcagctgttcgaggagatgaagaccaagtatggaattgcaccgaccgcccacactttcacgctcgtgctcaatgcctgtgccaactcggaggccattgaggaggcattcctgtactttgatgccatgtccagggatcatggcattgagcctggtgtggagcactatgttgggatcattgaggttttggggaagtcggggcatctcaacgaggctgtggagtacatcgagaagcttccgtttgagcccactgacacggtgtgggaatcgctcttgaaccttgcgcgcatgaatggagacattgaccttgaggatagggcagaggagttgctggtctcgctcgatccaaccaaagttaatcctaagaagctccctactccacctccgaagaggcgccttgggattaatatgcttgatgggaggaacaagctggtagagtacaggttgccgcccaagatcgaaaagaaggtggtgaacgaacagcggtatgtcccagacacaaggtatgttctccatgacattgatcaggaggcaaaggagcaggcactgctgtaccatagtgagaggctagcgattgcctatggtttgattagcaccccagcaaggactccacttcgcatcattaagaacctcaggatctgtggagactgccacaatgctatcaagatcatgtcgaggattgtagggagagagcttatcgtaagagataataagcgcttccaccatttcaaggatgggaagtgctcttgtggtgattattggtgaacatggcttttgttcagctgaatacaatggtctgaaattgccaatacgatgtattgagcacttcttttttcttattattaggattgcagccatcctatatgaatatatgctggcagccatgcttttagcgcataaacaatatccagttatctgatggtagtgttagtactcctgttatccatctcattatgatcatgaagatgaatgtgatgcttttattcttgatggcctattttttttcagagcttttgatgaggtttcttactaacatgttagtcctattttggggaaatgtttacattgcattgatgataagagaggtttcctgcaatttcataaagagtatgtgttgttggatattggtgtattatgctgtacgctaatttaaatctttgaagatatctcttaaatttcctttcaatacagatataggaaacatatggaattactagcctagagcctgtgcgttgcaacggaaaacaatttgagtttctatcttgttaaattaatcaataaacacttatttagtccaggtaatactatgattttccttattaaacaagtaggcgattttgaaatttgggaagagccaatagtgaaacgggagaggactcattgaaaagatggtgtaacagtatagattgtggggccaacatttcagtggtaagggtggtgtgggaatcggcaccaccactactaacatttgaagtagcatagaatagtttattttattgttaactgttgtcctttgttcttaatcttgcttttcatcttccttgactaatcaaaccggatgtgttttactggacatgttgcaaatgtgtgttctattcatccacaaggactgcaattataaatttatttttcgtcaatttgttctcaaatagttctttttacatttcttttgctattccttttgattttgctatatgaggattattttgttgcgactctttattgatcttacacatctgaattcaaaatgttatttattttccatattgaactgttcttctatcactcttcagcttatggatcataatgtcctgtcaattttatcaaattcttccatcatgaattcatatgattcattggccattgaaccccttattgcaaatcttcttgatagaatattaaatctgattgattctggtatggctccatcaaaaaatttcacctgtgatttcttgtctctccatccatcttatataacttttcatgtgtcttgttatgtcgaggtccaggagaagttccagattgtggggacatagaattctgtgtttctagaacaaagcacatatgcaggtgaaatcttcattatctaggcctacgatgacaaagtgtagtactttctgtatctgaattatttctgtctgcttcaatgcttaaaatacttgctaactttgaaattctctatttcattgacctgcaatctttgcatgtgtgaatatttttgcattattgaatcacactgctttatccattgtctatctgaccaaagatcagttattttttaacttctttattcttgagttgtggttgccattctgtttctatttcttataatagtgtatcattttgtcataccatgtcaatgctgttatactgtaacgtgatattactcaagaagcgtgccatatgtagtgtggtgtggtccaacgtttctcttggaccttgcattaatttcttcacaagtattttaaaaaaaggtctacaaggctgcatacaaggaacggatgccaaaccttataccgcttaagccgcataagtggtcgattacactgcataagcatctgattatgccgcataagcgctacaaggtggggtgaccacacataaactacatgctattttgaacattgcttcgtataaagttgtattttgtgtaaaagaacagaagtgtctctggtaaactacatgttattgaggaaattgatattttgcggctcaaatcttgtaatattgtcatattcatcatatgatccttttttcttcttgaaaaatgttccagatttatttaaagcattttgcgagatatgaaagttgtttctgtatattgtgtttgaaaagatttttgctatagctggtttccttattatatcggccctctcctgtttattcttaccctgtaacaatttggatttaggaaacctggttgtgtggttaggctgtgaaattcattgtatttgagaaagatctgctagaattgtgattggttgttttcctgatgctggcttcataaatgcctggaaaaatccattcaaatgtttcagaaaaacacatcccgaaatgaatgtttttctgttttcattagctgtaattccatcaaaggtgcaaaggtgcaaaggtacattatttatttttctggaagcattgtgtcacacgaacacaatccccatattttcatagcagtctcttgatcttccataagtttatgttcctttctgttctccaaaccaaattcatataaaccctgggtcattgtcttgaactcttggcctggacactccccacttaggagcttagctcctgtgggtgcgcatcgcatcggcaatgttttttttctctttttttttttcgggagtgttcatttgtgaagtgctctgctgtacatactttctcttctctttagtaaaatgaaatgcatatggctcttgcgtttttgagaattttttttcttgctttcttctggaactatctagaactcgcatcattgctggaagtttctctgtgaattgacgttttgacattgctcataccctttttagtgtatggtaaagatgtgagtctctcagggcagacagaattggaccctgtagacgtcagtaatctaccacaccattgcttgaactaacttattctttctttgtatatgatactcttccaatgttcttatcagcagtttttcctctgttgacaagtagttatgacttatgagatctgagaaatcttttttctcctgttctggttagttccgtgttatcctctaagtccagccatgtaatttaccatctcttgtaattttcttcctcactatcatgacacagacacttttaactacctcatttatgtacctttccgaaacaactcagtagatctgacattgattcagaatttgttttccattgtccgttgcatctgaatgttactttggtgacttccctgtttcttttctttagcattatttccttttcacacttcccttagtcagaattcaagaaggtttttgtatcttctgttagcttttggtcactcttgccagcttctgaaatttgattctaaccagtcctgattctgttccactgctagtctgctatcttgatttggatatgcataatttgttgcttgtattggattagtcttgattttcgtcgaacaaccttagttcctgcaattaatatagtatattggatgttatggaattttctacctagtctttttgtatatgagtcatcattttcaatctcctgacaattacaatgatataacaacatatatatgttactgctcccttttattatattgctgttggaacatttttgtgaatcttctacgtattgcatacctgaataattcttttgaggaagaaattgtgttgcttaatttggaaatggctttccaaacttgtttctgtttcagtgaaacacaataaacaaaggcaaaagtccattttacaccctcaaaccggtaagcttgtctacaatacacacccgaattactactaatacacttgaatagggatggcaatcgggcgcgacgggcacgggtaatgtctacccatacccgtgcccgtgagattatttttgcccgcggacatacccattactacatgacggacaataattgctgcccatgcccaccacccgcggacatcacatgcccgcttacccgccacaactagaacagtgcaacaaaatttcacaagtttagcaagttctccacctcggtgttgtgtcctcttacaacgatggagtaaggggaagagaaaaaagggagataaaaaagaaaccgtagaaaacaaagaagatgagttatatatcctagtggattttactcatggcccacatgtcagttagatttcacgggtaaacgggcaaagcgggcatgggtagtcatttcccatgcccgtgctcgtttacccatagggtacagtttttgacccaataagaaacccatgggtaaaaatggagaacatacctaatcctaataggatttttacccacaggttaatgggcaagaactattaatatcggacacttaacacccccaggctgtttttatcgtggtttttgatatgccggatgccacgtcagcctttgccgcgtcaatgcataggattatatgggccaagcccatattggctcgatctgttttgacctagcctagcattctcatgagcaggctgcgatggcagggttgcgcggaggcttgctgggagcggtggcactgggaagaagcatctctgataggctgcgcgctgtcgctggtggaagcctatgcgcgtcgccgcacgtgcccttggagatggctgagcagagaagaagcaactccacgtggggcggaagcaacgacgagctagtggaatgttcagccgacgaaacaagcaaatcgaggggcacgagcacctatggaaatggcagcatatccagtcaaggtagaagcgtgcctgttcgtctgccacttcagagaaccatgaatagggggagagagagagcatgtgtgtgagagatagaacctcgacccatacacacttgagccaatactgtgcgctgatgttggcgtgtcaaaaaccactgtaaaacctgccagtttggggagggggggtgttggtggtggttaagtgtctggtatcgacagatcgaggatgcagtacggtttcatagtttaggggtgtattttagacaaccgtaagagttcaagtgtgtaaaatggacttttcccataaataaatactagcactgttcaatgagttgagtagtacgaaccaattccgaccattgtactctttggctgagttcggcccgagttgaaaactcatcccacgcatacaaaacggaatgagtcattagtacatgattaattaagtattatttttttaaaaaaggatcaatacgacatttttaaaacaaattgcttatagaattatttaaaaaaattataacgtttagcagtttcaaaagtgtgcgtatggaaaatgataaagaggagttgggaaatatggctgccgaacacagcctttgtgtgtgttttgatgtgtactagtacttctaactatgagcagattccgttaaaattagtacagcctgaaagcaagttcgtaatcatcttaagttacatgatgcatttcagaattaattggcttgaatgttccttatatgcacaaacatgtagtccgcacatttttctgtattatactttattgaagagtaatttttttttaaaaaagtttttgggcattcgtgacataaaatccttgttattacattttgtttcaacatgtatatgaattcaaagacatttcatactgttctttttatgattattatacataaatatatgtgaggcaaaggaatggtataatcttgctccttgggttttactaaacatttttgtcccaatatatgggattgcttggaactaatcacaataccatggcttttacattatggagcccctaaaacttagggatttgaaaaaaaatgatgtaatattttctgaatgaacatgattgaaggattgatgtataattaggttttgccccattttatagatttggaagtgtttttgggaagaaacgtacatcaactcaattttggattttggaacatgattgaagaattttggatgccattaatgaacgaagatgttctcatccttatggatgtttttttttttcctatggtagatcaccttatttaccacagtgggcattagacatcgtggacaatatccagcatttactactacttgatattgagatccaccctactactaagagcatgtacaatagcatgctataagctaattataaacatattttaaatagataaatgaagatagagaagagcagcgggttacaaatccgtagccaactacagcacggactccaagacgtaatgtgtgtatgacatgtgggattagatattaatagtatagtaagcaactattgtatgaattaactattacattggctgtagatgatttggagctagttgtgggctatactattaaacttgctctaagttgcaaaagttacattgtggttgctctccttgcggtgttcttcagtaaagagcacaaagtttgaggatactgtagcaaattttatcaaaataattattcccctgtccgttaaaaacttcaaaatgaaacactctatcctatttttaacaaatgataaaatggtaaaacaaagtcccaagctcgtgcgtgcactcacgtttttttcaataaccatgacacatgctgttgtggtgctattcgaatcatgaacatctcgaatattttcatatataaaaaatgtcaccaccaaatataattgaacaaacaactcgctttacctgcaagaaccgaaccaaacacgtcggtatcatcgtgttcgtgtaggatataaatataaacacaacaaaaatgatgtaaatatatatgtgaacacaacaaaaggttttgaacgatgaagacttaaccgaaactacaaaaatatattttgatcttgacaaatttgtagatgatttaacattatttgtttttaactatacgcgtcccacacaagctcatcataaaagtactccctaatacacgctcacaaagaacaaccacaaatctttggtcttcgctaaaaaagctatgggcgcataatatctatggacattattatttaaaccttaaagggagcagtaatacaaccacgatttcaccgctgttctaccggtattaatttcctgatttaacaccttattttagttcataattacttagggactagggtttgcattttcgatttcagccaaaatttcggtagcaccaaaatagaaatttcgtgatttttggcacttgtcggaccaaaattagttgaagtacttttacatgttttgactggatttgaataaaacttgaccaaattcaacaaacatttggtaaaatccaaaaatttgggtcgatatatttgaacatgcacagatgtagcctaagggggggactcaaaaacaaatcacagcggtaaaattcaacaggcctggaatctcctggtgtagaacaccggaacttccggtatgttcagacagtccggaacttccggtgttcttggaccggaaaacagacgaaattcaaatttcacttccagaaatttagccaattctcaaaagtagaaacacacaggtgaacagaaaagcaataggatcacagatacaagcatagaaacatcacagaaatggacaaggaggatatttttttcccgaagttcggatctcgcgatctactctccgttgaggagctccaaagagttgggggtatcaattaaccccttgcctcacttgtgcaaaaatcttagaggaaatccacagccttcaaccccaacacctctaggtaattttctagaattgagtgaccacctagatccaacttaacctacttctagaaaacaccataagtgtgagttgctctattaggaaaaccactaggactttagcataagattctttactcacttacctcgttcccttacggaggtgaggaaaatattcacaagctttcccgggaaatccacaattgcaaaggaagctcgcgggtgacacctaaccatctaggagatgatctccaagagtaataagcaccgagatgtcagcccacaagataccccaagtgctcacaccaatcctagccttcacaccttctccaaatcttctccttcaccctcaaaatctcactctctcacaagaatggctcaaaattgggcggaggaggcaaagaaacacctgggagaggctagcaacagttatggaatggaaaagcaaaagtgaaatggccaaagggtgagctggggacgattgggatatatataacggctaggtgacgtcatctagccattactcacatttttgaactggaaacaggtccgaaacttcctgtcctccggaagttccggataacacttagctaggtaaatttcaccattcatcgatccggaacttccgggtccaaaggaccagaacttccggccgagcagatctgtcctgggcagagctattctcaaaaatattttgacacttggatctcactaagagcacttattgtatcccagaaccacacttggaacccctcttaatagtacttttttcctaaaacccgattgcaaaaagtaaactagcctatgcacacttcgagttccattcgttgtggggggtctccaagcatctcttgaccacacaatgacatcttgggactaaagcacctgagtatagctcaataaaactcattagtcccataaccacattgttattaatcaccaaaacccactagggggataaatgcaccttcaattttgatttgccagtggggtatgaaattaccggaattgcaatcactgttagggacaagcaccgaattgtagtcctgtccacttacctaataatgtaacatacccaaaatttaatcaaatttggaaatacaattgctcctgaaatttttaaagagtttttcctttgaaaggtttggtcaataagaaaaaaatgccgaagtaattaaaccaagtaggaatatcttcagattcaaataacagccccaagtaactatataaattataacaagctaggatgctaaggaagacaaattgtgtcaaacaacattttaattgtcatgactgaatatgtggtgaaatatttgctgcaatcggtcccaagccttgagtgctaagagcgtgtaggttggtttgatctacaacaaacaagagaaaatagaaaacataattagatgaacgatagccgatcggccgatagggccgatgacgtatcatcaggacccagccgatcaatctaacttgatgcatttttataaagaaattcgatcatataagtggcaaatatacataaacagatcatgaaacatgcgctatcatgcatattaggtaatatcggctgaaaccctgatgctatccttaattatggttaactccaggtcagtttttatgattctaaatatggctagggatgatgcatcacaaagtatataaagaagcataaagtttaaacaatcaagaagttaatcactttttaggatggtagatatcttagttaatctaatctagtaagacgatttagctgataccaacataaaccctaaaacgagtatcaaccgataggactaaatcgagatactaacactatattaactaggatatatgatagcaatgactacgataaaatgactaatacatctaaaatgacatagtagcccagacaacgcaagtcatcgagacaagttacctcttgtcgagagatcgcagccgatgcgctgactcgaagcaagaactcgtcgaaaagtaaagcaaaaaggatggcgatgcgccgaaagttgtattgattggattcaatcccttattacaatgatttggggcttatatttataccccgagtacaaaacctgtccattatggacgtgattcaaaactttgctaaagataaaatttgaacaagtccacatggctgactattaccatatctctaattcaaaccggtataaatatcctaattaatagataaaattaccttaaattagctcaatctctatacgacaatatcagttattccaatctaggcccaacccgagcctaaatcaatccgtattggctatctggcatatcggctaaggctctgttcgggagtgagggttgggaaccctcagtctccggcacgtaaaacgaagcagcgtttagtacgtgattaattaagttttatctttttttttaaaaaatggatcaatatgattctttaaagtaactttcgtatataaactttttttaaaaaacataccgtttagcagtttgaaaagcgtgcgggcggaaaacgacaaggaggagttgggaactactcctaacgaacgtagcctaagtctgtttccatctctattttcagttgatacgatgtccagccgatgcacagcctatctcctaatccagttcgattccgcaccaaatctgcctcgatttgttcctcctccgagtatgatgcaaaattctgttgttaacaaggtgccgattttttagtagattgacacctgtaaaaaccaagccgtgagcattgaggagcagaaaaggagaggagccgttacctctctctctctcacgcacctctctctttctcgagaggcagtggcagcagcgccttccctgtctctgccagatccgatgggaggggaggtattggcagcagtggcggcgccctctcctccactagatccggccggaggagaggcggcgacaacggcgggctctccacgggcagcggcggtgggctacgcacgggcgatggtggctcttccctccgccagatccggtgggaggggaggcggcaggatacccacaggcgacgacaactctaccctctgccagatccggtgggaggggagacggcaggctacccacaggtgacgacaactctcctctccgccagatcttgcgggaggggaggccgcaggtttaccacggtgtggctcccctcctctctctctcccctggcatcccaccggcggctctcctcctctccaccgcagtggggtgctgccttctccgctattaccgcccgtggtctgctctttgccactagctgctgtgacgcggctagatcgacgacggcgatggtgggcatgtgtttgtgtttgcaattttcttcatttttgtggctgtgtttggatgatttctgtgatgattttgattgtgtttggttgatggggatgatgctgatatcatcgatgatggagagctgcccccacactactacacaaaatattttcctggacaccgaacccttttgttttcaggcgggttgtaagtgaaactgcacgggaaaatagggagactggcgccgggccgtcgcccgcacgggaaaactcattttcccatgcgggcgttttaatccgaccacataggataatccccattatcctgtgcggtcgacttaagaggaccgcacggaaaaatcgattttcacgtgcggacctcttaagtggaccacacgggaaaatacattccttcttttccctcacacccacttcaaatttttcacactctctctctccactcttttccctctcacccacttccaatttttcacacaatctctcttccttttctttttattctctcccacacgcctctttcctctcctcccctctctcatgttctctctctgccactttcctctcctcacatccccctctcctctctctctctgcctcccactgagcgcacgggcgtcatgacgacggcgatgacgagtggcggcgcgatgatgagcggcagcgcgacgacgacggcgcgaggacgacgactgctggcggaggcggagcgatcggccagcctttttcttcttttcgtcatggttttgcaaactttgtgttgcgtcgcacagtggatcggctggttgccgtttctttgctcgagaaatggtagctttgggattaggatcgagaaaggctagctatgcgctcaggtacggctgcctgtgcggggttggacactggactaaagagagacgacggcgatccgatcggattttttcgattttattttttttgtccgttttttttccatgcgggtggtataacttaaccgtacgggataatcgacttaatatgaccgcctgggaaaatcgattataccgtgcggtcatgttaagtcaaccgcacgggataatcgattatcccgtgcggtcagcccgcccgcacgtgaaaatgccaatttcccagacacgcggctgtagacgggccgaaccaccgtaccagataatcaaaacgtccgcacggaaaaatagggtatgtagtagtgccaccatcgccgatgcatcgagccaatatatatatttttaatttatggagcctcaaaagtgctagttcctaaatcggcacctgtttttcatctacatcaatgccgccttctaggtgccggttgggaaatccgacatctttgttggtttgcagctagcacgaatgatagtttctgctgttgtgatgggtctttaacaactctagggagatcgatttttgtaggtgaaagcaattatgatccacctgcaacatagaaaatcaattccgtagtagtttttaggccatccctaacccagaaactatcaagtagtttctatacttgccatgtcatatagacactatgtgtaaaaactatgtattcaatggatggtgtcttcaaattaaattctcatccaatcacttctcttctctcttcttttatccatccattttcttgtttttattcttggttcttgtgtagagatggtttctttattttttttacctctctactcattaactctcttaccacataggattttcgtttatgtggtaatatatttaatgctatagaaactagataataggtaggattcgggatggccttatttcctctcggaaccgcgtgatcaattcagctcgctgtaactttagcactgcaaattgatatacgggactgcaaattgaactttatatgctcgggacattacatggactcgtcgccaactcgtaacctataaataacttaatctaaagcaatcctgtcgatcatatgacatgtaaggcacacgaacgtacgtacgtatatatagtacagggctgggacaagaaagcatccaataatctacatcttatgctgagaagctacggattcaacgagcgagtgctagcgtacgtaagcatgcatgttttcttctactactacttaattaaatcagcattatctaaaaatatatatctgtatcaaaggatgcaagttaaatagactctttcatgactacggttaattatcgcagtcctcactcaacaaaagagtcatatatcatccgatcaatcatggatgtgtcgtaaattaattaaccacactttatttaatgaattaagtctttcatctatcaaactacactatttaacggagaaacattgcgtcttaagactgatcacatgactacaaaatttcatcgtatgccgataagtactgataaactattttatctgcaagattaagttaatgctgacccatgtgattacgttcgtacgtgagctagaaattaaaaaagcagagagaccagcattcttacaaagagtgtttaaacgctctctatctgcatacggtagcccctatataaacaaaccagttgtcgtccagcaataacgaacatcaaccaacacacaagaaaaaccaccagagcctctcttcatgcagatggcgccttccaagagcatcctcgtcgtcgtcttcgccctcttcgccgtcgccgcctcgctgcctccgtcggcggccgccagggacgcccaggtgttcaagcccaccgtcgccgtcgatgtcgtgcatcaggaacaacaacaacaacaacaacctgcagtgaacgccattgccgacgtcagccagccatctacatctctggttggattgccagggctcccgccactgccacctcttccgacgatccaaatcccaggactcccgccattgccgcaacttccgacgatccaaatcccagggctcccgccattgcaaccacttccagcaatccaaatcccggggctcccgccattgccgcaacttccgacgatccaaatcccggggctcccgacattgcaaccgcttccgaccatccaaatcccagggctcccgccattgccgcaacttccgacgatccagatccctgggctcccgccattgcaaccacttccagcaatccaaatcccggggctcccgccat

SEQ ID NO: 58196 - DNA, 852 bp, Oryza sativa
tttgcattttctgaccagaatgtatagagtcaaaaattcacccctttcgagtttgatccatcgccattagcttcatcagtaaaagcatttgaaagcccaagctctgcattgatctcatcatctgtcttctcttgtggtatagagcaattggcaaatgtcttatcttcgttttccttacaagtcctttgtataaacaagaaaggaaaatgagttgtaatttattaaccattcaacagataaagaaaaaattcaaaatgagtaggcaaacacatctgaaatgacatctacatcaaaaagatcaataatattaaaccaaatggaagaattaaaatatatattttcaatgtagcggagccacatgttggtaataaggttaatctttgccctctcaaacttcacaaacacaggtcatttttcacttttcagtctccaatgcaatattgcccatgtttttcattacaatatagtacatggaaactgtctgttatgaaagtattatgcaagacaaatcccatgacatcacctctcaagtcaaacgatatgcttctacatatatacattaatagtctacatgaatcccgtggaaagtatgagcataaatgaaaaaggcccatgaaatacgaatattttaaggaatggaatgcaatagatatctgtagttacactgtagaattgaacagcctctgtttgcacaggaaatactaatatgaaatattgaacatgggcacatctaacatgcaagaagcacctttcttcctctgggtaactggctggctgctagccaactgccaaaatgatagagcacaaacaaatgcaaaatgtaagatttactctacagattatctaaatata

SEQ ID NO: 58197 - DNA, 3812 bp, Oryza sativa
attacctccaaaaaatgcatcgtcgcccatgaattctccaaaaggatcatccccaccgacaccgctgttggtggcgaaggcgctccactgcacctgcttgacggcggtatggacgtcctttgcggagcccggcgaggcggcctctgggtttggtggcagtgtggcggcgggggccttaacctccagctgaggaggaggaggggcctcgggttccgcattaggaggagggggcgccggggcggtgtgaggctgaggtggaggaggaggcgcggcctggtccggctccggtcgagaaggcggcggcgtgaggtcggaggcgaggcgacggttggtatcggcgtcatcgtcgtcgacgagcttgtcgaagaaatcggcgtcggcgtcgtccgaatcggaagcggaggccatcgttagggtttggggcagatgggagggaggggggcgggcggagaggtggatgaggttagggctagggtttggtatagtttaggagagggatctgatcgatcgattcgatctcgaattcgtcgtctactagagactagacttgaatgaatgcgatgcggagaagagaagagaagagcggaggaggaggaagacgacgacgacgacgcgtgctcctcctctcctagctactcaccccgccccagtattattattccatacgccctactactagtgcttgttgtatttcctcttttctttttcatcaacagccgacatggatatattttccagactccactaaaatatactaccaccttttatttttcttttatcctttaaaaaataccacgagtagtaactttttttttgttttcaaagtagtatgaaaagtgcgtatgatttagattatggaaaattgtctctattgtcaacgatggagatggcaaaggcctgagtgagcgtcgtatcatcaccattaaacttaataattgctgcgattcgattttgtttggacgatcacataccactccagctccagtggtggaaggtggcactttgacacccacctacattgtgatgatgcatcatgcacagtagagacaaattaattcgtcatcaacagtcctaatctcatccagatttggtctaactccttttttttctttcctcatgtaggggtactgtagtgtactctatcttcttccgcactcaaaagtatgtgctgacgtttgctacaaacaaatactaccttttgtactagacacagatacacctagagaaagaaaaaaaaaagagctactgctactattttgcaattacatctaatacgtacatacttacaagaattacaagagaaaaagaaaaggtgggttgttaattaggataaaagagccttctcaacatcgccaccttccaaatgaataatactatgaccttccttgctcttcgcccacaagacgatgtagagcccacagaacatgagcaccatccctgccaagctgtatcacgcatgttatgtaatgtacccacaggattatcattattgatacctttcagatccacgttattatgtatacataaacgaatcagcatatctatatgtatcataatgacagttgtattactattgttgttgttacagtcaaatgtaccatatatgtatttttttttcttttgccaaagcccagaaggtagcatgtgattccagtgaatatgcatatatagttgttcttaatttactatttcttttgggatcatgttaggtttatataatagactaaacacacgaggttaagtatgaaagtgcagtcgaatctctacattttctttttataaagaccataaaaacaaagaagataaaggaatcaattgaagagataattaaaggtaccttccgaggcagagcaactgggagaagagaagagcagagaggagggcagaacagacggtctgcacagggccaaagatagagacgagcagaggtcctcttttcccgatgcaccatgtctgaaacaccacgcatccgcccaccacccctcctccctttgcattttcaatttcatcatcatatgcgtccgtcagtcagtacacatcaccactaattgctcctactaatgtaaatggagcagcagaagatcgaggaaaaggtatgtaccatcaggacgatcgttgagatgatggtttcatcgattctcggcgagcccatgtcgatcttgccgtccacgatgaactgcaggatcgcggtgaagacggcgcccatcatcgatgttacgctgcacatcgtcaatggcgcagggaagctcaccaacgtcgctgcctgaataataccatgagtatatattgttgcaagtttcagtaatccatgagcagctagctaacaatgaaactacatgcatgtatgtagagtgagtgaattagtagtaattgatgattacctggagcaccgtgtagatagagagaacaactactgccaggaaaaggtagaagcaaccaaggatccagtcatagtaactagttgttgtgagttgtggagaagacgaaacgggactctgcaagaagctcatggccatagctcccaccaagcacaccaacgttcccagtatcttggctcttgtgtacttgcatcccttgtcaaacttctccaaccttaagtatatgtaataattcaggtaaatgtatatatcttaggtaggtcatcaattgcagcttcatctataagcagctactactatacctgaaacaagccgcaatgatgaagatgagtccagggctcaagtttggcatggctgatgcgatagctggtgttgtcttctttattcccagaagcatcagttcttgaaacaccgttgttctgaaggttattcattggatacaaaggctaaagcattaaaaaaaattataccatgcatgtgtatggcaaataatctcccaaatagattattcctaagtatatgtgtttttgccattcaaaagatgtgtgtgtatttaatacgtggtccttggggaggtatcacaagcctagtactaactgagacatcatcaggtcgtctatctgaagaactaatgtatgctgctgcgtgcactcaacaacttgcccctgctaaatgactggtagaatcagtatatgcatggttattagaattgcaaatgcacttgccattttgaggcttttagtacgttaaggatcgagaaaggtaacggttttcagtgcagatcaatcactttgtgccacatatttatagctggctaaacttgagccaattagcacgagcttctcggactgttttgctaatactagtatttagaaatatggttgaaataaaaaatcatcagcagttaatgtataaatcttaccctccaagagctatgaacacgaattgcgccatgagagtgcgagaaatcttggaaggccatttcttcctgacacagacaaaccaaacattgcattacttacattcaggcaggcaggcggacagaaatgcatctcatcaacttcaatatatatgtggagaaactactagctaatgagtagttaatcaagagagaattgaattaaaataagtaatggtggccggagtacctctcgaggacgacggcgaagggaaggaagaagagggaggaggcgacggcgccgaggacgatgagggacagcgggttggctccaaggctgaggacatggtccacgaacaccacgtatccggcgaggatgcactgcaccaccagcaacccacccacgatcaccccctcctccactttcgatgaccatcctccgccgctcgcaccttgcaccattgcacccaatctcttcttcttcttcttcttcttcttcttggaagaaatatatacgctcgtactacaggatcaat

SEQ ID NO: 58198 - DNA, 716 bp, Oryza sativa
agctcggtacccacttgacttgggccggcttgggctgcacagcacgcgcgcgagggagagagaagaggaaggaatgggccgaaaagggcccaagctgaggaggatgatttttattacttttccaattaaaataatcacttaaatgatctttcaattgttaaaaatacttcctatgctcaaataattccaagaaaaatcttgaaaatacttggacactcaaagtacttaaaaaaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctgataataatttattaaataatttataaatcctgaaacgaaaatcagggtgtgacaggagccccggggagtgtttttataggcctcggggtgcggcatgaggcaggaaatggcagaaattgccggcgaagtgggggcggcgatgtcggggtggtggtggctgattttagggggacaagtgggaagggcaatggccgcgggatgggcgcgaggtagaggacaggggcggcaaccggcccacgcaagagagagg

SEQ ID NO: 58199 - DNA, 747 bp, Oryza sativa
ttagaaccgcataaccttgaaattctgaagctcttttccagactgcctgtcatgggaaaaatctgatcctccaattttttttgcatactctggatgaaggttggaacttgatacagctgcaacaggaagtcgctataataggcaatacatgtagaggaagaaaataccattttcattacaaatgtttcactaagaccaaaatattctgtgttgaagcactagaaaactggcgagtgatgcccaaatatttgtatgacgaaaggaagttcctttttctttctgaacaacaaaagtttattgagacatcagaaaggaataaagagagaacacatactatcttcctttacaagagaggagcaagtgctggatgagaagtgacgaacaacagtcccacgctcgcatccgaggatagcatgcgctcttcgcaactgtgtgagtagattgtgcaggcaactatgagcatatgcaaaccatatatgtataataacagaatgaatgttcatagacgaaatgcaagcatatataatcctgttgtgtttgacataaatgataaaaaccagaggcccatgaagatagagcaagccagacatgcgctttggtgtaattccacaatgacctagatcgatttgtacatgatagcagttgagtaagatgaatagaatgggtttaaaagtagcggcgtgattaccgagagaggatttgtgcaactctgaaaaaaaaaaggggacattttgaacagttgaaaca

SEQ ID NO: 58200 - DNA, 2744 bp, Oryza sativa
aagcaagatagtgaaattacagctcgaaatggttaaatatttctccaaaatgatttcacgcccgtttggttgccacggcacgggcatctcgtttttttccctgcacaatcgtatcaacgcccgcctttcgtgggggcaccatcaaccgagacacatccttcaaaatgttattgcttgaaaggcgaactaatgttgcaagaacaatgttgtcgccaaaattcaaagaactagctgaagataaccatccacaaatatttacggattatattcacaaaacttcatctgattatttacaggcaatgctgaatgctcatgctgaaaaaatgctggatgtagctcataaaccagcagagcgtgccagctgtgcccaaaaagatttcaagactgccaaactcgtatgtacatgatttccttttctccgcttatatatatttcacggtttaactaaacaaccacaggaataaacatgtgaacgaaaacgttatttcccatgttcatttcttttcatagcaacaatcttcttggtgtagaatatccatcctataacataagacaatgtcctccatcctctatacgccttgggcttagatatcgttgcaatgaagcctttcaatgcagctccaaggtcttgtgtgtcaaaggatacagatggatctgaacaacgatagtaatcttcactgaatgaggggtgactggtgcaatcctcataaaccaaagaatttgagaacttgtccactgtctgtgatacttgcggtggtgcatggccaccaagtgggggtaactctgactgatattgattttcattgttttctgcagtttccaatggacaaggatccaatgcactcgagggatcaattgagaaaatgtcaggtgatggtatgcttgactggctcaaaccaaacccatcggtaaaaacttgtgtagaaaactggtcatagtcattttcatgcaatgacgtagttctcacatcaaggagctgtgaaggatttgccagaagtgtttcattgtcacaggtgaagacattcttccaattttcatacgcttgcttcacagctgcatatgcttcagcctataaagagcaaaagttaaggtaaaaaaaagatggtccatatcctaactggtgaaggggaaatatacaagaaccttctataactaactaagtcgaataaaaaattgtgaataccttctccttttctctaagatcatcagcacaaacaaacttctcagatattaaccctctcacttctccaacaacattgaacacgactgctgttttgcttaggctgtctggatagtacaaatgcaccttgtcagggagaatacaggtttttgaatgctcaacttgtgacctcccacatctttgttgacatgccactgcccaatatctgcataatttgagcataaggtcacatatccacacattttgctgaacggccactatcatctacaaattcaggcaaaaagatagaaatatgacatatgcttactgaggaaaaaactagcttagattagcataacgatgtttaccacagaaaaacaatagattcactcaaatgtaagaaacatacagtttcatggttatacatttctcaacataacaaaataatgctgacaaccataacagtaacttctcaagctggccagtcttcccctacctgattagtccacatggacctacaaaatgctgacacgtggaacaaagagaagatgcagcctacagctagccagctagctacgctctgctttcctggttacaatcctctagatacttccaagctcatagaagtatagtcaataaattaaattaagaacacctcaatccttcggatgatctcaaaagttattacccctagaataaacattcacagagaaacacaaaactacacaaaatttaggaaaaactaggagaaataccataaattggaaaataaataattacatgttatagtggaaaaaaaatagctgtcaaaagaaataatagggccaagactttcttttgagaaaaacaatcaacaattcaagtctagagcccagatgcttttgagcgggtttttgaaactggagctcaaaaaataaatagagaaaacaatggaaaatcaaaatgtaaaaaaacagatctctaaaattgaagctcccaaaaaaaagagagaacacaactggaaatcaaaatatatataaaaaatagagaaccaaactcaaaatcaaaatgtaaaagaaaaagaaagcacccaacggatatcagttgcactgtatcgctctgacgatttccgatgctagatatggtcgattgattatgataattattgaaaatccaacagctcacaaacaaaattttccaatttatgaaagctggtaatttcttactgaacatgcatttttaaataacaagtaggtaacataataaggcatatattactattgtacttcaactctcaaactttgataaaaacaaaattaaagagcgtattatagggttattttcaaatattgttgggattttacaataattaaattaattatgtaaatacttgcaaaatattttgatcatgtcacggctataaattttgaagcacgccaatacgtgctgatgattttctagtttgatgtacatcagtacattatatgtaaatattcgatagaaagaattgcaacaataggcagattgtgtaaactcaaaaaaagaatgcaaaatacaaacatagaaagattcttttatctttgaacaaatgcgagtgatgagctac

SEQ ID NO: 58201 - DNA, 9742 bp, Oryza sativa
attgccaccactgccatcaattcctatcactcttggatcaccaggagcacaaatccccataaactcccagagcgcactgtcaacgtctaccacaccacaggtgatcacagagtgcctgtcgtcgctgatgcagctgatgccatgcatggagtatctgaccaaggctgacgagccggctcccccgagtatcggctgcgacagcttcaagtcgcttgtggagaaggcgcccatctgcctctgccatggcatcaacggcgacatcagcaagttcatgccggcgccgatcgatttcgcacgtatgatgtctcttccggccacctgcggcgtcgccccgcctgtcgaggctctgaccaagtgcttcagtaagttttaattagcttcttttctctattgtttgctgcaacttatttctgaatttcacctgtatatactttttttttcaattgttttgtgtggattcaatcttatgtatacatgtaatgtttgtgttcgaaaagattgatttatccatgttatatatgtttgacagcgggaccagtgccgccgttgatgcctgctcctactcccgctgctgctccatctccgggtaattaataattaacaattcattctggaaaaaaactgagatatgctaaactttatctatcctgaattaactctacgataagttctgtacccttacttgttcatgttttgctttaattttattctgcagggccatctgcgtaagtttatatatagcgcaagagagaatggatgctgattaagtaggtgccgtcaagatgaagattattaatagaattttgatagtttatatgagtaaatgctgtctagtttttgttagtttctgtagtcagcaagacgttatgaatgaggttataattaattaggtctagggaggaacaataatatatatggatcaggtcttagttcagaacagtgtcattttgtacgtactctggtacaaatatataaatctacaaatattgttcaatatttttatttcattgtagtcgttctgttgacaaaagtatacacaaaattataaaatgtaatccctgaggtcatatattgctccattcatatatttcagatcgattgaactttttaccatcaataacttctcaaatgcttagttttaaaataaaagattttcttcaaaaggagtatcacagtattttcgtacttttatcatcttttttaaatataaaattgatattcaaatctaagtttgaaaaattcaaccaaatcttttctcaacgtcaaatatctatgtgagaagattatgagatttccaagtactttttcaaaatatttatgactcaaactacaatgtacaggagttatttaaaattttcagtgttgtatatagaacttgaatgctcccctccacacaatcatttttctgcccgaacagccagtgttaatccatcaccaatggttccggatgaaccgcagtgctaagccactgcgtgtagttgctctattaccaaatggtactaattgaagttagatctatatattttgagaatcagaatttgatatcagagtgtataaataacgaaccatttatttgttttcagtacaaatttttttcatgtttttaaatcgactaaaatttttgaggtaacgttaatttatagtttaatttacatttttacagttctttgcaagatatccgaatggcaaaggtacctatgttctacgatttatcattaggtactgacattaattcatagcaaagatatctacgttgtacacacaagtatagagagatagctccaaatatataccttctatatctatctatatctataataattgagcactttctacaagctcccaagttaactaggaaaatatggcctttgatcaaatcgataggataatcttcaccgttggtcataaaatcaaatcgcacatcacacctttaaagcgatctaatatccatccaattttaaagcccgtctagagcccatctaaccattacataaccgtatacgtatctcatcatgcaagcttttgaattatattcgtagacatcgtcttgctaatatatctctgtcccgactcgagatgtggccatgtcgaactcccttgcaattgacaaaaccccagaagcaaaaacaacatgatctgtagctatatatatggacggcaatatttagaggactagaaccctggaattaaccttcgctgaattgtgcatttgtgttgttccatgcacctaggcgatggttgatggtagatcctggagtcaacattcgatgaattttaatgtaattgtgtggcatctaggtggtagcacatggtgtcttagaggaagaaacaattatgtttaaaggaaagaggaagcagacagatagattaacaaaaattatgcatgcttctttgtatggtcgagagacgtcccgttgagtagagatagaagctaagttcagattgatctccatgattggcttatatgtatgtgtcacacccggagttttcccctttcccgtagtttctaattcgtcaataaattatctatagaaattactttggttaaccgggagaaaaccttaagtaacaatgtatttaataatcgaaaatgttagggagaatttttttgaattctctttgctctaaaatcattaacgggacttaaagcggaatattcagagcatcgggattaatgttgttaacttaaactggcaggatttgaattaataataattatttttttcttcttgcctttggtcgtgaatcatgcccaattcactcctctcttcgtacgtgcctccgcgttttcgttttgcatgatgagccaagtccgatttcgcttccggttccatttccgttcttttcccaaaacggcaccgtttttcctttccgatttaggaaagtcctaatcctaatccaacccctcgccctctccctctcggccgctgccctccctctctccctctcggccgtgcgcgcccctcctccctagccggccgaaccgagcccctcttctcctcctattcggttcctccctcttctcctcccaatcctagtcctagtaggacccacctaatccatatattttccccctatataagtcttcatacccctcaattttattatttccctcatattgcaaaaccctagacctagccgccagcgacccctatccccgccgccgtcagtctgctgtgccgccgcctgccgcgtcgtcatcatcgccgttgcgtcgccagtactccattttccctctttattgatgtgtttgccgctgcaaccatcaattcatcattttaatctattcagtttgtttctcatctagcgtcgccgtagcctctgtgtgttactgccggatcgtcgtcgccgtctccagctcgccgatcgtctcggtttggtgaggaaccttctcgtgatctcctagtttaggtgttaattctttaagcgttgttgttgtaaccctaaaagtgtaaccccaccaaaaccctagcgtcgccgccgctaagcaccgctgccgtcccggccatgcgccgctgccaccaccgtcactgccggccgcgcgccgccgccgctagccgagtcgcattgccgtcgccgtttagcgccgcacactacaagaaatgtgatcttctgtgacaaattcctcatgacgatggtgctattcgtcactatgccatttcgttttatgacgtttgatagggggtggtgttaacgaccaaatttggtaagtaatgaaccaagttcggcatttgaatcgaagtggattcggcaaagggattgtgatcgaagaatagagtgcgcatcggctgcggaggtatcggctagagtctgcatcggctgagatgacattggacaggggacagccgatacagccgatttcattgagatggttatgaaatcgtttctgggatcgatcagagtgctacgaaaggattgccatcatagagataagctcccagataggcaattgtatctattaattaggatattttaaatagtttccttagagatatgtttgggcaaaagtctgccgtaaagacttatgtgtatcttagagtttgttagagataatagtcgtgtccggcaaggacatatcatgtatctcgggtataaataaaaccgaacccatgtaatttaacaacaaccgttcaataacaatctcggcgcattgccaccctttttcaggttcgtttgtttcgacgagttcttgctttcgggttgagctgcatcagtttcgatcttcaactagaagtaaacttgtcatggtggcttgcgttttcgggattagtgctttcatcttcatgacactctaatcctgtttatgtaattcgtcgagttattatatacactttataatctttattagtgattctatctaacccgcaatcggttggtttttactgctaaatagtagccgatagagttagatcttgttattaatctagattatacagcacatctaccatcttttagaggttttcatcatcttgcttagatcttacatttatctttacgcttaatgctgcatcggttaagttcgatctattaagtattatctataactataatatctagcttgttttatgattatcaattgagatagtgtcggagttttagccgatatttcctgatttagcatcttttgccttcatatgcttgattgttatgctaaatctgccctttgtattaagatctcatcgcaccagagtatattaggctttcttgtttgatatattttgcttattttaatatcttagtataaagtggtatcggagtattagccgatacatgctagatctatctgatcggctatgctataaatgcctatataatcattgcttttatgtatcttttgacttgagtgatttatactatctcggcatggcgaccgatctatcccaatcacttagtttaaacatacatcgaaggaaagattatatatcactaatatctacagccgatcgagtagatttagtcttatcttattcattcattactgccgatcgattccaacatgacatcggcttgaagataaatgatatgtcatcggcaactaaccgatcggctatcgtttatggatttgaccgtggttttttcttgtctttctttcttgttgaatgcaggatcaaatcgccttgaacctaaaagcacgatttaggacctgcacaggagttaagcagatcttccaggccagtgtgtgtttttcgcatcaacacgcttttggcacgcccagtggggcacgagttgagcgatttttcatcatgtcgggcggcaagcaaaatcccccggctaccaagcaagcgtccgatcaaccagcggaggttgacgttgagaacatcatcccaatcacttaatggcaagtacttgaagaaatcttacacaagtgtatggattaattcatgatcggctgatttttgccaatacatgctagccgatgtgatgatatcgcctttagatggccgatatggattatatcgcccttagtggttttttcttatcataattggttgtggtttgccgatgtatgatgcccgatatgattatatcgcccttagtggctttttcttatcataatcggttgtggtttgccgatgtatgatggccaatatgattatatcgcccttagtgtttttttcttatcataatcggttgtggtttgccaatgtatgatggccgatatttgatatatcgcccttagactaaattataattttatgaatgacttcagcattgcaaaattaggggggcaaatatatatgaaacgtggatttcaaaaacaaaatttaaaggaaattcgcgacaattctaaacttgaagttctttacagcccaaaagtttacaaatttaaagttgaagttacaagattagctcatccagacacatatttttggatggccgatattgccctctgcctaatctgatatacttcatctattatttgggcatcggttgcgtcagtgcttgagatcaccttcagagatttggtcaggtcagtcaagtgcttgacatatgcttttaattttgacttctggtcttcaatggctttcggtaagtcgacaagcttttgttcttcaagagtgatttgtgcactgcattgctccaactcagccaagagctctatcgtccgggcgttcagccgattgatgttagcttgagtagaacttgggccagcctctaattcatcaagtttagctttctcttcgttgatagaagccctgctaacttggatggtcacctcaaggtcccttctctcacggcgatcgacaatcctttgtttggctttctctagtttgagccgatgttgctcaaggtatgccgctggggtataatcgcatcggctaattcgtctgggattttatcatggactacatgaaacctatctctaatggatccactgctggttaccagagtttccagagaaccttctagtcattttgagatgtccagcagggttgctttcacatcatcggctaggggcaccaagactgtgcttgtggtttcttctttttcatccatgaactgcctgatgtcgaaggagaacatatcggctaaaacctcaaaaggaatacattattggttaacaaaagtggcatggtagccgatatgatttgtggattcaaaacaggaacttacagggatagcatgggctggtgctgctacttcttcttcttcttctatgtgatggcttcctgcagccgatagggtatgctcacttgattcgggaataggagttggagtacgacgagcctgagaaggaccaatttaagttatcatcggttattcaaaagttgaaaagaaaattaaatgggatttagaaacttaaccgatggaattggtgcttgtggttttttagaagccaactttttttctgcaaagtacaagattaggaatcagcatcaaatattaaaacagaagatgaaaagagaacacatgcatacccttggtttgtaactgggacgcactggaggtgatggagttctttgaggagcaggaatttcaggtggaggagtttgcacccttgtttcactaagatttttagccgcttcatctacagcttctgccaattcctcaccctccaggaattcttctatgtctggatctacggttggtaggtcatcaatagcagtcttttgcttcttgggcttcttctttgcagccgatggagcagcagctgattttgtttttctcttcttgccaacatcagctgcaatcagcacacgcgacagaccatgtagtagagttgaggtcttgggggcatgatagccgatgactgggggagctaagccaccaccattgggaataagtcctggagcatattggatctctacaccacttttgctgcgatggggaggagaagattctgttgtctgcagaaaagaaaaattaaaagttaagattgatcaatcggcttacaattgttaacaaccaaatttggtaatttcagtatcggagacaaagataaaatcaaagcggaatccaagatggagatcgtcccgcaagaagagcaaaaatcggctaaagtccgaatcggctgcgaccaggatcggcagagtccgagttggacaaggttagccgattgagccgaatccgacaatatgacacggcatacgttgtcgtgttgggttaatgtgcttcatgaggattgccatgcatggacagagtcctgagaaggcaattgtatctattaattaggatatttcatgtaatttccttagaggtatttttgggcaaaagtctgccgcaaagacttatggtatcttagagtttgttagagataagagtcgtgttcgatatggacatgttttgtaatctcgggtataaatagaccccgagccctatgtaactaatctaacacacgttcaatacaatctcggcgcattgccacccttttactttcgttttgtttcgacgagttcttgctttcgggttgagctacatcggttttgatcttcaactagaggtgaaacttgttatggcggcttgtgttctcgggattagtgcttccatctttatgatactctaatcttgtttatgtaattcgtcgagttatcatatattctgtataatcttcaaaaataccgttatttaaccttcaatcggctaacatctatcattggaaggcagctgattaggttaaatatctatgttgtcttagattgtacaggatatccaccactctatgaaacatccaacggcttgattgtctagatattgttcttcttttcatacttatagctgcatcagtggagtttgaccttataagtcgtgattagaatttcaatctctagcctacttttggttgtcgattagggtagtatcggggtttcagccgatcttatctgattttgccttattatttcatgcgcttaattgacatgctagatctgtcttttaaattaagatcttattacaacaaagtatattaggcttctgtttgatatattttacttgctttaatatcttaatatagagtggtatcggagtattagccgatacgtgctagatctatctgatcggctatgctatgaacatctataatcttgttgttaatatatacttcgatttaagtgatttgtatactgtctcggcatggcgtccgatctatcccaattacttgatttaagtatatatcgacatagagattatatactgtcaatatctacagccgatcgagtagatttagtctcttcttacttatttatatctgccgatcgattcaaacatgacatcggctcatagataaatgatgtgtcatcggcaactagctgatcggctatcatttatggatttaaccgcagtctctttgcctttatttcttgttgattgcaggatcaaaccaactggcacgctcacgaatctaaaggcaagatttttggacctgcactgaagttaagcagattttccaggcctcgtgtttttacatcaacacgcttttggcacgcctagtgggaccgagttgcaataacgttctctcatggctgagaaaccaccaccatcaccgtcttcgattggcaagtcggaggtcccttccaagactgatatcccaaagcctagtgggtttgaagttcatgagggaaacattgttcccgtcactatagacaaattaacaccggaacaaaagaaggagctcgatctgatgatgcagcaaatacaacaccagttcttgaattctttcatggagacccgtaagggaacagttgtttagaagtataaggtaaaattagttgctgatgttcctggaacaggttcttctaagaatggagaagtacaacaagttccggctggtacagttgaatcaagtagtaaaggcattccagagggctcgggagataaaggtgatggttttcagggggtacaagttgaagatcttagaccagatggcaatgaagtacaaccgcagtttaacaacttccaagatcggattgactatgccgtgcaacatgctttgattaatcaatctggagtgctagtgtcacaccccgaagttctcctaccaagcctaaaatttaatttataaacgaccccaagaaaatgcaggtgcaatcaagagaaaaccctaagaaagtaatgcaaataataatcggagttgacatgtggaatttttcttgagttcttcatgtcgaaatttattaacaggatttttagtggaattttcagagctctagaaataatttttaaccaattaaaatggagcaagcaatatttttattctagggaaaatcctttttcttttttttctttttcttgggtaccgagctcg

SEQ ID NO: 58202 - DNA, 3272 bp, Oryza sativa
cccacctccaacctcccacgtcgccggcgaaatcgggctcgcctcggccacgtccgtctctcccgagcccctataaagcatgcccgcactcccctccaccttttttctttttccaccactctctcccgtgccctccattgctcccgcgccgtgcgcccatccgctgccgcctctcccgctactccggtcgcctctagccaccgctacactcgccgccgcaccacgccgtcgccgccgatggattcgcgcggccgaggtccacctcgtccatccctcctccgtcgaggttcgccgccggagccccatccccgtcgtgcgccggtaagtgacgccatggccgccgccttcggccggcgttttcgccctctcgcactctcctctctctctctaacccctctccttttgttcgttagaaggttccggagctcgtcccgccgtcgccatcgtcccccgtcgcccgccgtcgtcgaccgatgtcggtgaggcctctcctcctctttctctctctctcccgcaccgtttacccgttgcgccgccgcttagccgcgtagctgccgctttgcctctagccgccgctctccgccgccggtcggtcgccatcggccgccgtcttgcgccgctgccgcatgcgcgccgcgccgtcgcgcgccatggtcgccgggccggtttgcgccgtgcccgcgcgcaccggctgcgagctcccgccgccgtccgatctacccttgggtagatcggggccgtcggttcggctgtcgcgtggccgccgcgtggcgcgccgctcctccccggtccgtggacccgatccgccatggaccgccctccccgagccgctgaccggtggggcccgcttgccggcgccgcgccccgccttgatgacgtcagcactggaatatattgcgcaataaatgatttaaggtttttcttgtatagtaataaacacagtgaatcttctaaaattcataactaattcatccgagctccgtttaagcccgttcaagtctcagtaaatcaagaaaaatgtgtagaatccattaaaaatggttttgttccctgtttcagtagtcttatagcctgtttgcaatgtttgccttgtatgtcgctagattccggcactcccgacgctccggtgtacttcgaaatagtcgccgaggttcctccagcagcagagcaaggcaagtcatgcttgtcacttgaacatgttgatcctatattgcaaatgctctattgttttctttcaaatattgcattgttttatattgatactatgggttgtttacctattgtcatagccatgctattgttgaaccatgtctctttgtcagcttggggttctaacatgattagggttaggactagggattgcttagccatgcttagttcaactagttcacattggggaaaatcctattaatgtttagactgttggttctaatggtttttgttggattagtgacaccgctttggtgttggttaattaaaataaatcacatggtgggctgtgggtgcatggttttgctggtcgcgcccatggcagttaaggaccggttcgcgggatgccctggaagaacttatcgtacttaccacaagccagcgtgggcaacggctgggcttgtagtgtagctttcctctagttgacgcatccaggcaagggtgggcgtgatggagcggggcaggccctgtgacagcctctgtcgcttccggattcacctaggcatgagaggggactgcccgttgcccgctggggacgggggtgacacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcactctagtgtaatcttttgaaattggatagtttaggtggatggttgggcctgtcgcaacgtgagttagcgttggacagtggatagttaatattaattaattattacaactgtttaatctttcaacttctttttataaatgctcgctttatgcaaatgaaccactttagctcttctttgatgattccgtgcatcatacccctattccggtatgacttgctgagtacagtgggtagtactcagtcttgctctccttttcccaaccccagagttcgagttcgggtcagatgaaggtttctccgaggagtaggctccgtccgtgccgtcgaggatgcctgtggagtggtgttccgctgcagttctagtcaaggcttagctcctgttgtctttcgtttttccgctgcatttatgtaagactttatgatgtttgtaagacgtggatctgaatgtcaacattgtcgtttgtgtaccccggctggtcctggacgggggttttaatgcacattctgcttgaaattctattcgggaatttctaggcgtgacaagttggtatcagagccgaccttgaccgtaggacaagccaaatggaaaaacctaagagccctctgaatccttttcattgcatatgttctttgcaattggatttattccgggaaaattgggatctgttcttgtggttcaagggaaaaatcttggtcgctcgtttaagtgagatttttcaaaacaagtcagtccagggttttagtaaaactgttgagatttattcgtcagtcagttgggatctgatgggtgaaatgcattaggtcatagcttaggaacatgggttgcaaggtatttatgcttttattgttattattagtatgtatctaatttctcattattttatcgttatgtgagtctgtcttatttattcgctctcatgcaaaatgatctatgcataaaaatttcgctcttattcgattcccttatttgagtttttattgctttatttaaatttggatttgagcatgcattgatcctactcctttgtcttctctagatgggcggccacccacccaaccaccgcggagaaggcatgatcgactttgtggcggagttggcacgtatgacactggtggtgggctaccccaacgcgccagagtacacgacgattccaccgctcagtggcgagcttcctcaccgtgttcgcctggaggtccacggctacgtgggtacctgcctagctaacatggtggttgaggcatctggaggcacagcagatcacgcctgtcaggaggcagcatacctgatcatggtcagagggta

SEQ ID NO: 58203 - DNA, 679 bp, Oryza sativa
aaaacaaacagtcaaaattggacacggaaacctatagtttgccttttttttttggacggatggagtaggtaagatatgatgaattgatgatttattcagttgactggagaatcagggaagcaattaattaactaagcaggcccgatgaaggccacaacgacaccatagcccataggcacgcacaggcgcacacacatccagtgcggcagtgctcagcttaaatggaactagggcatcttggcagtttaacagccgacagagatcctaacaagagcaacaacaacatctggataacaacagcatacgagtacaaagcaaataaaatggctggacgtccggaccaaacagctgcttagtgcttgctagctagcacaatcagactaccatgcatagtgcacaatgtgttcctcaacaaactgaaaacaacaacggtggttatcacagtgctacaatgatgatgatgatgatacagtgctacaagctccatcatatgcgtgataaccactagacgagatgagatatggcctcttacttctttcccttttggatgactttgactgcattgttcacaccggccatcttctcatctgtgatcggccctccttctggaagatcgaacttctgcgggtcaacgacctctgcttccctggtggctgagggtccacaatctccagcatac

SEQ ID NO: 58204 - DNA, 1625 bp, Oryza sativa
gaatttagaactggatttgagatttttttcatcgaagtttattttttaatctttgattttagatcgctaaaaacacatatataaaagttttattcacaaattatttttcgtttacaaatataccgtttgacttattcgacgaataagcgaaacgatgagtccgtatcgtgtggaacggtggatgctagactagactactactttttgttttttgcacaagatatgataatacatattccctctgtcctataaaaaacaacatattatcggactaatactatgaatatgaatgtatcatatccaatcctagctagattcatttttctgtggatggagggaattcacaaaagaccaatctagtattgatgagagtttttcttatccaatttgttatactagaaaaagtatcttgttttttcttaggacagaggaattacgccggatgcgccgtatttcaataacgtgaagaaaacgatcctatcaggaagacagcagcgtgcaatgtaccttgctctgtcgatctcatgcaaatcacctgcaatacaccaccactatacaccgcaccatgcaaaggaatgtattgtttccaggtgtctaatctttttttttccacaaaattttctattgcttagaaaagttcggttactcctgtagcttaattatatgcatccataagtacgtacagctggttaaaaaaaatcagcaccctactgaagtgatgaacagagatcaagcacaaaattagttacggtacgacaaatcaaatcgctgtgatcgcgttgcgtgtagaaaggcgcaaacagttttttcatcagtctttgctttattaggcgcaggtcaagttttgcgcccatgaaacaacgtgcacacgggcgctagtacaaaatttaaattgagtacatacttttcagttccaaagagtagattatattactgaccaaacagcgggcgatcgatggactacatgcatacacaacaaagaaaaaaatgcgatcaggaatactggtagtagattattagtacttgcacacagccagcacacttgacttttgacaaatacgtaagcatggaaatctagcagacttcagatgcagacagtgctacttgttgttccggccagtgtcgtgtatatgttgttgtagtaggagtagtacaacgtatactctcgcaacttcccagaaatggcaaattccaaccgccacggtccaatctgcagaatggaaaaagcaaatggagcacgtgtttcacgccacattaattaattaattctcgtttttcgtgcgaatagagaattaatatttcatacagttgagaatagtttacatacgcttgttggccctggcatgtgcatcagcttgggtcaccggcttttgactgtgtgtaggcttgactatactatgtctcatttcatttattctctgctgagattctattatcatcaggggaaaagtgaattacaagcatgcatcatgaggtatataaaaaaacattttcagacttaaggctcttagggcatgtacaatggtagccacaagcaactgtggtctcaagactccacgtaggatagaaccacacaaaggtcacactacccacagtgaaaaccactccaaaacgtattttgcatg

SEQ ID NO: 58205 - DNA, 6502 bp, Oryza sativa
tatttatgcttttattgttattattagtatgtatctaatttctcattattttatcgttatgtgagtctgtcttatttattcgctctcatgcaaaatgatctatgcataaaaatttcgctcttattcgattcccttatttgagtttttattgctttatttaaatttggatttgagcatgcattgatcctactcctttgtcttctctagatggccggccacccacccaaccaccgcggagaaggcatgatcgactttgtggcggagttggcacgtatgacactggtggtgggctaccccaacgcgccagagtacacgacgattccaccgctcagtggcgagcttcctcaccgtgttcgcctggaggtccacggctacgtgggtacctgcctagctaacatggtggttgaggcatctggaggcacagcagatcacgcctgtcaggaggcagcatacctgatgatggtcagactacgggagcgccacaactacatcttccacgacacggcgtaccgatttcaccctcgtcgagccagtgatgatgatgtcagcaccttccgtccgacagccggcgagaacgacaccacctttggtcacatgtgtgctgtgatgaggggattggacaggatgcactcggacctgcacaaggcgaccaaggccttgaacgatgggaagctcatgaggatcgtcactctgaaggacgagatagcgcgcctgaagagggagaatgctcagttgaagggtcttcccgcgccaggaggagtccggatccgcactacgccccgcaagacgatgactgcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaccggaggttggttgtctgctactcccagtggcagccgcgatctcagcagcagcagctccagtggctcacagtcaggcagcggcgagacttatctgccaggctccgggagtcgctcagagagacctggtgatgagcaggaggacgccttcgactccaccgaccgcaggagccgttccgagcattaggctcgttttccattagtttatcgactgtctagcttctgcttgttagtttgtgtgtttaggctgcttgtttgggggtcagtcgacggtcgatatcatgtgcttatgatatggctgtcttaataaggatttttttttgcttgttttttttagtgttttaattcagattagaacaattgcagtttaaattcctttgtaataaagcttagtttctgagcatctgtttttcttcttttccccgtctgcttttccctccagatggtctacaccaggaatggtagccgcgcgacaggcgagggcagcaacggcgaagagcgcactgatggggcgcatccccacagcgattctggccatggtccgccgccacttcccaagaatccgacgctagcccaagtgatggcacatcagacacagatgatggcagccatgatgcagcagatgcagcagcagcaccagcagatgcaccagcggatgctgcagcacgccgaacagcagcaccagcagtttggtccccctccccctcagtccaagttgccagagtttctacgcgtcaggccacccaccttctccagcaccaccaaccctatggaggcgaatgactggctccatgtcatagagaagaagctgaatctcctgcagtgcaatgatcaggagaaggttgctttcgccacacaccagcttcaaggtcctgcgtcggcttggtgggacaatcacatggccacccgcccaccaggtactgaagtcacttgggcagagttctgccgtagcttcaggaaggcgcaggtgccagatggggtcgtggcataaaagaagagggaattccgggcgctccatcagggcaacaggactgtgacagagtacctccatgagttcaatcgcctcgcgcgatatgcaccagaggatgtccgcaccgacgccgagaagcaggaaaagttcatggcgggtctggatgacgagctgaccaaccaactgatatctggggactacgctgacttcgagaggctggttgacaaggcaatccgtcaggaggatcaacgcaacaagatggacaggaagaggaaggccgcacagttcagagcacctcagggaagtcaccagaggccgcgcttcgctcccgggcagcagggtggacctaccaccatgatcgttcatcagcaccgcccgttcaaccctagcaactttccccagggcgccagtggcagtcagaaccaccatggaggtcagtccaatcacggtgcagctccacgcccaccaatggcaccggcacagacaggcccgcccgcgcaatccaagaaggagactggagcaaaaccagggtcctgcttcaactgtggcgagcttggccacttcgctaacaaatgcccgaagcctaggcgtgccgggccaaggtttatccaggctcgtgtcaaccacgcatctgcggaggaggcacaagcagcaccagaggctgtactgggtacgtttcctgttaactcaatccctgcaacaatactttttgattctggtgcaacgcattcgttcatttcaaagaagtttgtcgggatgcatgggttaataagagaggaacttagcacaccaatgcgggttcataccccagggaatagctccacttcagttcaattcagcccttctataacaatagaaatccaaagatcaccatttctagccaacctcattcttctcgaatccaaagacctagatgtcattcatgggatggattggctgaccaagtttaagggggtcatcgattgtgcgaatcgcacagtcaccttgaccaacgagaagggagaaaccgtggtgtataaatcactagtctcaccaaagcgaggggtctctttgaatcagattgagacggaaattccagtggacactgtggagaagaatttggggaaattggaagatatacccatagtctgcgagtatccagaagtgttccccaaagaccttactaccatgccacccaagagagagattgaattccggattgacttggcaccggggaccgctccaatttacaagaggccgtacagaatggcggccaacgaattagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaatcaagaacaaatatcccttgccgtgaatcgacgatttatttgatgaactgaaaggagctaaagttttttctaagatagacctgcgatcaggctaccaccagttgagaatctgggaagaggatattccaaagacggagatcaggctatatgagtgcacggttatgtccttcggacttactaacgcacctgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatacgccaagttcagcaagtgtgacttttggttgacggaagtcaaatttctgggccatgtcattacagctcagggtgtggcagttgatccatcgaacgtggagtcagtcaccaaatggaccccaccgaagaccgtgtcgcagattcgaagttttcttggacttgcaggttattaccgccgattcatcgaaaacttctccagaatcgcccgacccatgactcagttgcttaagaaagatgagaagtttaaatggacagctgagtgcgataagagttttgaggagctcaaaaagaaattagtatccgcaccagttttgattctgcctgaccagatgaaagacttccaagtctattgcgatgcatcccgtcacggacttggatgtgttctaatgcaagagggcagagtggttgcgtatgcctcgcggcagttacgtccacacgaagggaattatccaactcatgacctggaattggcagcagtggttcatgctttgaagatctggagacactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgctttaagccggaaaagttactgtactgccctgtgcatcgagggcatgtgtgaggaattgcggcaggaatttgagcatctcaacgtgggaattgttgaacacgggtttgtggccgctctggaggcgcggcctacgctcgtggatcaagtcagagctgctcaagtaaacgattctgaaatagcagagctaaaaaagaacatgagagtcggaaaagcccgggatttccacgaagatgaacatggcacaatctggttgggagaaagattgtgtgtgcctgacgacaaggaactgaaggatctgatactcaccgaggctcatcagacccagtactcgattcatccaggcagcactaaaatgtatcaagacctcaaagaaaagttttggtgggtcagcatgaggagagaaatagctgaattcgtcgcactctgtgatgtttgccaacgagtgaaggcagagcaccaaagaccagcaggtttactccaacctcttcaaatcccggaatggaaatgggaggagattggaatggactttataacaggactgccccggacatcatcgggtcacgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacgggctatcacccgcaaactgatggtcagaccgagcgagtcaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttttgggatcagacaggcgagcgtcaactgttcggaacagaggtattagcggaagcagaagagaaagtcagaatcatcagggaaaggttgaggattgcccagtctcgacagaagagctacgcggataaccgccgaagggaactcacttttgaggcaggagattacgtgtatctttgtgtcactccgctccggggagtacaccgttttcagacaaaaggcaagttggcaccacgcttcgtgggaccatacaaaattttggaacgaaggggagaagttgcttatcagttagaacttccatccaatatgatcggcatccatgacgtgttccacgtgtcccaattaaagaagtgcttaagggtacctgaagaacaggctgattcggaacacattgatatccaggaggatctaacatacgtggagaagccggttcgcatacttgataccagtgaaaggaaaaccagaaacaaggtcacccgattttgccgagttcagtggagtcatcattcaaaagaggaagcaacctgggaaagggaagatgagttgaaagccgcccatccgcatctcttcaccagctcctccgaatctcggggccgagattccgtttaagggggtaggtttgtcacaccccgaagttctcctaccaagcctaaaatttagtttataaacgaccccaagaaaatgcaggtgcaatcaagagaaaaccctaagaaagtaatgcaaataataatcggagttgacatgtggaatttttcttgagttcttcatgtcgaaattcattaacaggatttttagtggaattttcagagctctagaaataatttttaaccaattaaaatggagcaagcaatatttttattctagggaaaatcctttttcttttttttctttttctttttcctccctttttcctccttttttcgaatgggccgccggcccattctctctttcctccccctcctccctgctgggccggccgcaggccgcaggccgaggcccagccaggccggccgcctccctcctctccccggggtcgccgacaggtggggcccacctgtcgggcccttccccaacctccggaccgccgcccacgtcgccacagccgccaaaaccgccgctctctctctctcttccccacctccaacctcccacgtcgccggcg

SEQ ID NO: 58206 - DNA, 1092 bp, Oryza sativa
taaagattatatatgttgatagcatagccgatgttgcagatctaacatgtatcggctaatactccgataccactaagatatcaaaatagacaaaatacattaaacatggattaatcaagtgttaaagtagattaacagattaataacaagcttaatatatttaattacagtgagatcttgatataaatggcaaatttagcatattaagtaaacctaaagtaaacaaaataaccaaatcaggtaagatcggctgaaaccccgatgaaacccaaatcggcaaccaataaactggctagagattgatattctaattacgacttataagatcaaacttaactgatgtagcaataactatgaaaagaagaacaatatctagaaaatcaagtcattggatgaatcatagagtggtagatatgctatattgtaggatcgaacaaggccagacaaacctaccagaggggggtgaatggtagggaaaaccaaaaacccaaaatcttttgcggaataaaagattacctcgaacgaagttgattatcgccggtcgaaccgctcaatcaccgccggtcagactgccgtattctcgccggtcagaccgtgtgcacacctacgatcagattgctgcactcccaccggtcagaccaccgccctgcctgcggttagaccgtcgggacccagaaacaccggtagatgacaaactcgaaatgtagattagaacttttcgactttattgcatcaactagtgtttacgaagtgcaactatagcactcctcaccaagatctcgaattaaacttaaaaccctaactttctctcaacttgtatctcactaaaactgatactgggagaccacaacctccctttctatttatacatgaggtaggctgtgcaaagcccacgaatctaacacaacttaggactcctatccacgtaggaaatcctctcttgcaagtatccaactcatccatttccttatctctttcaatcttcccgaattcggactctcctccaaattcgactcctctttccatatgtacacaatccacttgtataccctatgaaatcttcatcaccacgtgcattatcctctagccttt

SEQ ID NO: 58207 - DNA, 2318 bp, Oryza sativa
ttctgttaaaaatgctcgctttaggcaaatgagccgctttagctcttctttgatgattccgtgcatcatacccctattccggtatgccttgctgagtacagtgggtagtactcagtcttgctctccttttcccaaccccagagttcaagttcgggtcagatgaaggtttctccgaggagtaggctccatccgtgccgtcaaggatgcctgtggagtggtgttccgctgcaattctagtcaaggcttagctcctgttgtctttcgtttttccgctgcatttatgtaagactttatgatgtttgtaagacgtggatctgaatgtcaacattgtcgtttgtgtaccccggctggtcctggacgggggttttaatgcacattctgcttgaaattctattcgggaatttctaggcgtgacagctagtcactacctttttaaacatggtgaagtcattggttgatggttcaatggctgagtatcaggctacaggaccggtatatttaccaggggatgttttcccaaattatcggcctctgatcacaaataatcagccgagtacttccagtgtaccaccagcagcaccagtatcagctcctgcacctgctgcaccatcatcggcgccaaaacaaattaccaatcctcgcaacatactggacaaaaggtcaatcggctgactcaggaacatgttgctgctatgtttttgccaaatcagcctactgtcgaaccagtacaacaattgccgattcagtagacgccaccaaggcagcagattgctcagccgattcaacagcaaggtttgctaaatgcatcggctaggttgaggacgcctgataatcagccaaggcagcatgttacaactcaagttgtccctgagcatttggttcataatgtgcaaccagatcaatcggtgatacctcaagttattcccgaacatttggtgcacacattcagccaaactttcagaattatcaagggggcaatttgaattaccaatatcagcctccatcgccacatgttcagtataagcaagggggatcagctcagccttagttcgctcctcggtacaatcaattcgagtctctaccacaacaagcacaaggggtgcctcagcagagaccatgggccgatttgattgcagatgtgatgagggagcaatttgggcttaagccaaaagacactggaaacttataacggcatccatatcctgaatgatttgagagggttcaattgcctaaccgatacaaagttccggattttttaaaattctcaggacaagacaacgtttctacctatgagcatgtcagccgatttttggctcagtgtggtgaagcatcggctgttgacgctctgagagttagattgtttcctttgtccttgtccgaatcggcatttacttggttttcttctctaccatacaatttgatcaacagttgggccgatttggagaaacagttccatagctatttttatagtggagttcatgagatgaaattgtctgatttaacagcgattagacaaaggcatgatgaacctgtgcaagattatattcagagattcagagagatgaggaataggtgctacagtttgagtttgactgactcccagttagccgatctggcttttcaaggtctgatagctccaatcaagcagaaattctcatcccaggagtttgatagtttgtcacatattgcacagaaggtaactctacatgagcagaggttttgcagaagccaagaaaaaattcaagaagatcaatcatgtctatccttacatatatggatccgatgatgataatgatgattccgaagtagcagcagccgagtgggtcagaagcaagaaggttataccatgccaatgggtaaaaagttctggaaaagaagagaggtatgactttgactttaccaaggctgataagatttttgacttgttacttcgggagaagcagattcaacttcctgctggtcatattatactatcggctgaggaacttggcaaaaggaggtattgcaagtggcataattatggttctcattctactaacgactgcaaagtttttagacagcaaatacaggtagccattgaagggggaaagattaaatttgatgactcaaagaagccgatgaaggtcgatggtaactctttcccggtcaatatggtacatagagccggtagaacagccgatggaagcaggagtaaaagtttttagatgaattcggctagaattattaacaagtatcagaggaaatatgacaagcagcaataggagaggtattatgaagaagacaatggcggttttgatcctcgttgggactgtgagttt

SEQ ID NO: 58208 - DNA, 698 bp, Oryza sativa
aagtataggaatagattcttttcaatactctttccacttagcttagagatttaatataagagtgagtagcttccggtcctcatggaaagctacactcgttgaggtagaaatcgaagagagcgccaaacttccaggcacacttgcagagcttccgctcattctctacctattctctaatgtacaaaagatataatagagcctcttgtatttcacctcaaagttgtgtgtgctggaatgaagtgagctcctccttttataggctccaaatgaaggttactgctatgggaaatacccaaactaccctccaaccatcattgggatgaaatcaggagcatcgacaaggaagatggcgatcaacggtgacagacatggattagccaaactggtggttcggttgaagcaaaaaaacccacctcctggactctcctttggccaataggttgcttaatgggctcccaacatcctgtactatgagtttgcccaattctaagtggttttgattgacttatggagcttccaatccatgtaaacgcatcctgattgtccgaaggtgtactttgtcgcatgacgggtatgacatatttcaccaacagtagtggaaatgattagtaataaaccctaccactaagttgaataccatattttatttcattatatgcaggtgttgatgatcaaatatgatgatttaaggaccgtca

SEQ ID NO: 58209 - DNA, 678 bp, Oryza sativa
gcggaagtacgtttgaaggtcatcgtgctgttgctgcatcaggttgttgatgttggtgaactgagcatcagcattttgttgccattcttgcgtctgtgctatgtgttcctcgaggttgtattggatctcttccgtttgcatatcaagggtatccattctcctagtgatttcacctaagtcccaacgagaggaacttgagcgccattcaccgagagatggaggcataccgcttgatctgggggactgatagttcaagcctccccattgtatgtcatgaggcactgtcaacgaccaaatttggtaattcaagtatcggagatgaagataaaatcgaagcggaatccaagagatagatcgaccggaaacagaataagaatcggatgaagtccgaatcggctgcgatcagaatcagcagagttcgagtcggacaaggtagccgattgggccgattccgacaatgtgacccggtacacatcgttgggttgagttaatgtgcttcatatggattgccacgcacggattgggtcctgtaaaggcaattgtatctattaattaggatattttatataatttccttagagataagtttgggcaaaagtttgccgcaaagacttatggtatcttaaagtttgttagagataggagttgtgtccgaccaggacagggctgcaggaattc

SEQ ID NO: 58210 - DNA, 1573 bp, Oryza sativa
cacttcttagttcattcttctattgatgttccaagtgtttttctctttgtagttgtagatacctactccctccgttttttaatagatgacatcgttaacttttgaacgtatgtttgaccattcatcttatttaaaaattttatgcaaatgtataagatataaatcatgcttaaagtactttgagtgacaaaacaactcacaacataataaattataattacgtaaatttttttaataagacgaatagacaaacgtgtgataaaaagtcaacggcgtaatttattaaaaaacggaggttgtatatcacaaatatttagatatagtcccgcagcaacacgcaggtatcatatactccctccattccaaaatgtttgacgccattgacttttttttaaaatgtttgaccgttcgtcttattcaaaaaatttaagtaattattaattcctatcatttgatttattgagaaatatacttttatgtatacatatagacttacacatttcacaaaagtttttgaataagacgaatagtcaaacatgtttaaaaaagtcaatggcgtcaaatatttagggaaggagggagtagttcttgtaagtttgaccggcatttttgttctcttgcaatgatgctctgttagctactgcctgaaggctgtctaccattcccatacgcgtagcacaactccgtaaaaaaaaggctgatatgcgagcccgtgtgcccgtgctttactatgactagtcgagcaaaataagtccactttgactaaaatatagattcaatctgagatttgtatccctcaaccttaatatcggatattttaactcccaactattagtgcaatttgatttcctcgatagtattgactgtggtttcctctatgtgacatattgacttacaccatcccgctgagttagcttgtggggctcacatgtcattctctctccttcccttcttccttattcctttctctctcttcttcctcttccctatttggccctttcttctagccgacttcacaacagtggtagcggcagtggtggtaggacgacgatggggagtggcggtggcatcttgcgcacccatgcactcacccatgcatgctctcccttatggcaccatctccctagtcgatctctccctacaccgcagatgtagaagcttgcgctggtaacagcgcagcgctgttcccgcacagcggctggcacaaccaccatcgatggcgtcatgcgagtagcagtggcaaggcgcacgcgtgcggggtgatacaaggtggaggatgaggcaagcgccgctgtggaccgtcgttatcgatcagtttcgactgtcaatataattaaaatagaggagaactagtgatgcttgcaatgcataaatatgttagaataataatattccacttggattaggtatactaaccttttgcagagaatggcaataaagtggaggagaatcgacatcaactcagacaataaatcaattggactttgtcaagaaccagacttatgtatgaatgggccaagaactcagaaatgacacgatgaattaggccaaaattcacaagtctacgaagtga

SEQ ID NO: 58211 - DNA, 1525 bp, Oryza sativa
aattatcttactaataatgtcgttaagaaatacctacagccgaagcaagaccgcgctacagcgtgacgccgacacgcgttagtggcaagaccaatatgcgagctgaaattttgcttgtagggcgctcgaggcaaattggaatttcaaatgagagatgattcaccaattcatatttgtagtttaatcaagacatattataccaaggcatcataactagagactactaaaaaaatatatcaagattttctcccgtgtatttgtacacaaggttttgacttaaatttctaacagcaaaagaaaaaaacaaccgttatgttgtgagcacttctgtatatgtcccatcaatattttggtcagaatcattatttcttttctttgatatggtattgtgctccgaaagcctcttccgtttctttgaatcattgtcttgttccacaacaaggatttttatgtgtttttcttgcagtggctctagaaagcgcgacgcatagttgactatgagagaatactggttcgggtaggtatatgccgatgtttggtactgtttgcccttgtgccttatttatcgtcatggcaaagttaagccttacaggaaattatttccttttgaattggaatgggaacatttcatcatcagaggggcttagtgggattcgaggcaagaaaacccgtgtaccagaatgttgtcctagcacaatcactgtatcaatggtattctctgaaatcctcgcaccaccaatcttgtgccattgcaaagtccattagctaggtcgatattcctgagcaatatgatgggataattaagtttgagctttagcatgtgaggaggcaacccatttgggttcagaacgataattcgatcaatatcaggaaaattatactatcaaaatttatctataaatagtttaatatagagaaatctataagttataataatttttagtggatcaaatagtgctaaaactaataatgtaaatgaaaaaacaactgaaattagttagtaattgaaagaacttcttttagcccacatatgaaaaatctaattcattaattctgaacgcggccgacaacaacatggttgcgatagagagaaacgacagcggtgaactcttgtggtgaacacaatcgagtgagtacattgtcacaccccaatccggcaccgccgtacaacggcacctgacaggagcgtgtcgtaggaataacgacgcgaaccgcttcctacgaaaccgcgatctcagtaccagtcccaggacatagtgctggtacccacggtgacaaatatgaatcattgcaaatccttaaaataaatagaggacttatttaccttaacttaggttgcagctcagacagcccgagaatgcaaccaacgacacggaagagaaaactccaacaacaacagcagcagcggaaccaacgaactaacacccaacaccacaggcgatggctgggaaccaggacgaaaccctaatcttcacttcactttacttcacgacggaggaactatatatatttatatagagcaagg

SEQ ID NO: 58212 - DNA, 1136 bp, Oryza sativa
acccagggttacctcatgccacatagaaggatcaagtcctcacgtaagcttgcatgcctgcaggtcgactctacaaatccccttccaaccaccttgatcggtaagtgagcaagcttcttgtccttgccttaccaagaacccggtttgtccgaccccgccccggcgttcccaactattggcatgcgaggtttccctgaaccgactagttacttagccaaggtgtcccattccaccttgtggttgcactttgattatgctcgatgagtttcccacaggaatcggttcttatatgcgaatacgggacaatgccacgtaggcacggctcccgcatcgcgagttttcgcaattcattttattttcaagcacaccgacacatgtccggttttcaaggcttcacaaacccatttcccaagttttcgacaatcaacggtgtatgcgggatatttggtacacgcgctcagagagcacggataccaaggtaccacaagggtggagagacaaggaatcagggtagtacagcctacagggattagtgcgactactgagtaggtccgtcggtttggcacgcaaaccgaggccaagcaaattaagtgtgtgattctaataatgcaagttgcaaacaagataataatgattttccaattataggagcaattggtcaaagggtgacttgccttgctcaaggtcttcacgaggcttcacgaatcttcgagaaaacccacgatcgacgaaaatccggtaaccgcaactatatgcaaacaatcaaaacctaaacaaaagaccaaaagaaagaccatatttagactaattaatagttccattaaatatatctcaattttacagaattattggaagtggaacgggggtcaatcggacaagcggttgagaagataggaattttggaaggtcaatggatttttttagataaggaaatgatttatcggaattttctggaatacgaggaatggtttatggaatttatagaaataatattctcaagaatattattgatagtcactgacgtgcaggaccaagggaaatgatttatggaacaaaaggaaaaaagatttattaaatcccttggaaaagaaagggatgagggatgtgaattggacttgtatcgggtggcattggtg

SEQ ID NO: 58213 - DNA, 912 bp, Oryza sativa
ataatgaatgcagtagaatacaagagcatgtctctgattaagaaactgcctaatgcacaataaatttaatattagttatctagtttcctttgatgaccgtttggaggcccataaaaaaccaatctagtaccggatgtaacactatgaatctgtatatgtatatatatatatatgtatatatatatatatatatgtatatatatatatatatgtctaggttcatagtactagaatatatcacatccgattttaaattcgttttttataggacggagggagtatatatttagacatagcctaaatgcacactaaaaaataatcggtaacttcctttgaatattttaggggtcagctatatttgggaattataggcgaatttcgtacattttaccctttttatcctctagaccaacatttcactttttttggtgacttttggtgtggatccttgctaatatgaaaaaaaaaatctgtgtaaacatgcaaacatatgttaatccacaaatgaaaaacaaagcgaatgaaaaggtacattactaaaattgtgatcttttatactatgcaagtttggatcatgactttgcaacctaacttgactaacatataaataaaatcagataccccattcatcccaaaatataagatacaaccactttttatatgccttataatataatacgtgcatgtgtgcatacattgactattacctcttgatcctttaaattaggtttattttaaatcgtttaccatcaagcctcctaatcacattgtttgcatgtatgaatgtgatccaattgaggaggtgattaaattctttcttcgatgttttattaggagtggttgtcccttatattttgggatagagtaactgataaaaataacaaaactgtttttagtgccatgttatgccgg

SEQ ID NO: 58214 - DNA, 1092 bp, Oryza sativa
ctatagggcgaattcgagctcggtacctgtttcggatttgccgtatatcgactccgagcaagtttcgcactttggcggttttcgaccattacttccgggctttaaataccaaccggtacccttgagaaaatttaaaacggtccttttcgttttcaccggttgaaccaaagttggccttttttttttccaggaattccaccgacgcaaaaggcaattccaaagcgattccttctccggcggacctccgcttcggtgatgtcgtcctccgccagcccgtctaccgcgccatctgccgagtacgctgaggtaagttctcatcggctagatcccttttctcgcatgaaatcgatttccctcttcctcatcttgttttcttcttctctatctttgttcacatttgtagcacctatccaatctgattgcgattccaagtctatcgcatgagggacattattttctcggtccaatcggcaacctagaccccactgatttcatcatcggcgaaaccaacataatcccctttagattagccaaccttaatcttggtcactggaagaatacttttaagtcttggccatctctcagaaaaccacccctgagaaaagctggattacatggtacaagcgcgtatcggctagcaagaaagttcactgggatgagatcggaatcggccaagcacttgcccttaccatagtaaattcatccaaggatgaacccttaatggccgccgccacctacttctggtccaatactatcaacgcctttatgttcaaccaagggctgatgaacttgaacaccaagaaccaatacgatttcaggaccaaaagcataggtggttggtctggttatgtggcagcatatatgggccaaggatccgttactcctcgagagcatgtggcctttttactcatgtggctagaaaagtttcttttctgtggatccagctgtggtcctacaaccaactggcagtttgcagccgaagctcttgagccaaaaagagaatttcctctaggcaaaatcctcctcggctacttataccaaatgctgaacaatgcatcggccaaaatagccgtcagctcggtggttggagca

SEQ ID NO: 58215 - DNA, 653 bp, Oryza sativa
atatcactaacacacaaaccatgcttaccagaataaaaagcttacatttttgcacagcaaaatggaagattatttccctcaaattcttttttttacatgaagttcttaattatcagcgtttcagtgaggttcctccaataattctggatgaatgttcagttgaaaatatcctattagacctcacctggaaacaaggaacttgactgtgtcctccacatccttcaccacgcttggttctacacaccgcatcatcactttcctcatcttccaaggaaagccatgcaaataccagtagtgcagagatatgttaacccaattgctacctaacaagatgttaagagtaacttggcataatttatgcaataaatattgggttgctatgtcatgttcactgtaggttttatctgagtttgattattgaatattccacttataggaagctagcaaaaggttcatatatctggcaattcctctaaaatgtatgaaaaacaattggtaggcaattcatatagatgcatcaactttaatctaaagacggtatagcctgtatagtatttaacaattggtgaaccactgaataattaataccaaccagaatagccccaacattcttccaaaaaatgaagaaagagtattatatactccctttgttt

SEQ ID NO: 58216 - DNA, 1469 bp, Oryza sativa
ttttcgtactaatcagattgatcaactgtgtttatgcattggtctgttgtcagtcgaaacgatcgcctccaagcgcagccacgcaccgagacagcccgtcaggtgacgcgcgtgcaggtcgcacttccacgcgagcagcagccctgctggtcgtccgtactggagcgggagcccgcaaggcgccgacacatgcgcatgcacaagcagtgcagattgaaaccagctgatgaaccaagaaatttcttcgtgcaagcatccgtgtgtgatccaatctacgtccacgcaaggatcgatcaacatgtatgatgcatgtaccaatcgatattcaccaacacccatcggattcttcaacaatcggacatcatcacgctgatacgctatgcgttggcatccgcggatcggcgaactttacatcggataaatgagatgagtgtcggtttcatcaattctaatactttgcaatagcgagagtaatatgctagatcatgcctctagttgttttattttctcgcatgaatagatgtatttgtccggcctttgcgccgactcttctcttgttatatcgccgaccacaaagtttggcaccacgcgcccgaacgcgcttaccgtgcacacaagaaggtgcacatacataatccgttgaattgaacgatggagtgctatcccaaacgacgtcaccccatactcggtaacacacgacaccacccagaagttgtcgtctatctagctaatatagtcgttgatctatgaatatattaacacacttgtcatcaccgatcttatggatcagcgcgcttgggacactgttgattgtgacttgtatgttaatccgtcatattgctatctgtatgaagtagatggtaacaaatccgagtcatcggcacctgcatgcgccgccgctgccgcctgcacgtagcgacaccttgacgccaccgcatgacgtcttcccctttgtcaatggttgccgaatcaatccagagactttccctcgtcaatccgccatctgaaacgccgactcgacggcctttcgagaccatctgcaacgcaattgacggccttcgcccgtagcgacgccgaggagcttacgcccgcctcccctcgccgccagtatgcacggcatgcctcccgcactaccgcacgcggccgggacgagggtcgaagccgccgtgagcgcccgtcgccgatagccgtccgccataccagcctgtatgccgagccgagtttcgtcgacacgtaacatggagctatgattgtcggatgccggtcacggcttgatgccaacgaatgccggtgtcggtgctactagatgttgcaccgccgttccgcctctgagcatggcaacttgctatagtcgtccatctctactaagggctcactagcacgtttgccattggttccatccgtcgtctccattgaagaatggcaattggatcatacctcacccacttcttgtgggagaaggtcgtaat

SEQ ID NO: 58217 - DNA, 36758 bp, Oryza sativa
aatcttgcattcgttcttttgagataatattttacaatacacgagttacattatagtttagattaagttcaacatgaagaacatggttaagctcatgtagagcatctttatcttttgctttaggcatagaagcttctgcattagattactgaattttttttttatataggtcatctcaccttacctatattgcctttttttacctatagtaattctttaaccttttgtggaataaaattgtgaattgtatgtctaaaattgaatgtaaatatttgtcttgcctattatttgaagtatttttggcgaatgtattcttattatccactaagcctcaatcaaccaagtaggttgatagttctaagtgcattgacgccatattggcatacatgtaaagttgtttacttatacacatgaacaattagaatatttatggttaagcattgaagcttaaatatatccacccgcaaccacattatttcttttagaaaagtcgtaccatgaagttacaacaaatatgtgggtttcacgacaactattttgtaggttttcttacgattggcgtgaaaagggggaggaatatgtgtatttttgcaatttatttcagaatatttgtgataaagaagcataagaaattgtggatatgtggcaggcaaattggtgtgttataggtcaaatgctagaagcaaaaatagcccaaactattagcgaatcttatttgggataattatgaattattgttacacaatgaagtgtgttatttattggccattgaaaattgcatattcatcaaggaagtatgaaattgcatatagctatttgaaagctattggtttacttgtagtatacaatatcctaaataattaatgaccttttggattcgaatgattctgaatgatcaaatgacaccacatttactttggcataatgaataaaagttagacatatcacccaattaatttattggcatattcaagaagaataaatattctcgtaggataaatgtttgggtgatttgaaaagttccatgatggttaaactatgttcatagatcaatattttagagttatagttatgttcttgaagacatcataaagttatataatactaacacatccatcttatgatcatatctatgttgcataaatataaacatgaagtttattgatccaacttaattcaagaattgaatatagtatcagtaattggatcaagtcttgggcaaataaaaagagctagaaaatagagtaattttgtcgactagtggatatttgtttgggcttcattgtcgcagaataataaccctctatgaattgggataacctacagtattagggatgtgcaatttttcatgccattgcattaatttttatgttagctcactgcatataatatatttaccccctttattttatataagtgcgtgttcaatgaatgaacatttccttcatatatcaccaccatagcatacatatatgggcctccacatgaagttggggatacaaatagaccgaattccattaatccagtgcctatgataggggatttttgtgatatgctattagataaagatcaaatatcggcatcagggggagaaaagcccatgtgttaaagatgccttatattttcaagaagaaaaagatctttataagtaagaataacgcacaagccaaactaaactagaaggtttagtttattctcctataagccagaagcgggagcttgccagataattatgaattaaaggagtaatcaaaagttatgtttacttgtagtaaactttctgctaacagtggtataccctgggttttgaatagtatatccacaaatgcagagtgacatgttagtcaatgttctaaaatctacggggacgcctgcggattctaagatctaatgactattgtcaatgtacccattaataactccttacaactcttgtagagtaatcaccatgaaaaggtgaattgcttcatgaagagattcatcatgaagatgaaaacccagaattaaagcgcgcacatctatctaattctgggatgcggaacaaccatacatcttatgtttgggaaatgactaagatatggtttataataaattaacctcacgaaatgagtatgtggagaaaagaatagttgtcgacaacatcgcctttatgattgctaatatttctctaataagaatccggatccggaaccaaagtccatggcagagttgcatagtagcactcatatcaggtctattgaagaaagcaatgaggttgaaccatagtcgctaaataagtctatgtgaacatggaagttcagaattaataggaaatgaagtggtgaaaagcgacggtttatttggtcatgggaaagactgatattcttctactataaatgtattaaattcggctatatatatcactggtaaaaggcatgaatgaataaatgatatgcagtttatgggttatgaaaatccatatgaagttttcgctagaaagaaaacaatttcgcaacatatatgtaaatctcatactaattagtgtcatgaagcacactatattatcatgaagagaattgcaagactcgtagaagagtttatgatgactcacaaagagtttttctcctagaagtgagaatatttctcatagcagagaaattgacttccggaagaacaagttgatccttgtaggactacgctaatgtatgaatcaccggttaatctccacataacaccaataactcttactcccatgaagtggacagacccgttcaaacgaataaatttgaaaatcacatccactagcatgcaagtggatcggtagttttctacatactatgaaggtgtaagattttatatatcatgaagatatacttatcaatggtatttggcaatcttattaattcccctaatgccaaaatatagaccggtttatgtcactctaagtggtttaagctaattgttgaagattagtgaaacaatcaaattggtaattattgataaatccactaagagaaagttgcataatatttaatctcttgtattgagctaattattttatacataccgcatatgtgtatcgttgcaacttattttcccatagtcctccgtaaggataaaactttgtttgtattgcacatttgaataagtggttatacatattgctcctatacgttgatttatttctcatgttcatagtagaacttatgaaataagtaaacgaaagattaaacattgtggtaattttattttcattattttacacattaataaaaatgtggttatgatattggaacatggaagtttcaacggatctcttcttgagggggagcatatatgctaaacattgattatcatacttaagacttggaagtcttatttttgatttaccaagaattaatcaaattaatcattgttttgataatttaccttgaaggttactaccgctatattgttgtgttaatccaagttgattaatataataatgcatatagatcattagctatttatgaagaatagtcgatcttaaagattatgcgatcaagaagatcatgtgttgtactctttttcccttagtgagtttttacttgaatatttctcacgcaaggtgcaacaagtgcaatataactagcgtgtacgatgtactcctttctcctatccttttctcccactaggtttttggatggagtttttaatgagacatgtgtatagcgcggtattcgtccaagggggagtgttatgaaactattatctcctgccagagataaatatgggctcataccaaatatatggatacgtatcctaataggactcttcctattatgggtatatataccgatagagaggtagagagatatgaatgtatccacatatgagaaagtaataaagctgtgatgcctctccctatatccgtgttcattgtttatctattatgtgcttgtatgagagatcgtcgtcgtctactccggatcagcaaataggccactagttattcaatagaaacaatgaaaacaggttgacagtgatttctctctagaatcttgtcgcccatctcggctaatcttctggttgtaatattctcactacacccttcacagatctactgccatctggaacatgatcatctcttccgttatcttgttgattaccctgcttttgaaaaccaatcgatctgtttccctctttccaaatatcccacaacacaaagatgaattagatcggataccttttctttgtgttgctcatccggcccattcgactgtccgcactagtttcaattagtgatctgttccctgatacagcggctgaaagaaaattctgcccaattcttttgccaaatccctgctccaactgctagcgagtatgagaaatctttcaaaaggtgttgcatcgtccccatgttccaaaacataaatatcaaacacaatagttcttgttcggtcatcctcgactttgtagtcactctgaaatccatagccgattgtagtacagcagccaagcaaagaatctttggttagattgtcctaggtttcccaaacggtttatcattttccttggactaaatgccatattacacaagggtggggtttgtagtatctaactctaaggtgcttagccagcttctatcactatgaactggcgttgatacatgttgcggcttaaaaaccagtgctaattataaatattagtgccaatacgttcttagttataactggcactaatggacaagactacatcatgccagataaaaaactacaaaatggtcttagctacttattttattgtatctacctcatatagaaggagtaataatcgtggttttgctttcatacaaaacggtcttagctacctaatttaatacatccgcctcatatagatgaagtagtaatcgtggttttgcttgcataaataatggtttagacaattgcaggcttgtagctgactcttgaagctcaatcctgtcaccacctggtggtatgctccaactgaacccctgcagaagccttgcaaatagcatcattgtaattgatgttccgagtgacacggcaggacagccacgcctaccagcactgaacgatacaaaacgtaactctggctcagctagcaccacagtaccagtatttttcagatgtcgctctggttggaattcgagtggtttatcccatgctctagggtttcgaccgagcccaattcggcttaacatgacatggctaccctttgggatcatgtatcccgcgacggtggtgtctgcgatcgcgacatggggtgggttgaatgggtggtaggggtggaggcggaacgcctcccggatacatgccttgaggtatgtgaggttgtgaatgtcggattcctcaacaagcctttctctaccaacaaccatatcgagttcatccactgctttcttcatgacctttggattgttcaccatctctgccagtgcccactctacagcatttgatgggttgtccacggtagcaaggattatttcctgcggccataagatcaaattaaaacagtgttggattttcatccttcaaggggcaacctctaatatgcctttaactctttatacaatcaaaattttcatgagaacttttggaaaattgacaacaatattaagtatgtactgacatctactgaggtcacaacagtcaaatctagactggacaaatatatagaaaacagaagaaatccagagatgaacactacaatgttaatgttcatatatagttttgatctgtcccttttgtttcttgatgcgtgggttgagtttagaatgagataatagatatgcattatactagacttacaattcttttcaaacattttcatagctatttttcaaaaagaaaccatagatattttgcacgttcactatcaaatcatcgtaacggttaattttaacttcaaaatgaatgaaacccaccatagtatatctttacctataacgaaccaaaggcctcactaattatttctaaaatataatcgatcacttctagcattagaaatttggaccaaaacataagtacttcaagcatactatttttcttccgaggacatatctatatagtccaagtttgaaaaaaaaattaatagagcttattaccagcgtttctgccttgatctcatctactgacaaaaacggtttcccttgtgcatcctccaaggagatcaacacgtccagaatttagaataaatgttatattttttaataatgtttttgtaatttagaagctatatactcccttcgtcaaaaaaagacaaaccctaggttttcgtgtttaacgtttgaccgtccgtcttatttaaaaaaacttacaaaaaaaattaaaaagacaagtcacatataaagtattaattatattttatcatctaccaacaattaaacgttggatacggaaacccagggtttatctttttttttttttgacggggggagtagtcgttacatttggaatagtaccattcaatactctcaaaatgataggaaagaatactaattactctagttcggtaatactagcaaagtgcccgtcgtctcgccggccgccaacctggcgagcacgctggcatgaaccagctcgtcgttggtgccactgatctgctcccactccccctgacatccgcgcttctccccaatggcagcccgatgaggagcggaaggaggaagatgggccggtaccgatctgatggacgggaaagggaaggaagacaagaaatataagggtctctgaccggaaatgctaaggggcgatcgatcgcccctagagcgctctccacctggtttcctttttttaccgcattactttcctattttagtaaatttatgcacctaaagtttgtacatcttaattttacacatctaaagtctagagatccaaagtttataaataaaaagtttatatatctgatttaaatttgaatttgaattcaaatgttttttatatatagtatttctatacatctaaaatttatacacctaaagtttatagatccaaagtttataggtcaaaagtttacatatccgattcaaatttgaatttgaattcaaatattagtttatagacccaaagtttataagtcaaaagtttacatacctgttttaaatttaaatttcaattcagatttattatatatagtatttccatacataagttttttcaactttgtgttttttattttttaaaaatttatggtgtagtaggaagagaagaaggggagaggaaggaagagtagtgtattggggggatggggggtgattgcctggggcgatcacccgcccattaggcggccccatcactgacagctgggcaccataggatgactcagcaaattagaccaagtcaaagcaccacatcagctaaactgctgagggagacaaattacatcggttttaaagtgaactcattccatagaaaaaaagacctgccggagtgaatttggcccaatcggcccaacaagctaaaccaacccaattaactaaccctaaaactccggctctctctcccactacaaatcgcacgccgcctctctcccactacgcatcatgcgtcattttccctgcaccacatcgctcctctctcccactccgcatcacgcgctgtcgtttttccctgctccacatagcacttcctctttcgctctccgtagcggaccgtgcgtcggcatcgctgctgccgccaccgccaccttttctgccacggttcttacacctcctcctctatccgtacatcgttgttgacgcaagaaacacacactgccctgggaaatctgcttagctccagtgcaggtccaaaggttgacgagatgcgggtgtgccagtcaatttaatcctgcaactgacaagataagcaaatagcagatcaatgagccgatcagctgacaagccgatgtagtaattccagccgatagccgataccagccgatagcgattgggttttgaacaatcggttatatgtccaatgtagataatgatataaaggatgacaaataataataatataatccagtataaaccaatcggctaacaatatgaatagaacaagtattgatatgaaggttaaagcatacatcagctggaggtacgatgtcataaaatccataagattagatagatcaatgaaacctttattgtcatcggctagacccaacttatatattatgcaatccttataagcggatgcaatgtccataaaacatatcgactagcaccccgataaaacactagtatgaacctatcggctcatcaagatttatattatcaacaacaatctagtaggtcggacctaaccgatgtagcacgagattatatatgacaatctaatactcaatgagccgatagatctgtctaatgtgatggatataacaaatctatttgtaacaacattgtgattgtagagatatatcggctaagacagaagattggacctaaccgagatagtcccaactaaaccaatgcgtctctaaacacaatgcaactagagatagaattgagacattaggtaggcaaatatatcaaccaaactagagcgatccaagagatcgaagtgatgcagccttgaacaacaccaatatagccaacagattcaccagggccggcggaacgcagggcttaccccttcgccggaaattgaactgaaccgatccagccccacgttaggtgctagattctgccggttgataagtaaaaacctcggaaaagagggtggcgatgcgccaacagtagtattattgatcgagagatgttttacaatgacctcgggtgtacatatttatacccatgggaagatactagtccttgtaggacaaaaaagaaacttccctaaaagataaaaggaaaacataaagtccttataggacactaaacacactttcctaaagataaaaggaaactaacaaactattcctaattaatagataacttgccatgccacatcctccttgaactcggtcacttctagataagctttctttaatagattaatttccttaaccgaatatagcaggaatccgactattggcgttgcgataattctcttaggggcttaccaaatttccccgctaacacatgccccccaattttagagtatgagaactcatacttgaaaattatcttatgtctgatcttggtaactctaaaattgatcttcctttgcttcttgtaatcggctttcatgagccgatactgtttgcattagatgagccagattgtcaaactcgtggcaaaagaatatatctatgataggtgctgacaatccctggaatgcaagatctgctagttgctcatcacttaggtgcaaaccataacatcgactgcggatattacgaaatctcttaatattttctatagccgattctcctgcttgttgctgaactgatatcaaatctgaaagcttcatctcatcgacgccagcaaagaagtagtcatgaaatttcttctaaagatcagcccatcctatgatagaatgtgatggtagagatgaaaaccatgtgaaagccgatccagccaaagacaatggaacaaatctaacttttagagcttcttcagccgatacctccccacattatgctaagaatcggctaatgtgttccattgtagatgtatcatcctaccctgaaaacttggagaaatctggaaccttgtatcgatgtggcaatgaaaccctatcaaaccactcaggatatggtagccgatacacagaagtatgttccttaggtttgattccaaaccactcctctattatctttgcaattctatcggccaaatcttctccataccgatgtatttgaattccctctgaccgatattgttgatatgcctcatcatgtcgatactgatatgtttaccccccgagccaatattgttattgttctgcaatctgccccccaagctgacgtctttgaacaattaactcatcaactgtcaatttgatcaaattttgcaatgtatccgccaaaacttctgattgataaaatactagtatgaacctatcggctcatcaagatttatattatcagcaacaatctagtaggtcggacctaaccgatgcagcatgagattatatatgatgatctaatactcaatgagccgatagatatgtataatgtgatggatataacaggtctatttataacaacattgtgattgtagagatatatcggctaagacagaagatcggacctaaccgagacagtccccactaaaccgatgcgtctttaaacacaatgcaactacatatagaattgagatatcaggtaggcaaatatatcaaccaaaccagagcgatccacgagatcgaagcgatgcagccttgaacaacaccaatgtagccaatagatttactagggctggtggaacgtagggcttaccccttcaccggagatcaaactgtaccgatgcagccccgcaccacgtgccagattccgccggttgataagtaaaaacctcagaaaagagggtggcgatgtgccaatagtagtattattgatcgagagatgttttacagtgaccccgggtgtacatatttatacccatgaggagattctagtccttgtaggacaagaaagaaacttccctaaaagataaaaagaaaacataaagtccttatagtacactaaacacactttcctaaagataaaaggaaactaacaaactattcctaattaatagataacttgtcatgccgtattcttcttgtactcggtcacttctggataagctttttttaatagattaatttccttttccgaatatagcaggaatccgactattggcgttgtgataattctcttaggggcttaccagccgttttggtcaaatccaagcagcgtgcggtggggaggtggaccgagtgcatcgggtttcatctgagccaccgatggtcgtctgctcctccctgttgccccctcacgccggccaatactcggtgactcaaggtgagggtatggactatgagcagcaggaccgttgatgatttcaccgatttttatttcttcatttttctttttcaagtattatcggtcggtttagttccgatgcatgttagatttctgattgctcaatgggtttcttaatcgatgtttgatgttgtgatttgtcctccttatgcgattaggattttatatggatctctgattttttttttctttggccaccgaacgcgattacatgcttgcggagatggaacacgccgcttggtcggacttatggaaaaaaaaaattgtaacgatcagaaagttactgatttttcaattaattaagattaagatttggaaccttttcaacagaaaactattttgcctttttttgaaattttcatcttttttagtttagaacaatttatttaaatgtgatcaaattttgttcaacattaaaaattttattttggaccaaaattactacaattttcgaattttctgtcctatcagcgcagccaatagctatacacaaaccgatatatattaatcactgggcatgatgatgaagaggaagacgaagatgataccaacatgagagatacggaagttaatgaaatagtagaagatgcaaacacaatattctctaatgagaaaataaataaaacaatacagaagaaatctctaatagaataaaataaatatataccaaataaaaaatacgtaagggttctggtaaaatttagatgtcaaaatttagaggttagatgatacgtatagtaataaaagatagcaatcaaattgaactatattttgatggccgtattcatggtttcatcttgaacagtgatgaataaattccttctagaatactgaaataatagagattcgagaccatgtaccaagtccaaacctgtccttccaagaggacctaattattcctctgctgccagactgatagtacctaatttaattactcctccatgcacggtcaagagaaagacgtatacatctgaattcgattgatgatagatcccagcttttctacccccagatcaaactggtgacctccaatcactaccatctttgatcggtctgacaaaatccacaatagtctcggttccaaaaagaaccgagactaaagattgtttttagtcccagttataaaaattttgatctctagtcccggttcatcccctgtcagatgcatgtcagggggccgaggatctttagtcccggttggtgtcaataaccggcactaaaatcaccactttagtcacggttggtaataaagatcatctagatctttagtcccggttggtattatcaaccgggactaaaattgaacacgtagtatataatacctatcccttatcctcttctccacagttacaacttagcggatcgaatctctccccctctcctcagatctctcctctctaactctcttcgtcatcccctctcctccacctccccttactcctctcctccccctcctcccctaacggctgccccctcctccccttcacattcagcgggccggcaggcgtcaatgccgcgtgcggcagcgtgacgaaggcaggcaaggccgcgcccggcggagggcaacgggacctcggcaggcggcgggcggcggggccacggccgccggtcgtggtgagcggcggcaacggcattgttttttctttttttttaatttgtgattcactgagatgtacaaatttgtgattcattgtttggatctgtgatgtatttgagtaattttttaggattttgtgatgtatttgatttgtgtgtataagtaactttatgatttgtgatgtggatttggtgatgtgaatttgggatgttactttgatttagggatttgaggatttgcctacttgattcgggagaaaataaaaagaaaaaaaagaaaaagaaaaggggaccatctggtaacatcaaccgggactaaagagagaggatctttagtcccggttagtagtaccaaccaggactaaagatgcatctttagtcccggttatttcaaccgggactaaagatggacatctttagtcccggatcgttacttccggttggaaaaccggactaaagaggattcccaaccgggagtaaagatggtttctctaccagtgaatgctttcataccaatcaaccaatcagaacaatctgaccttagcttctatctcaattcgaggggacgcctctcaaccatacacagatgcatgtactccctccatccacaaaagttacacctattagagcaagtataatagtgagctataagcctactatatgcttttgtggagaagagaggtaacaaaaacttaagggggttggttctcatgcaagagctatcttaacacaatctccgagataaatacattaaatttataagtgagagatagagagaggaaaagaaaattgtagccaaccatatagctaatctattatatgtgttggttttaagattggctaatagtaggaagtaagctatactattatgcttgctcttacatttgtcaccaagacaaaaaaaaaataaatcatcttgtatgttataaaatcaaggagtgaatgcaatcatgcaaccaaaaagtatttagatgactccttgggttctaatcaaacatttaatttatctcctaatttaaatcttgaatgcataaagactataaatagaaacaacttatttgtaaaaactaaaatgtgaaatatgtctatcttttatatggatggaggaagtattgttttcgttagtctatctgtctggcttcttctttctataaacttaattacttcttcatatttctggcttcttctttctgtaaacttaattacttcttcctctgggacaccatcttctgccggctagatgccacacaaataaagtacaattcatcgaatattgactccaggatctgctgtcagctgttgcatggatgcattcaacaacacaaatgcacaatccatcgaagttaattccagggttctagtttctctaacctttgccgtccatatatacagcttcagatcatgctgttttagcttccaggattttgttaatggcgaaggatgtcgtcatggccacttctcgggtcaggacagagataaattagtgagatgatatttacgaatatagatcagaaacttgcatgatgagataggtatatggttatgtattgtttagatgggctctagatggggtttaaaattggatagagatagaccgctttaaaggtgttatgttcgatttgatttatgaccaacggtgaagattatcctatctatttaatcaaaggacacattttcctacttaacgtgggactcgtagaaagtgacctagtatagctattcatatagatggtatatattgggaggtatgtctctactcaacatttaaatactaaatcacctatccgtgttgaaacactaaaatagtaaatacgggagacgttgtattcaatgttagataacaaaatattgctttcaggttacaataagggaaattcatgatatttatattttcatcatagaggattttttcttgttccctcccatttggtaaatattgtaactcaaacaatagaaaaatagagattgaccataccacaaaacaatacatatgtgcatgtaaatcatcggaattcatgtatcaatagtaggggcaacaaccatggatggatcttactagctgcaaacataatttcttttgtggttcaacatctcgacgtctaaaatttacaggtcagatgataggcagagatatctagatgtaaaaaaatttatatacagtaataaaaagtagcaatcaaattaaactatacttttgtgtccatattcatcatttcatctcgaacaatatgaataaattcctttattgtaataaaataatggagactcgagactttgtccaaagtccaaacctgtccttccaagagttcattattattactatgttgccagccttatagtacctaatttaattactcctccatacaggggcaagaaaaagacgtgcctcttaattcgatggatggtacatccattcatcccagcttttctgcccccagtttgaactgtcgacctacaatgcttttatacgaatcagccattcacggagatcaatctgaccttagcttctacctctacttaactggacgtctctcgaccatacaaagatgcatgcataattttcgttaacctatgtgcctggcttcctctttccatgaaaataaattatttcttcctctgcgacaccatctgctaccgcctagatgccgcacaagtacagtacaattcaccgaatgttgactccaggatctggcataacccatcgtccagatgcattcaacaacacaaataaaaaattagtcgaaggttaattccagggttccagttcctctaacctttgacgtccgtatatacagctgcagatcatgttgtttttgcttctgcggttttgtcaatggtgagggagttcgacatggccatatcttgagtcgagacggggataaattagcaagatgatgtttacgaataaaaatcaaaagcttcaacatgagatacatatacggttatgtaatggttatatgggcattaaaattggatgaagatagatcgctttaaaggtgtgatgtgcgatttgattatatgaccgacgttatgattgtcctaactatttgatcaaagggcatattttcctagttaacataggagctcgtagaaagtgtccaattagtatttgtatagatataaaaggtatatatttggaggtttctctttactcgacatttaaatgttaaatcacctatcagtgttgaaagactaaaatagtagatacgggacatcattttatggagatcgttttattcagtgttaaataacaaaaaattgttttcatgttacaataaggggaattcatgatatttatattttcatcatagaggattagtggttcacgttcaattttgttctttcctcccatttggtaaatattgtaactcaaacaatagaaaaacagagattgaccacaccacaaacaatataaatcatcggaattcatgtatcaatagtaggggcaacaaccatggatggatctccctagctgcaaacatcagttcttttgtggttcaacatctcgacatctaaaatttacaagtcagatgataggcagagatatctagatgtcaaaaaatttataaacagtaataaaaaatagcaatcaaattaaactatacttttatggccatatatattcatcgtttcatctcaaaatataatgaataaattccttctattgtaataaaatagtggagattcgagactttgtccaaagtccaaacttgtccttccaagagttcattattattactatgttgccagccttatagtacctaatttaattactcctccatacaggggcaagaaaaagacatacctcataattcgatggatggtacatccatgcatcccaacttttctgctcccagtttaaactgccgacctccaatgctttcatacgaatcagccaatcatggagatcaatctgaccttagcttctatctctactcaacgggacgtctctcgaccatacaaagatgcatgcatagttttcgttaatctatgttcatggcttcctctttccattaaaattaattatttctttctctgcgacaccttccgctaccgcctagataccgcacaagtatacaattcatcgaatgttgactccagtatctgccataagccgtcgcctagatgcattcaacaacacaaatccacaattcgtcgaaggttaattccagggttctagtacctctaacctttgccgtccatatatacagctacagatcatgttgtttttggttctgcggttttgtcgatggcgagcgagttcgacatgtccacatcttgagagtcgagacggagataaattagcaggatgatatttacgaatataaatcagaagcttgcatcatgagatacgtatatggttatgtaatggttagatgggctctagatgggctttaaaattgtatgaagatagatcgttttaaaggtgtgatgtgtgatttgattttatgaccaacgtgatgtttctcctaactatttgatcaaagaacatattttcctagttaacgtgggagcttgtagaaagtgtccaattagtattgatatagatataaaagatatatatattgggaggtatctctctactcgacatttaagtgttaaatcacctatctgtgttgaaagactagaatattagatatgggacatcgttttattcagtgttaattaacaaaaaattgttttcaggttacaataagggtgttgatgcgaaaaacacacactgacctggtagatttgcttaactcctgtgcaggtcctaaatcttgctcttgggttcaaaggtgtgccagttgatttgatcctgcaatcaacaagaaagaaaggcaagaaaaccgtggttaaatccataaacgatagtcgatcggctgatgccgatgacgtatcgttcaaactatgggccgatgttattagcaatagatcagcaatgaagaataaagcaatataaaactaaatctactcgatcagctgtagatattaacaatatataatccttttctcgatctatatctggactaagtgattgggatagatcgaatagcacgtcgagacagtataaatcacatagatccaaagatacattaagatacgattatatgaacgtttatagcatagccaatcagatagatctagcatgtatcggctaatactccaataccactctatattaagatattaaaacagacaaaatatatcaaacagaaagcctaatatattctaatgcaataagatcttaatataaagggcagatttagcatgacaattaagcatataaagtacaaaatagctaaatcaggtaagatcggctgaaactccgacactatcctcgttagagatcataaaacatgcacatgccagatattgcaattatgaatattacttaatagatcgaactcaaccgatgcagcattaagcataaaaacaagtgcaaaatctaagcaagatagtgataacttcagaaagatggtagatatgcgatataatctagattaataacaagatctaactttatcggctactctttatcaggaaaaactagccgattgcgagttagataacgcaactaacaaagattatgaagcatatatgataactcgacaaattacataaacaagattagtgtatcttaatgatggaagcactaatcccgacaacgcaagctgccatgacaagtttacctcttgttgaagatcgaaatcgatgcagctcaacccgagagcaagaactcgtcgaaaacaaacgaaagtaaaaccgggtggtgatgcgtcgagagttttattgaactgttgttgtcaattacatgggttcgggttataattataccctagatacatgataggtccttgccggacacgactcttatctctaacaaactctaagatacacataagtctttacagtagacttttgcccaatcatatctctaagaaaaccacttgaaatatcctaattaatagatacaattgcctatctgagagcttatctccatcgtggcaatcctttcgtagcacgttgatcgattgcagaaacggttttataaccatctcaataaaatcggttgtatcggctgtcctctgtccaatccatctcagccgatgtagacttcagctaatgctttgccgaatccacttcgattccaatgctgaacctggttcataatttaccaaatttggttgttaacaaaggggaattcatgatatttatattttcatcaaagaggattagaggctcacgctcagttttgttctttcctcccatttgataaatattgtaactcaaacaatagaaaaacagagattgaccacaccacaaacaatataaatcaacggaattcatgtatcaatagtaggggcaacaaccatggatggatcttcctagctgcaaacataatttcctctgtggttcaacatctcgacatctaaaatgtacaagtcagattataggcagagatatctagatgtcaaaaaaaattatatatagtaataaaaaatagcaatcaaattgaactatactttgatgttcgtattcatcgtttcatctcgaacaataatgaataaattctttctattgtaataaaataatgaaggttcgagactttgtccgaagtccaaacctgtccttccaagagttcactaatattacaatgttacctgccttatagtacctaatttaattactcctccatgcatgggtaagaaaaagacgtatatcttaattcgatggatggtacatccatgcatcccagcttttctgcccccagtttaaactgccgacctccaatgctttcatacgaatcagctaatcatggagatcaatctgaccttagcttctatctctactcaacaggacgtctctcgaccatacaaagatgcatgcataattttcattaatctttgtgtttggcttcctctttccattaaaattaattatttcttccactgcgacactatcttctaccgcctagatgctgcacaagtatagtacaattcatcgaatgttaactccatgacctgtcataagccgtcgcctagatgtatgcaacaacacaaatgcacaattcatcgaaggtgaattccagggttctagatttttctaacctttgccgtttgtatatacacctacagatcgtgttgtttttccttccagggttttgtcaatggcgagggatttcgacatgggcacatctcgagtccggacagagataaattagcaagatgatgtttacgaatataggtcaaaatcttgcatcatgagatacgtatacggttatataatggttagatgttctctagacgggctttaaaattggatggagatagatcgatttaaagttgtgatgtgggatttgatttttgaccaacggtgaagattatcctattgatttgatcgaaggtcatatttttctagttaacgtaggagctcgtagaaagtgcccaattggtataggtaaggatataaaaggtatatattgagcggtatctctctacacgacttttaaattataagtcacctatctgtgttgaaagactaaaatagtagaaatgcgagatcgttgtattcaatgttaaataacaaaatattgttttcaatatagagattgaccatactacaaacaatacatatgtgcatataaattgacggaatacatgtatcagtagtagcagcaacaaccatggatggatcttcctagctgcaaacatagtttcttctatggatcaacatttcgacatctaaaatttagaggtcagatgataggcagagaaatctagatttcaaaaaattaaatatgttaataaaaaatagcaatcaaattaaaatgtacgttgatggttgtattcattgttttatatcatacaatgatgaataaattcctcaaactggcgacctccaatgctttcatactgtcacacccagaaattcactaacccaaatttcaagcagaatgtgtattaaaatctctgtccaggactagccagagtacacagacgataattgaaaaaatagatctacatcttacaaaaataataaaataattcttacaaatgcagcagaaaaataaataaactagacttaatcttcacgaccaaaagcatagcttcctccataaaccacaggcatcctcaacgttcagaacaaactcaatcctcatagaactcaccatctaaaccaatctctgcctcttgtggggaggaataaagcaagactgagtaccaatcatcgtactcaacaagtcatactaacgggaaggtatgatgcaagaatggcttattggatatttgcaataaaagtagcatttataaatcatattttgaataagtaaaataatatatgtaattatgcaatattaaatcattactttccaacgctaaaaccatgttacaacagatccaaccaaaccacctgaattacaccagttcaataagtcatattattacagtgaaactaatcacggtgagctggttgaccgcccaataaccgtgggcacggcaattcgaatagttttaactccgataagaggtgtacaactttacccacatgacatgattccacacatgttaccatgccccgaagtaccgccacgatactgcaaagggggaaatcgtgacaaaacccttcatataacccaccctaaccaagcatacccacatcaggtttcaccccctccttattccatgacgggcagtcccctctcgtgcctaagtaaatccagaaacaacagagaccaaaatccaggcccgaactgcaccatcgcctctacccttgccacggtatgtcaactaagttaaagttaagttatactctagatttagccttgagcccacgctggcttatggtaagtatggttagggaaagcggctaaggcggcagcagcttggctcggctctgctggcagcacggctcagggagacggcagggcagcggcagctggcacacggcagggcagggcagcagctgccactacaagagatcttatgatagatgacgcttcatttacgtcacaaacattgaatatttggtcacgtttcataatctgtgacgctcgcgtgacgaaaattcattcgacacctatcatgcgtctctaatggcgttctatgacgaaaccttatttttttcgtcattaatcgattgacgatccttctgtcggcataactttgtgatgctcatattcgtcattatctagctaaaaaacgttataaaatatctgatgacccattaaaatccatgtattgagcaccctgtttatgggcttagcccaatggcaagcccgactagattttagcctggcccatctatgatgtagcatattttcagcccaattctattatatccatttgcttcaatatcaaataataaatgggccaagtccattgcaaaagcccatacatgcccaaacattataccacaccattttcagcatgtcattattttcattatgttagtatcaaataacaagtgggctaagcccatataggcccaacaatcaaacacaataacaatccatatagcacaagcccaattagcatccaacacaacccgacaaacatccaatacaacacaaaatttacaacacagcaaatcagcaaatcagctggttggccactcgtgggaagtgcttgaactgcagcagggacaggaagtgcttgaattgcggcaggggcctcaccttcctcaggaaccccctatatcaaatacacaaagtgcaatagattagtcaccgattgactcattacatgataaaattgtgcctaaaaaatagctgaagtggaagaaataagttcaaaggagagaaaagggtgcaaccattgtttgaaataagtggtttcccgttgtccaagagcagataccaacgcatgcatgacaagaagtgcctatgtcgcttaaaattattttttgatctgtttattgttattattttcaacaagtcattgcaaaaacttaaataacacagattaacatctttctgagtttaaaattttgagactccttatttattttaaaagttttgacgacataatagctcatcaggaagtccaagcaacaagacatggaaaaaacataaatggatatgagtatgtccaattgtcacaaatatcttcgaaaaccaaatgtattaaagaacatgatcttattgcagatcaaaacgatgccattagcttgctatcttaacagttagtttgcctttctattcatgtacctttctactcatgtaatgctcaagctttaacagaaaaatgcaagaacgacaggaaccggtaagcacatagcataaataactaatcttctgtttataccacatatgcatatgctagcaaggtttgcacacaaagccctcattccctaaatgtttgacgccgttgacttttttaaatatgcttgaatgttcgtcttattcaaaattttttgtaaaatatataaaactatatatatacataaaagtatatttaacaatgaatcaaataataggaaaagaattaataattacttcaattttttgaataagacgaacggttaaacatgttaaaaaaagtcaacggcgtcaaacatttagggatggagggagtataatatttgtacaccacagattcacagttatagcagcatagctgcgctataatgtacagctccattatccatttgcaaacaagcctaaatagaagaataggcattgaaaaatacctcaagtaatgaagtttcggcaataaatcacatatatgaatcagggaggatagatatacatagaatctgaaaaaaggagagcaaggattgattagggactagggaggattgaatcgggaggaatgccacttgcttgttgctgctgttgctgcttgccttccgcctgttgcttcatgcctgctgcctgctgcctcgccgcttgctgctcgcatgtccctgccgcgtagccgcgccgccggacacgagcgctggatatgagaaacacataagattgttgacaaacaacaatatactatattcaaccatgaaactacttttgaggtgctcataatcccaggcgcccaacaaacgaacctaatattgcatcctcgatagatttacaggctttgagccttatgagcttcttattagatagagctatgggctttgagcccaaaagagcttctgagagctcatgagctagctagatctcggcttgttaagaagataccgactcgtttaattaattttacgagtcgagttgagcccataataagaagatgagaacaagcttaagcttttacagtaagtttgtaactgctaattggcatgttcttgtcaaaaacgttttctaagtggccatttttagcaacaggactaatccagaatgcatatacatgtaaatattattcagtaagtaagttttttcaaggcaatcatcagtatgtatgtttattttttcttgggatgtatgataaagtggttatgaagaactttggaacataaacggggtaaagaaagttgtgcagactcgtattaaaaaaagacagaattttcaaagaatcttttctctgaagcatactttgtcggtcttcatctccatgctcagttacttgagcgacctgctaacctcgtcagcatgcagagatccagagttagataagccaagaaatctgcacatgaaaaaagtatcacaatcttctttcatctgcatgagaaaaaggccaagagaacttcccagtttgatcagtttgggagaactaatgcagtttccctccctctgaagaaaggtagtcctatatctgaacaaataggatttttaatagatttatccttgcgatatgcccttgatgtgtttaaacatctgaataaattttgctccatgcatctgaaattctaaatgtctgatgctgcaatgtcgtgctaattgatgttattttattaagattgttccagtccagccctcgatggttggtactactacattacaggttacaaattacaagtctttgcccttttcatttttttttaaaaaagaagagatgataggaaaaaagaacagacctagacaggctactgcaagagaggacatggtgaagcagcagcagtaatcagccaccgccggtgctggtgacgccgaggtctggcttgccgtcgtcctcgctgcttgtatgaggccagctccaagaacccccgctgcttgctcctgtacagcagcctgcgcagcacccacccgaacacaacacgcccccccccccccccccgcgtcaacagggtgggggggggaaggggggggtgagatgcggcggcggctctcgtcgaaggagaggtcgatggtgctggtggtggcgccgttctgctgggtggtggggatgaagtgtgatcatcctgtctttcttagaccggacccacttaaatctagtagcttccataccttttataggtcataaactgtcctcacaagtcttttctgcacactttgtcctcactcgtgtgcacccgggaagaatttaccggtctgtcacctatctcaaattactccagaccaagtacgcttaacctcataattctttgaagaccagcttccggaaaagaagttgcaacctgttgatatgagtattctattaatcctattaagccctgggccgggatgttacatgaagccagagaggacgtggtgggctgggaaggccgcggcgaggaggaagagggcgccgacgcagggaggggagcacgcagcggaggtggaggtggagtgcacggctgccgaccctagcggtcgtgccgtcgtcggcgaacgagaggaaggacgaggcaggaggagggggtcttgtcgaatcccgcggcggtgcgggaagagaaagaggaaaggcgcttgtcggggtcactccaccacggcacctggtcaagcgtcacggcaagctccacctcgcccacgcccaccgccgccgccacgaggaaatttatgtaaacccatataagagatatgtaaattttatgaacaatgttcctatcggtttgtcgaatgatgaaataaccaaaataaaagttatagatattgatgagtaatacaaatttgttattgacgactttttcagttgaaatcatttagtatttgaaaatgttgtttgaaattgtcataatttgaaattcaaattttatataggtcaatcaaactcagatggagaaataaccaaaatacaaaattggtagatctcaataatttatacaactttgtttttggcaactttttcacataactttatttagtataataaaattcaattcaaagtttttaatattttgaaattaattgagaggagggaggcaaaatggacttctggctggagggaggaggggaaggagcagcttggcggctgggccggctggttgagtggcgcggcccatgaaggagtagaggaggcccgcagggccggctggttgagtggcgtggcccatggaggagtagaggaggcccgcagactcgggccgaggtgggccgaggagaaagtggggagagggaagggaatgggagtagaaaagaggccgagcgggctagcggggagtagaatcagactttgggacggattcagcccaaatgacaaaggaggattgtttttagtttttctttttaataaactctgttaattttttttatcgcttaataaatatttcggtgctctgagaaaattcaagtaaacatccaggacatattttagaccgaggagaacttatgaaagatactttgggtcacattcaaattttttcttgcacgtattttagtgtttagcattttcttttaggattttagtttattatattattccttttagcgaataatttttaatttgggtgaatttatcaggatgtgacaattattttagtgcgttacaaagggcagttcaagcattcgtcattttaaaaagaaaaaaaacatatgataaaccaacattgttatgaacttgtgacatttgttggttggtctcttatgacaaaataatattcattacaataaaccattagactagtttatgatgatctgtatttgatcttagtgacgacaaccccaattttgtcactaatcatcatcatctgttgatgcgaaaaacacacactggcctgaaaaatctacttaacttctgtgtaggtcctaaatcttgcttttgggtttaaggcgtgccagttaatttgatcctgcaatcaagaagaaagaaagacaagaaaaaaccacagtcaaatccataaatgatagccaaatccataaatgatagccaatcggctagttgccgatgacatatcatttatctttgagccgatgttatgttagaatcgatcgacagtaataaatgaataagataagactaaatctactcgatcggctgtagatattaacgacatataatctttccttcgatgtatatttaaactatatgattgggataggtcggtcgccatgccgagacagtataaatcactcaagtcaaaagatacattaaagcaataattatataggcatttatagcatagctgatcagatagatctagcatgtatcagctaatactccgataccactttatactaagatattaaaacaagcaaaatatatgaaacaagaaagcctaatatactctggggtgataagatcttaatacaaagggcagatttagcataacagtcaagcatatgaaggcaaaagatagctaagtcaggtaagatcggctgaaactccgacactatctcaattgataatcataaaacaagctagatattacagttatagataatatttaatagatcgaacttaaccgatgcagcattaagcgtaaagataaatgtaagatctaagcaagatgatgaaaacctctaaaagatggtagatactctgtataatctagattaataacaagatctaactctatcgactactctttagcagtaaaaaccaaccgattgcgggttagatagaatcactaataaagattataaagtgtatatgataactcgacaaattacataaacatgattagagtgtcatgaagatgtaagcactaataccgaaaacgcaatccgccatgacaagtttacctctagttgaatatcgaaaccgatgcagctcaacccgaaagcaagaacatgtctatacaaacgaacgtgaaaaagggtggcgatgcgccgagattgttattgaactattgttgttaaattacatgggttcgggttatatttatacccgagatacatgatatgtccttgccggacacgactcttatctctaacaaactctaagatacacataagtctttacggcagacttttgtccaaacatatctctaaggaaactatttaaaatatcctaattaatagatacaattgcctatctgggagcttatctccatcatgaaaatcctttcgtagcactgatcgatcccagaaacgatttcataaccatctcaatgaaatcggctatatcggctgtatcggttgtcccctgtccgatgtcatctcagcagatgcagactccagccgatgcctccgcagccgatgcgcactctgttcttcgatcacaacccctttgccgaatccacttcaattccaatgccgaacctagttcatcacttaccaaatttggtcgttaaaacatgccccccaagtccgcgatattggtaatgttgcggatttgctcaatttccttcccgagtagaactagggtttccatctccgattccgttttggccgttaccacgctttcttttaaatagtaaccactgcttggcacttttcacagcgtcagcttccgttttaaccgctctagccaaaactttccccaatctcttcctcgatctttccggcgacatctttgagctttccggcgatcccgcaagcgactcccagcagcgccgacctccatcaccgacaatgtcgacctccgccgatccttcgagcgcgccaactgccgagtacgtcgaggtaggtaccatcggctaaatcccctcttttacgtacaagattggttcttctttcgctcaatcttcgattttctttccctgtagcatctttctcatcaagttgcggttcctagcataaccgatgagcattaattctttcttggtccaatcggcaacccaaaccccaccgagttcatcaatggtgagaccaaccgaatcccctttagatttgccaaccccgatttaagtctctggaagaataccttcaaatcttggccctcagccgaaaaaagctagccagcttggtatatgagggtatcagctagcaagctaactcactgggcagaaattggcatagtccaagctttagctctgactgcagtagatatagccaaagatgaacccatgatgacagctgcaacctatttctagtccactaccatgaatgcctttctcttttcccaaggaccgatgactcccactctcctagatgtcacaatgataattggcctagatataacttcatcggctaacccggtcagcttgaatacaacatccacctttgagttcaaaactcagaacataggtggctggtcaggttttgttgcaaaaaacatgggcaatgggccagtaagtccaagggaacatacattcttccttctgatgtggttagaaaaattcttgttttgtggcctgagctgtggtcctactgccaactggcaacacatagctgaaaacctagtggagaagaaacaactccctcttggaatgtatctgttaggctatttgtatatcctgtacaatctaagccaacatagatatttaacctaatcggctgccttccaataatagatgttagccgattgaaggttagataacgatattgtcgaagattatacagaatatatgataactcgacgaattacataaacaagattagagtatcataaagatgaaagcactaatcccgagaatgcaagccgccataacaagttttacctctagttgaaaattgaaaccaaagcagctcaacccgaaagcaagaactcgtcgaaacaaaacgaaagtaaaagggtggcgatgcgctgagattgtattgaacgtgtgttagattagttacatggggcttgggatctatttatacccgagattacaaaacatgtccatatcggacacgactcttatctctaacaaactctaagataccataagtctttgcggcagacttttgcccaaacatgtcgccaaggaaattacatgaaatatcctaattaatagatacaattgccttctcaggactctatccatgcatggcaatcctcatgaagcacattaacccaacccgacaacgtatgccatgtcatattgtcggattttactcaatgggctaaccttgtctagctcggactctgtcgatcctggtcacagccgattcggactttagcttattcttgctctgcttgcgggacgatctctatcttggattccacttcgattttatctttgtctttgatactgaaattaccaaatttggttgttaacacatgccccccaagtccggaatatttggtaatgtttcgtttttgccatatcgtatctccgagagaatatcgcacttgccatttttccgaccattatcgctctgctttaaatacttgtccccgagaaacttcacactgttacttccgttttcaccgcttaagccaaatctcatgttctctttctccggcgatcccctcggtgcacaaggcgacttcgaagcaatctcccctccggccagacttccgcccgcagagatgtcgtcctccgccagtccgtccatcgcgccatcggccgagtacacagaagtaagtacccatcggctagatcttcttcttccgcagcagattggttttcccttgcttatcttgttttcttcttctctgctcttgtttgcatctgcagcacttgtccaatctggtagcaattccaagtttgtcacatgaaaaccactattttcttggtccaatcggcaatcttgatcctactgaattcatcatcgccgaaaccaatagaatcccctttagattagccaaccctaatcaaggtcattggaaaaacatcttcaagtcttggccatctcttgagaatcccccccccctctgagaaaagctgggccatgtggtataagcgtgtatcagctactaagcaagttcaccgggacgaactcggaattagccaggcactcgccctcaccacagcaaattcggctaaagatgaacccttgatggccgctgccacctatttctggtccaacaccatcaatgccttcctattcaaccaagggccaatgacccccactttgctcgacatcaccatgatcacaggtttggatgtgacctcatcggctaacccaatgagcttgaacaccaagaaccagtttgacttcagaactaagagcataggtggttggtctggttatgtagcagcatatatgggcaaaggatccgtcacctcccgagaacatgtagccttcttactgatgtggcttgagaaattcctcttttgtggatcaagttgcggccctaccaccaactggcagttcttagctgaagcccttgagacaaagaggcaattccctttgggcaaaatccttctcggctatttgtaccaaatgttaaacaacgcatcggctaagattgctgtcggctcaatcgttagcgcaggccggccatggtggttgctgcaaacttggctaaacttggtagccatgaaagctgtcaatcagccagccgtaacagaagctgaatttccgagattagagccgatcacaaatgatgatggagaagagcgcacccatcacagatgtatgtccgatggggagtatgcctccacaccagccgatgctggagcaaagttatcagccgaactgctcaaagactgggtctgcagtttctatgagggtttccaaagagatgctcgagtctggtttccatacgaggacttaataaactttgatctcccaggagactttagatttgaagacctcaactctgaaaagtatcaaaaatcaagagaagtcttctcaactgccattagcccatgcatctttcatattagcaccaaggaagaaatatacaagtgtcctatgaattctaccatccgatgagctcagctaggcaatttggaatgggacagctaccaatcggcttgttctttgccgataaaatccaatgccgaggagagatttcatcaaccctgatgatggatcggctactcaacatccgagagcaaaaactttgatagatggtggggagaatggaagcaaaacatattccatcagtcgacttctatgtatatgacagatctattcccagatgtcatctctcaggtatatctttactttgtcatttttgcttgaataattagtagccgacttgaatcttaactaatctatccctttaccttgcagaaaacagaatcttctcctccacgcaagagcaacagtggcagggatatagagtatgccccaggccttttgccaaacggtggtggattagctcctccagtcatcggctatcatgcccccaagacctcaagtctgtttcaagggcagatgagagaaccagccgatgttggcaggaagagaaagaccaaggcatcggctatagatccattggctctggctcccaaaaagaagaccaagaagaataagcctacgccagccgatgacttgcctgccttagatccatccatcgagcaagccttggacgaagaaaagattgaagaggatattgatcaagctgcagccgaagtaagtgacacagaaaaaactccatcggcttcacccaatcgaactcctccaactccctctgccccagctcatttctcaagggtacacctctctccttaatttcctcctgccattattttattcatagccgatcacttataaatctcatttttgcagaaaaagaagactgttgtgaggaagaaatcggcagtaacaacgcttaaaccggctccaccagtaagattgtcatatataaatcctctcacttatccgatcacagccgacattttacttaacgctttgtctttttgcagcctcctcctcctccttcaccacctatgcaacagatgtcaagtgaccgtaccccattggctacgggaagccatcatgttgaagaagaggaacaaccagccgctaatgccatcccagtaagtctttcattgccataagaacctagatcggctgaaactgtttgatatttaactgtcttcaaatttctcttttgcaggtcctggccgatctgttctcttttgatatcaaggattactttgatgaagaagtagaagaagaatccacaagcaaggctctagcgcctctggatgaaactgtcaagaaaacacttgaagacatatccattcggctagagtcatcattggataatctggtggccgactgtggttcgattcgggcacgatttgcagaaatccaagccctagtcccagacgatctagcaaacaccattactctagctgtgtacctcgagcaacatcaattcaagctggagaaggctaagcaatggatagccgatcggcgggagcggaaagatatcgaagccactatccaagccaattgggaactcgtgcatgaagagaaagctaagttagatcagctctccgccgggccgattcagtcaaacatagataagcttgaagctcgcaagattgatcttatagcccaacttgaagaatgcaatgccgagttgaatcttgaaaggcagaagctagccaatctcccaagtgctgttgaagaacataagtctagattgagatcggctataaaaaatgtggctgacatgaccaagtccctcaaattcatctctggaactgacacccaagacattcaagctattgaagaagtagatcaaattagacaacgggctgtgtcggctatccagcgttacttgtctagatgattggtcttgtaataggatagctcattttgtaatatatgtgcccccctaattttacaatgacgaaggcattaataaaattataaattgaactaagagcgatataaccatattggccattgtatatcggcaaaacacaaccgattacaatataaaaaacaactaagggcgatataaccatatcggctattgtatatcggcaaaacacaaccgattacaatataaaaaataactaagagcaatataaccatatcggccatctcaaggcgatgtaaacacatcggctatcatgtatcgacaacaccaaccgatcatgtattaacccaaacacttggttaatatttcttcaagtatttgccattgagtgctcgtccataaacttgcaacatataagcccctttggatacaaccttatagatttgaaacggtccttcccaattcggcgaccacttgccgaatttgttatcccgagtccctaacggcaaaatcaatttctacacaaggtcaccttccgaaaaagacttgggtaccacctttttgttgtaatgctgagcaattctctccttatctttggtgacttttgctagggcttgcaatcttgattgaaccaagtcttccctctcatcagccatgagattgtattattcatcggctgttaactcattttgtaactctatcctccttgagccgattcaaacttcccatggtaaaactgcctcatgtccataaacaagtttataaggatgaacttgaatcgaaccattacaagccatccgataggaccacaatgcttcggccaatctagtatgtcattgccgaggataatcggaaatcttcctcttaatcagtttaatcaaactcttattagacgcctcggcttgcccattagcttgtgcataatattgtgaagaattcaacaatttgatacccatgctatcggcaaactgaacaaactcatcggacaaaaagatcgagccttgatcggttgtaatggtttgaggaataccaaagcgataaataatatgctcttgaacaaatcgaatagcatccccagaatcaactttcttcaaaggaatcgcttctacccacttggtaaaataatcggttgccaccaatataaacttatgtcctttgctcgacggtggattaatcataccgatcatatcaatcccccaacctctaaatggccacgggtgctctttgaattgctccaaacttttgacaatcttgatatcctttgtactatttgaaacaatcgtccaacattgtcggccaaaaatatcctacccgccgaagcaaccacttcatcttatgagccgattgatgagttccacaaattccttcatgtacctcacctactacaaccttagcttgatcagcacttaaacatttaagcaacaccccatcaatcgtccaataatatagctcatcatccaacaaggtatacttcaaagccttatagcacaacttccgagaagccgattgagatggattctgcaaataatgatgtacatcgtacctccaatcatcggttgttatcgtggaaacttctattgtgacatccttcatcatcggcttgtaacccgatgccccttgagccaagtcattagcttcaatattttgctcccgagatacatgcttcaaagttaccagccgaaatcctttcatcaactcccgacacttctcattgtaaaccattaatgtatcatttttgcactcatattctcctgccaattgactaatcactagaaaggaatcacccataatctcaacagcatcggcttcaactttcttatgtaattgcaaccctttgagaaccgcttcatactcagcctgattattagttgcatatggcttgatagtatatgcaaactcaaaacttgccccccgaggaaaattataaccaagccgataccacaaccatgagtgcatactgacccatcaaaaaacaaagtccagggcacaatctcaaccgagccgattgagtcatcacgatgatcaacaataaaatcggctatagcttgccccttaatcgccttcggtgactcataccgaagatcaaattctatcaaagaaaatatccactttccaacccttcctttcaaaatcggagccgataacatgtacttgaccacatcggctttgcatattacagtgcattcattggataattgataatgccttaatcttgtacaagaaaaatataagcacaaacacaacttttccacaggagaataacttgtctctgcatccaaaagccgacgactcaaatagaacacaactctttctttcccctcgagctcctgaatcaagaccgagccgattgacttctcaccggccgatagatataacctaaaaagtatccccttttgtggaggaatcaaaactggaggagagctaagatattgtttaatattatccaaggccttctgctgttctgccccccaagtaaatttctgatcggctttcaatctcaacaacagtgtaaaaggttctaaccttccagacaaattagagataaacattctaacaaaatttatgttgccgatcatctcctgcaattctgtcttgtcctccggaggttgaatcttttttatcgcattaacactcctttgagttatctcaatccccctttcatgaacaagaaatcctaaaaattggccagccgatacgccaaaagcacactttgtcggattcatcttcaggccatacttcctagttctcacaaaaaccttcctcaaatcggctatgtggtcctctatttcctttgacttaacaaccgcatcatcaatgtagacttcaaccaaccagccgattagatcatgatatatgtagttcatagatcattgataagtagctccagcacttttcaagccaaaagtcatcacaacccactcaaacaagccgattgcaccaggacatctaaaagctgtcttatgaatgtcttcctctgccataaagatctgattataaccagcattaccatccataaaactcaatatcttatgccctgaagcagcgtcaaccaattgatcggcaactggcattgggtactcatcctttggtgtagccttgtttaaatctcagaaatcaatgcacaccctgactgtgctgtttttcttgataactggaagtatgttggaaacccactcagcatatcggtaaggacgaataaaaccagcatcatacaaacgtttaacctcagccttaataggttcgagcatatcggctttgcatcttctcggcggctgttggtacggtctaacccccggtttgataggtagccgatgttcaacaatggatcggctgagtcctggcatctcgtaatattcccaagcaaagcaatctctgtactcttttaagagctctatcaacttggttctgaat

SEQ ID NO: 58218 - DNA, 8901 bp, Oryza sativa
ttggctgcttaggagtaccttccagtccaaagtttttccctgtgttaactttagtctttgaccttctatgctttcttaatacaaacatacatgtcttttgtatattcgtgaaaaatttaacagaactcttggaagaatagactagtttcttttatctgtgaaaagctcttgtgtctcctaaatgtgcggtaatgattatagaggcctgttatggttaatgctgacactgcctacattttgctttcaggttgctagcatttttgttccaattgtcatcaccttgtccatgattacattccttgtatggtaagttcaacatatactaacacaatttttgagtgatactatgtttgaaacttcaatttttctgacatgtacattggctgcttttgtaggtttttatgtggatgggtgggagcatacccaaattcatggatttctggaactagcaactgctttgttttctctctcatgtttgcaatagctgtagttgtgattgcttgcccttgcgcccttggtctggcaacacctactgctgtgatggtggcaactggagttggagctaatcatggagtacttgtgaaggggggagatgcattagagagggctcaaaatgtaaattacgtgatttttgacaaaacaggcacactaacacaaggaaaagcagttgtgacaacagcgaaggttttctcaggaatggatcttggggatttcctcacattagtagcatctgcagaggtgaggttgaacttaagttgcttgtatggttcatatcaagctgtagtaaatgtgtttcggtattgtaactatgcttcatatgaatgtggtaatgccaaaatatgttttgctcctcagggttttagttaaaaaaaaagtgttttggtcttgttcatattgacttgtcaaaagtaaaaaaagttcttttgttttctactcaggcaagcagtgagcatcctctggcaaaagcaattgtggaatatgcattccatttccatttctttggcaagctccctacatcaaaagatggcattgaacaaagaaaagaagacagattatctcagttgctccttcaagttgaagacttctctgccttgcctggcaaaggagttcaatgcttgattaatgggaagagagttctggtgagtcacataagctaccataactcttccttgcccttcttgcagctgagttgaaaacagtgtacaagtctaacccatctactgctgtaccatttcttttaagcaaaccactgattatctagacataactgttttgcaggttggaaatcgtactttggttactgaaaatggtgtgaatgttcccccagaagctgaaaatttcttggtagacctggaactgaatgctaaaacaggcattcttgtgtcctatgacgatgattttgtgggtttaatggggataactgatcccctgaaaagagaggctgctgtagttgtggaaggactaaagaagatgggtgttcatcccgtgatgctcacaggtgacaactggagaaccgcaaaagccgttgcaaaggaggttagtctctaatctctattaccttccttgatccataatgttcatcatttacctgaacacctcttcatatacatgtctgcgattttctgctcttgcaggttggcattgaggacgtgagagccgaagtcatgcctgccggaaaagccgacgtggtccgctctctccaaaaggacgggagcatcgtcgccatggtcggggacggcatcaacgactcccctgcgctggcagcggccgacgtcgggatggccataggcggcggcaccgacatcgccatcgaggccgcggactacgtgctggtgaggaacaacctggaggacgtcatcacggcgatcgacctgttcaggaagacgttcaaacggatccggtggaactacttcttcgccatggtgtacaacgtggtcgccatcccggtcgccgcgggcgcgctgttccccttcacgaggctgcagatgccgccgtggctcgccggcgcctgcatggcgttctcctccgtcggcgtggtgtgctcctcgctgttgttgagaagatacagaaacccaagcctgacgaccatgttgcagataactgtagagtgacattggacgagtaaagagaaggtgtgttgacggctgttaagtaccaaattaaattcgtcaataccagcataagaccgtaaatataaaacatccaacatagtggtagagtttatttctaacaatttccacgagtgttggtgtatattcgtatgcaggtgacaaactacctaaattgagaagaaatatatatgaaagaggaggagaatcaaactcgtatccgaacttatggagttttggacccaaaaacctaattaaacacctccaaatgtgtcaaacattcataccaatggattgaggggaccaaaataagtgtccaggccgaaaaccggagcgaacatagccgtctcgggtttggtcgaaccctcacggaggccgttggcccaggcccaagttcagttcggtagaaatccgcttcccaattacggttatggccgttttcaccggtagaaaccgtcataagcatggacacttgtcaatacaaaagagaagatgctctttggatgcttggagcatctccatactcccaagacacttttctacctataaatacccctctcatcctcacttgtaaacagacatcaagatgtagagctgaattataagaggctctaagtatacttagggctctttatatgttctatagtatacttagaatagggagagagtaaagtagaaaaaattggaggaattccagagttgtcggtaatcctctcattattcttgtactttgttaattactccactttaatagaaatatcattctgagtaattaagatttgcttagtgagaattaattcttggttagttcctaattactatatgggatcattgttcactatggtctagtaatatgtagtgattgctttaatgcttggccaacgttagagtagtaattaattgcgtagacgcggtgtctggctaattaattttcagtgattactgtgtatctcacggtacgtaggtgggtgtagaggtggtgacaaccctcaagagcacttaagtcctccacagtacgtaggtgggtgtagaggtggtgacaacctcaagagcacttaagtcctcgtccggtacgtattagagcgacatctggaaatagcgggttgacagttcctgaagtatcgtgttaggattaaaattaatctttctatagacactgtttttcacttgaaaatcctctctaccatttgcatatgtttgctttgtgtccttggatgaaattggagaagagctgagcacacacgttccttgtggaaatcgatactcggaatactgaatactgaagctacatcggtattctccgtgtgcttgtagattttatttgtgacgttaagaaataccaacaacaatctcgtttaccatgtacgcggattcgaggctacttcaaagttaatgtcagggatattcacttgataactcggtttatggccaatgggtttcctttaattggtaatatcccctttacatctttgtttacatttctgaatgatggcgaaatatattatcctccaatgctagatgcacattatcactcggtagtgttgattggttcagagattggaatcaacaatggaaaatcatcaacattctatgtagttagagacagttttggattcattcactgcagctaccaccttcaaaactatggcgcactactagtttatttgtgacttgtcttaaattcttattatccagtttagtaggtggacctatctttgttcttatgacgaagcgtcaaatctatgtatgcaattatatttgtggagttttgattctcatcatggaggctcaaatctatgtatccagtgtaatgtattagtgtagtatttgtgaacttgttctcttgttatggatgaaagagacattatccttaatttatcgatttatgtatccaatccagtatttgtgttatttcttttattttcattatgaacgaaatagttatcaatttatgcatccaatccagtatttgtgttatttcttttattttcattatgaacgaaatagttagtattgttctggacatgttcgtgcgacggaaaaaataattacattacttgcttcaaataatttgttgcgtgcatgctggaacacattgggcatattttctttttaattaagtactacactaattactactagtaatcgtattgcacgtttcccataatatataagcatactcaaagtttaatgcattgattttccaatgatatgtatatcacacgacatatacaaagtactaaaagtataaaattgtctcaaaatagtactctagtaaataacatttacatgatcaacaataatattctatcgtgtgaccagtagaaatttatatggtaagcaaaccatagaggtttatatctcagttactttcaagacattaattgtcacgtaatagtactctagtaaattgttatcggaatagtactcggtgtagttgccttaactgcagtgaacagaaggaaatgtcgagtgtgaacatgctggaaacgtcttaaaaattgaaatggcaactctgtatttctggtatggacttacagtgtatcccgtgaacatgtccaaactatattagttgagcactggaagggatttcacactgcacatgtccatcatcctagcagttgcaacccctcctaacgaaagaaaaataattcaataaggaaaaacttatcaaaggccaatgattttgaacccatcccttcgtccaaagaaaccccttctagttgtgattctaagttatttcactctacaagtaaagtgatattcaaatgagaacacatcatatatacatatattatttgtatcacaatactccacataaacttttgattgctgagaaaaatagcaattcaaaatagcatcctcaagcattcatatcatcaaagatcttgtaaaatgtgaggcacatgattttctagtagcagattagaatagaaaaataatatgaaaaacatgaattatttaaaaattacaactctgacaaaatgaagaactaatgaatgcattgaattccctcaaatctggacctaactacataacctaacagcacaggaatcaacacttcagggtatttatggcctaaacagaattcacatgacaccaattgttgggaggaattattccttaatgaaaattcaaaaatgatgaggaaaaagagcaccctctctttgaccatcgcctgtacatcgcaatgtttcatcatcaaccatccataaatcaagactattgataccatacatcagttgtcctcacacacatgatgtaaaattgtatctttgttaaaaaaaagtgtacatgttagtttggcaaggtaaaaaagtatcttgcagtgctttatagggaaacaaagaaaaatggagaaaaaaaagctacaattgacagttttttagaaatattgtgaattgaagaaaatcataaagttctacacgatttatatcaattaagtagactaaatacacattattcttgttctccatgaactacagtgtagtatacatgtcaataccaataaacatttgcactaaaattgacacatcgacactcaagaggtgtactaagccatttaggaacttcaagtgacaccctttctcaccttttcttttcgtttcctgattgcaacctttgcatagttggatttgttcaaaacattagtctagaccagatcaagagagccccagatggttcattgtaatgccatcgaatatattcaagtcatctaggctcctgtcatcgttgaacacctaacatccaatttatgcttcagaataatagaattcgaacacctgacatccaatttatgcttcaaaacaatagaattctcttggtcaccgtttctgcaagcacaaccttagagcagaatgattcagcaatttcactttaaaaaaataaaaaaaaaagtcctcgagctatttaaagtgtaatataagctcaatagtgtacagcgatcgcaggcttcagatttaacacgctatggacttttttgtattccacgttgaatttctaatcctacttgcgttatacttgaaaaatacgggaaataaaatttaagaattgctaaaagttgtttgacaacacaaagaaaaagttaggccctaattagcacatctatatcttgtatgacataacttaaaagtacatctatatcttgcaaacgatacatagtttgtcctttaaatagtcagtgtaccctaagcaagcaaatattccactaatttcctcacttgtcgcatagcacaatactcagtgtacccaaatctaaattggattcgacaataatcatatgtgtattccttagattacaaaataaatatcaaaaaagaagaccatttaactgaagatataaaaaagaactgcttcaatccaaggagctaaagctttttttttttcctttcaaaactctgtagaaactgcttccatctatgcatataaatcttttcacagatgaatacggaaacaaagatttaaacatgttcatgccctctcgacgggaggtaatactctactcttgtttgaggattgtatccgtcaaatattgtatttgatcaaatgatcttgttttggccaatgccctaagaggggtcccagctctgtttatatgggttgggggtatgtgttgcaagtagaaaatctagccaaactcgaccgaagcttccttaataaatattacaaaagaaaacccaaatagggatatagaatcgtaccttctcgcagttgtggcccaccttctgatagcagtcagatataaaggctatatgtaggtatcccatatctataatctccatgtgttctaataaatatgtgccataataagatgctaaaatgatgattttcaattatatccgtatacaagttaaagcctgaacttaatggaaaatgaactaatcctaccaaaatcttgcaaagtttctacattcctaaacaggctacgaaagtgtcgaccaaagtctgtctgcagtagatcttggtgtcatactttgctaactggccaaccctgatcaaggtagctagtacgaagagcaaaatacaacacacatacgcacacatggttagaacagaactactggttgagctgacaagtaattaccaaaagctattcaggaaagtattggacacgtgatggctgccactgttacgcatcagtccatcaccagatttcacaacccacggagaagaccgccatgccttgtattgtcgattggagactttcttaatgtatctgaaatccggctcaaaagtagcatgggttcaagattctatctgcaatgtttggatacaatgcgcctaaggctctgtttagttccctagcaaaaattttataccctatcatatcgaatgtttggacacatgtatagagtgccaaatataaacgaaaaaataattaattatacggattgcgtgtaaattgcgagacgaatcttttaaacctaattgcgccatgatttgataatatggtgctacagtaaacatttgctaatgatagtttaattaggcttaataaattcgtctcgcggtttacatgcgaattctataattatttttgttattagactacgtttaatactccaaatgtgtgtccatatatctgatgtgacttgccaaaattttacacccctagaactaaacacagcctaaagcattgtcacgaggaaagctaacaaggcgcatacaaaatcatctcaaagcacctacagctcatcatatatcaggcatcagcttgaacgaattttcctcagatgaaggcaatagaaatcaactacatatcagaacaaacgctacatccaacatacactagaaaattagcacgccaagtggcgcgctcattatagctcgtgtctactttctaattagtttccaaaattcaggtctataaaaggttggcaaatgaaagattcaatggtgttattaacttatgcaacaagtttagctaaattagcttccatggcacttctgctaaaaaaaacccttgaagaacgatcatcgaaaactggatagaactatagataaatatattttcatgaattcactaagataaaaaaaaagcctgatactaccatagttgttccggtctagcttctagctatggcacaatgaataaacacaacaatgtagttacacggaaaacaaaaataaagtttagaaccacagtctttcacacattttaaatgccagaggtcatgatttcgagcaccttgtaggcggtagcaatttccatcttcaatatcttacatatccctagaaatgtcaggaggtgaacacaaattagttggacctagactgactgatagaaggagatcaagagcaagagacataagttaagccagattgtcctggtgggctagtggcacaacagcaaaagcttgaaacaacattccttagtttttaaggaaaattgttgtttctcaattgttagttcttattatgggtgcattcaaatgataatggaacaacccgttgatagacccatcaaagtgataacatccacccaacagaacaaataggatgagggagcgatattcagaaaaaaatatctcctcagaaaatatatattctttatatatttgtcagataattgcaaaaatgcatattcagatacagagaatgtggaaagaaatatacagagaatgtggaaagaaatataacaagctcatgatgtattaacttaagaatgtggtcattatgaacagttgcaatcgatcgcaacttcagaatttctcaagtaatactcaggacattcccttgaataaaacacttgcaattagggcactaaccatttatgatgcaaatgtcagtaaat

SEQ ID NO: 58219 - DNA, 5507 bp, Oryza sativa
agaaagggtgatactataatttcacatgtctatcaagttagaaaattagacaggaattgtgttattctatcaccactggagattcagaaatcagaagttgaattataaagatgacaacattcaaatatcagaccattaatattatgaataatgttctctataaaaatgtgtatactgttcagagcatcaattataacaagaaaacaaaccttaagagacagtagagttttatcagtaaaccgctttactgaagagggtatatttcctgggagagtgttggccactctttgcagctcttcttcttgttgctttgcagttacaacatcagggccactgtacatatctatcagctccttcatatggggtgcccttgccattacatctttcacagcttcctattagtgatacggtacattatactgggtcagttgtatacatcaccaaaaaaaaaaaaactcattttagcagcaaggcgaatacagctgcaagttcaagcatgtactggttcatgtaatagtagaagcctatgagacaagtgtctaatgtggtgtcatacaggaatttccaaacagggacttaaagctgattagcagaaacatggaagcggaataatagatattcttttagttcaataagtccaggactgcaggaaatacataaaagctagaatgacccaatcctgttaaaatctctaatctaacgtagccaacagtccctctttacttggattttagaacaagttgaaacttatctggagattacagtttaacctcatcagaaaggagcaggcacaattactaagtaatcagctggacagcgttcatgcaacaaagataataaatcctttgtataaaccttatatccgctccatttgtaatgcataaatcagcttaccaaataacatgttctgaaaggtgaaacaacacaaaatctactaatatcattttcagcccgatctaggtatatcagtgcaaagctaggccaatctggctgtgaacatacttacgtaccacagcaatatgcatctgcaaactcattagaattatttctgaagcctcaatcaggctgaatgattattccaaacagggaacaagtctattaacatgctcgagttcatcagtttatttatgaaaacttgataatgcagctaggattctaatgccatccaactatagacttgcagcgttgcacccgttgagcatgctataatcctattgctggaaaaacaaagtatcatttacactatttatgcaggctttctccggcattttctaatgcaatctggttcctcaatgctgcaagagaacatatgtaccaaaacatctactcgcacaaacatttctgtggagaaaaataatatagtacaaggtccatcaaagaaatcacctcccattcctcctggttctggatgccctcatacgcaactatgaatggcttcaccttctgtagcatatcctccaatgacataggtggcttctcttcgatatctggattattgaaattcacatgatactctggctcaaactcgatctgcatacataaacccacaggaaacaaataattcaggaaccttgcatgaacggccagatctaacaactctaacaattttgcggattcaaccgcattgctgcacagaccatgttattggtgtgacaagcctccagatatgcatcctgcttcgggtctggcagcgcgttatctgcggcctcatcaaacgcttcgttaaaaatcttcatcttgtcctcgccgagccgcttctggagtctgtcgccatcggcattgtcccccaagtagatcccatgcttctcctccatatcagcagagcggcggccgcggccgccatcacgtcccctgccgcgcccgcgctccctaccacgggcaccacgacccctgccgccacgcccgccatcgtcgtcgccgccaccgcccaggagctccatggcgcgcttcacggcgtcctcgggcgacagcttcggctgcccgctgggagcgggacgcgccgccgacgcggccttcttcttctcctcgcggcgtcggatgaatcggttctcctcctgcggcatctccactggcggctgctgcatccgcggcacgccgcggccagcgccagcggaagggagcgtgcgcggcggcggcggtggcggtggctcggaggacgaggcctcggcggccggcgcgtcgaacagcttggcggggaccggttgcttgggggcgacctcaccgaggggcggcggcgatccacggccgcggccggcgccgggaagcggcggcgacgagaccgacgggatcacggcctccccgcggccgcggccgatgggggccggggaggagaagggatccgcgccgccgccgtcgtcgtcgtccgggacggggctaccgggggcgcgcggcggcgtcgcggagggcgggaggccgcgcccacgcccgcgcccggcgccgccgccgatgccggagaaggaggagaaggcggcggagtaggaggtggggaggtgcgcgtgccgcctcgcggcggcggcggcggcgccgatggctcgcatggtggtggggaatgggtttagggcttggaggggagcgcgtgcgtgaggtgctcgacgaaatggttgggctggtccggtgcgatgcggtggtttctgggccgttggatcgtaccgattgttcttgggaataagttcatctaaggttccttaacttgtcaacgaatccgattttcgtccttcaaccacaaaaccagatacaattggtccctcaactatcaaaaccggtgcatattaggtccctcggcggtttcaatggcggttttggctgacgtggcacctacgtggctaattttgactcggttttgatctgacgtggcactgatgtggcccttacgtggcaattcgatccggaaaataataaaccccgtgggacccacatgtcagtttcacacacaataaaaataataataataataatggtgggacccacgcggaccccacatgtcagtctaattaacccctcctcttctgcttcctctctctcctcctcccctctcttcgtctctctcttgcgctgggtcattctgattctcctcttcaccatcttctctgtcttcatctctctcccctctcctctttctcttctctccggttcacgggcgccggggagaggacggtgtccggctgggagaaggggcgcggcgcggcggccggtgggagggaaactagcggagagaaaggaaccagcccggcggcggaggcagcgccgccgcggccgtggctgcggacgatgttgacgtcgacctcggcatcctcggcggcgggatgaacgtgtcccgccgaccggccgacacacgcgcgcatcctcgaaggcggccgtccacgtgggcgggtgagggggccacctcgccggcgggagaggggagaggcggccgactgcgaagacgaccccagtgatgatgacgaccgtgcggcgcacggcggaggccgatcccgtgagcaggaagctcttcgtccacggcctcggctggggcaccaaagccgacgacctccgctccgcgtttatgtgcctaatcatacaaaggtagaagcaatagcgactagtactagctgactagagtatattttgcttcgtcatcatcatttgcttgtgttatgacggggttgatgaatgaatgaatgatcattgttttaggcaagaaaacactgttccggccggactgacgaggaacccatatcgatccgctcgccgcggcccatggaaacccaacaggagatggcggcgctaccttccgccgccggcgactactaatggtgggtgatgctcgagcacattgacgaactcgaggtcgacgacaaggactccaactacaactcctgctccaccgctgccgacgacaccgccaatcccgtgagtccatgacgacctcgctcacctccgacggccacgtcgtaagagtctacttccgcctcaaagcgcccccagcgacgtcacacctatgcccctggcagtcactcttctccatttccgccgccatcgtcatcgccggccgcatcccctagcacaagagagagatgaaaagaggagagaaagagagagaggaagcagaagaggaggggtgagttagactgacatgtggggcagcgtgggttccaccattattattaatttttttgtgtgtgaaattgacatgtgggtcccacggggtttattattttcccgggtcaaattgccacgtaagggccacgtcataccacgtcagatcgagaccgagtcaaaattagccacgcaggcgccacgtcagccaaaaccgccgagggacctaatatgcaccggttttgatagttaagggacccgttgtatctggttttgtggttgaaggacgaaaatcggattcgttgataagttaagggaccttagatgaacttattccttgttcttgcgcgttatcatcaccgttgattcgtgaatcaggtttttactccatgatttttgtttttttttttggattgtatggcagacgcataacaccacactcacacccgtgaatacgtctcgtaacatatgctctaaagatgaaaatcctgttaaaaaatcatctatacgtgtgtaatattcgtaagcaccaaaatttcagtcttcgtggatagaatcatgcactcacgactctactttttcttttttttcccctatgatttttccattgttatgatcgttttacctgcaaaaatgaacaaagtgaaaagaaattaaaatgatttatagcaattttatgtatatgtttctttgttgatttaaaagccaaagaagaaaataaattatggtaaaaaaaactcaaaattaaattaaaaaaataaatattggctatagctaataaggtaacaaacatataacaagaaaaagtgtattgatgtaagcataccagtgaatcttgacagagagaaaaatgggcatggacgtgtaacagcgtaagaacatcttcaacagcctttctattttactcttcaaaccaaagtttagcaacagtggataaaaattgcattctcttcatcccactcttcaagctatccgactggacaaactccttcccttacttaccaaacttggtgagccaactacacttgccatatgtgggtctaactacctcctattatctttcctcccacttgcgatgcagatcaagtggaactttgccgctgcgcacctcctcgccaccatggtttcccgctcgcaatccccctaacgagacaatcattgtcttcatcgtttgccaccgccatcgtcaccgccacatcccgcacctccccctctactccaccgtcgcagcctacacatacctcctcgccaccgtggcctctactctgtcgttgccgtcttcaaccccacacgaccttcacagcctccgtccctgcatggactcgggggccctcagctctcgttgtctcctctcaacggcgatttttacagcctttgcctccgctggcatggaggaagcccacggcaacgacagggttggggagtgtacggga

SEQ ID NO: 58220 - DNA, 3649 bp, Oryza sativa
tttcaccaaaaagaaaggtaaacaaaaaaaaatgatctacacggataagaaaaaaaggttacagcctaaatagatttattttatcccgatttctagggagaaggagagtttgtcaaacaacatggtcgtcgcagtacaatttaacgctttccattatttaatgtcttgttttgttttaattatatggagccatgtgtgaagcttctcagcacgctaaatattatagcattcgtcatatgtatgactaaggaagtacttttgtttgattgtatagcttattacatactttacactttgccacttgccacttactgcgtggaatttattaattcagctcactcatatatggcttgttatatatgtatgcatgcatgcatctcgatttgaatataggatgtgattgtatgcgttcataagtgtaatttcacgcgttatgtataataaataattaacaaaaattgctatactaatataatattttttttttgagaaatatggtcttccaaaaccctgtcacctcccaatttatatataatcagtggtgaactggtacttaccaccggtatgttttaatgcacatcgtaataagaaaacaattatacgtacagacagtataacaaagacaatttagctaggagaaattgacatggtagtttgaatgttgtttttatgagaaatgagactattaaatatttatttgtggagtgttactatgcaaaatttctttggagagctctacagtttactactagtttttatagtttatatgctcctcatagtatatctcatattttttagaattgctttgtgggggttgataaaaaatctaccaaacttattcttgttagagcatctgctatatgttgggctatatggttgtgtagaaatgatatggtttttgataaatcaccatctatgtcctataatcctatatgcatattcttttcagggcaacatactggccccggttctgagctcaactgctaaagtgtgatgaagaaatcaagtcagtgaaagttatatgtcgtaattttgattcaatagttatgcagttgctcgctaactttggatggagattcacaaatagaatttaataatttttgtgatcttgttatgctgtgtgagttttttttagtttgtgtgtccttttgtttattcaggtgtgagtttttggtgaattggtgtaataattaattggctgtagctctttgagcaaaggtcgggattatattccattattaaaagaaaacatattgtattgtagttgtaaatgtcaaactacagaagagaaatgggggagagagaccccggggggtgacttcacttttttctcggcgaatacgtttatcaccatataattaacgattggtgcatcagctgatttcagattattgactagaaatattaatcatgaatatttctcaagaacacatagcaagtttgagatctttgtatctattcgttagaaaaccagaaacaggcatgtaatggaaggaaatgaggtctttgccccgtgtgttgcagcgggattttaataaaaaaaattatcattaatatgttattattatatcttaattgttgtacgtatttgatactaacatgtggacatttttagccttacactgttctttttttctttcaacaaaaagtgaagagttggttggagtagctaacatttagaccatctagacctacctgtcatttttccccttaaaaaaactaggagttggtagtggggcagtggtatgtagaaccaccaccactactctcttttataagaagcatagtatacaactaccacaaaacaccacatcagtgatgcctccttcattgcgtcatgcatggaggaaggaaaggggaaagaagagggcatgcacggcggtcggctgcgcatggccagcagtgatgatgggccttgtgagaggagctagctagcggcaacagcaaaccatgtgggaggagaggatcctctcctctaacaagcggtggagtacttgcccgtcagagttgcccgtcagagatgactatcacctctgacagtcggtcacccgtcaaaggtgactggacacaacaatgaccactgttctttgaccaggcctaaacccatcaaaggtaagggtttatggccatcaaaggtgacctgatccggtgtagtgggagtaaaggactagtgatagaggactggcgagaggagcggcggcgagtccgttcatagggaagagtctgtgtcgtcacgtggagctcagccagcggcgggagggaatgacactggcagctgaaatattttgttgatttggtgttcgttctgttggatgaatcgtttttatcttttggatattgaaattattgatccgttggagaattcttagatctgttcttggtagatggatgtgtttcttatggggccgattgcaatctcatcagtgtgggctcgcaatctggcaataatgatccgctggctgattatcgctgagacagaagtgccggttccaaaatcgtcaccgacgttagttttgaaccagcactgatgtccaaacctgtggtaatgatagttggaaaattttaaagtctcaacacataatatagtactacctcttttttaaatatgtataacgtcgttgactttttgtccaacgtttgaccattcatcttattcaaaaaaatttatgtaattatttattttaatataacttgattcatcatcaaatgttctttaagcaagacataaatgttttcatatttgcaaaaaaatttaaataaaataaatggtcaaacgttggttaaaaagtcaaccgcgtcatacattaattaaaatacggagggagtatatagcaattggatagtttctttagcggcacaaaaatcatcacttgcttatgtagagcttatctaatgtgtgattatattctttcaacaaaacggatgcgcatcatttctcggtttattcctacatgtatggataatgcatgtatgagaattaattctacaatatgtatatgtcagcggccgtttgcaacgaatcaggagggaggccggaggtacagttaggagaataggcaaccaagccacctagcatgacaacgtagtaccaagattaatgttttattttaccatgaccaaaattattgttcattactgaattaactacctttaagtactcatttttaaacatcctaatgtggttggtgtggttctccaagtcgttggtatatttctttcattgatgaatctctattacttacgtattgaatcctgctatccacgcagcatgcatgcatacaggccgatatatttcttaaaagaaaatacagacgatcaacttaataattttatctgcctccgcaggcaaaatggcgatagctaggtactccctccgtttcacaatgtaagtcattctagcattttccacattcatattgatatatattttagatttattaaaatcaatatgaacgtggaaaatgcgtaggactctatatattgagctatctcctaaatcaacattggctgctaggcttaatatatattttctgctatgatttaactaatgaattaattaattgtcgctttccacgtaccatttcatatatatatatacatgtgcaaaattttaaatgcaagctgttttagacacatgaacttttcaaca

SEQ ID NO: 58221 - DNA, 841 bp, Oryza sativa
gtaccatcgacaactttttaaatttgtcgttgtcatgcatccatgtaccacctgttgatctagctagctaggagtagattgccggccagcttttgaatgcatgcttgtcttagcaaggatgacaaatggttgagaatgatgtatgaactaatcactctccagctgttgcaacttgcaaacaagaagcattagtgaagaatagcgaattagttactaccaagtcataaaaacaactccctctatttcattttatattataagtcattttaacttttctctaatcaaactttatatgtttgaccaattttatagagaaatttagcaatttctacaacatcaaattagttctattacatctatcatcaaatattttgataatatgtttcttttcagttcgaaatgttgttatatttttctataaacattagtacgtatccttccatctgtggcggcctctcacatgcctggttttgccggccatcacagcttcatctcaattgggccaaaataaacaccgtcgtagaactcgtacaggcataatcaagttgcatatagctagagcccgtcatcgatgatactcatctatgacggtgtcacgcccagaaatttagcccaaatttctagtctattttgtgtattaaatccctgtccaggaccaaccagggtacacgaaacgacaaattaatatacagattcaaacgtaaataaagcgtaaaatacttacagaagaggcacttagtcctcacaccgaaacgaaagcagcagtagcgaaaaaaggcaatcctagtggagcttcagctccactccacaggcaaaactcaactggggtatgagccttggt

SEQ ID NO: 58222 - DNA, 687 bp, Oryza sativa
gctgttttcttttctttgtaagtatgtaacgttattattaagatggattggtatattaattgtccagttcgtgtacctcggctgattcctggacgaggattttatgcaccaattagttgggaaattactagtgaattccgggcggtgacagctccctctcccatttccccctcctccccgggctcgccacgccccctaaccacctccccaccgcgctccctctctccaccgctccccggcgaactccagcaactcgtcaccgccgctagagccactgcctgatgaacctgagtttctttcaacactctaggcaattgtttggcctgatctttcggtgagttgatgataactacgattttggagaaatgttgacgacccgactacaaccttacaagacgttgtgttgcgcatttgcgatcgatacacctctccgtgggttgtggatcttgccggtccagatcaatcttattcctgcaagcaaatcgaagaaacaagcaagagcaagataaaagcaatctgaattacaaataggaatgaatacacacgataagttggggattcgaatacaagctgacggacggtctagccgacatgcacgccgcaaggaagtagaaatggctaaacttttatctaaataaaacccaagaaaccctaaaggggtacctacctatttataggggtgggagg

SEQ ID NO: 58223 - DNA, 678 bp, Oryza sativa
tctaactttaagttagagggacatgggagccacatgtcagcgacacatgtccctctaactttagaggagcaccttccttctacatctgcacaacatccattactttttatatactcatcatctcacactaacactaaaattttagacatagttgctctgtgattagttcctaataatttatgtttccttctatactctaatcatttcttatttagcttatgcaaatattattttcttaagggttgttaagtgatattgctttgacaaatgttctcatattctcgatacttcatgaattatgcatgttgtttcttagtgtccaattatatggggattctctttgctcaagttgatgtaatttcaacatacgtgaaggttggactatatacaatatggatttgattggttaagagtggtcaggtctggtgaagcttgctggattcggttgaatttgacgaacgctttggtatcgcaagctgggggaggagagatggaaatgagaagcgtgttgtgagtggaaaataatgagggtaggccctacataaattgtaaacaaaagtctaaatactagagaaaatttgcagaaattaaacttaaactctactgtatcagaatgaggaaaaaaacacttacatctttccagttgcatcaagtgatggtgatctcgtgatgagctac

SEQ ID NO: 58224 - DNA, 1205 bp, Oryza sativa
aaaccctgtccttgctggtcattgagatcatctattgtgtccttggtgtagacgttgaaacctccacgacgccctcaaaataatagcttgggctctccatcttcaatgggttgtatatcatcggacacttttagaaaatctccatcccaaccttttccagataagcaatcgataccgtccatctcccaaagagctaaatcggcactggcaacattaactgacttgtcggctagcacaatctcaatcttgttgccttgccattgaatcaaacattgatgcatggttgaaggaatacaacaattggcatgaatccaatcccttccaagcaacaagctgtaggaacccttcccatcgatgacaaaaaatgttgtagggatggttttgctgccgactgtcagctccaaattcaaaactccttttgtctctgacggattgccaccaaagtccttgagaaccatacttgtcttgatgagatcttcagtatttctgcccagcttcctaaatgtagcatatggcatcaaattcacagcagccccaccatcaaccatcatcttggacatcggcttctcattgacatagccgtttatatacaatggtttaagatgccgattctttgtcccttctggtttctcaaaaaccgcttgctctggtgacaaaaccaacctagccgaagcttcctcaacttcatcaacatcagcttgtttagctccgaattccgcaggcaacgtgaaaaccatgttaaccgatgcggtcacaacactcttccctttagccaacctttttgcttcatcggctgtagcagcttggttcttgacacgccactcctgccttggctttgtcttcttctgccgatgattaatctcttgctccacttcatgaaaacactctctgttcctcaatctttgaactcttctcttctgattcttcgtaaaaataccagaaggacaccattgagtttttctgccctcctcgtcctcttgatcatgatcttgatttactgggcccaatctttgatgaacaggaactcttgtcaacctcagccgattgcttctattgtgagatcggcttgaactttctgcaatatcactgcatctaggacaatcttcgatagatggcagcctcataccctcgttccagcaaaatctgaaaaactcacagtcccaacgaggatcaaaacccgcattggcttcttcataatacctctc

SEQ ID NO: 58225 - DNA, 614 bp, Oryza sativa
gtctgaccatcatcaggtatggtgcctcctgacaggcgtattctgttgtgcctccagatgcctcaaccacaatgttagctagccaggtacccacgaaccggtggacctccaggcgaacacggtgagaaagctcgccactgaccggtggaatcgtcgtgtactctggcgcgttggggtagcccaccaccagtgtcatacgtgccaactccgccacaaagtcgatcatgccttctccgcggtggttgggtgggtggccggccatctagagaagacaaaggagtaggatcaatgcatgctcaaatccaaatttaaataaagcaataaaaactcaaataagggaatcgaataagagcgaaatttttatgcatagatcattttgcatgagagcgaataaataagacagactcacataacgataaaataatgagaaattagatacatactaataataacaataaaagcataaataccttgcaacccatgttcctaagctatgacctaatgcatttcacccatcagatcccaactgactgacgaataaatctcaacagttttactaaaaccctggactgacttgttttgaaaaatctcacttaaacgagcgaccaagattt

SEQ ID NO: 58226 - DNA, 688 bp, Oryza sativa
ttgtcctcgcggagcgacaggttgagcagcgcggtgacgccgtgctcctggagcagcgggtccggccgggacagcagcgccaccagcggcggcagggcccccgcggccacgatgcgtaggcggttgtccgggctgtgcttggccagcaggcggagctccatggcggcgcggcgcaggtcgtccagcgacgacgcgggcgactcgagctcctccaccagggccgcgatggcgccatcggtggcgcagggcagcggcggcaggcggtgtatccccgtgcccttgggggacgacgaggacaggaggtcatcgccgtcggagcaggtggaagagtcgctgctgtcactccggcgcggggaggtcgacgcgtcggactccatcagagatcaacggtgatgttgtgttttggcctttttggtgactctcactacaccagtgggctctgcttcgggttgctctgctcgggaggagtatatatagtacgtagtacaggttcaagtgacactgcggtggggcccggcgcgtacgggggtcacgtgaggggtgcgtgggcgcgcgacacgtgcggcgggtgcccaactggcgcctggctggattccgtacgtggagccaacatggactcggtccggtccggtccgtgcggtgcgcggtgggcatttgccaaattgccattttggggagatagctagcg

SEQ ID NO: 58227 - DNA, 7287 bp, Oryza sativa
ggggcataggtgtgacgtcgctgggggcgctttgaggcggaagtagactcttccgacgtggccgtcggaggtgagcgaggtcgtcatggactcacgggattggcggtgtcgtccgcagcggtggagcagaagttgtagttggatccttgtcgtcgacctagagttcgtcaatgtgctcgagcatcacccaccattagtagtcgccggcggcggaaggtagcgccgccatctcctgttgggtttccatgggccgcggcgagcggatcgatatgggttcctcgtcagtccggccggaacagtgttttcttgcctaaaacaatgatcattcattcattcatcaaccccgtcataacacaagcaaatgatgatgacgaagcaaaatatactctagtcagctagtactagtcgctattgcttttacctttgtatgattaggcacataaacgcggagcggaggtcgtcggctttggtgccccagccgaggccgtggacgaagagcttcctgctcacgggatcggcctccgccgtgcgccgcacggtcgtcatcatcactggggtcgtcttcgcagtcggccgcctcttccctcttccgccggcgaggtggccccctcacccgcccacgtggacggccgccttctaggatgcgcgcgtgtgtcggccggtcggcgggacacgttcatcccgccgccgaggatgccgaggtcgacgtcaacatcgtccgcagccacgggcgcggcgcgctggctccgccgccgggctggttcctttctctccgctagtttccctcccaccggccgccgcgccgcgccccttctcccagccggacaccgtcctcttccggcgcccgtgaaccggagagaagagaaagaggagaggggagagagatgaagacagagaagatggtgaagaggagaatcagaatgacccagcgcaagagagagacgaagagaggggaggaggagagagaggaagcagaagaggaggggttaattagactgacatgtggggtccgcgtgggtcccaccattattatattattatttttattgtgtgtgaaactgacatgtgggtcccacggggtttattattttcccgggtcaaattgccacgtaagggccacgtcataccacgtcagatcgagaccgagtcaaaattagccacgcaggcgccacgtcagccaaaaccgccgagggacctaatatgcaccggttttgatagttaagggacccgttgtatctggttttgtggttgaaggacgaaaatcggattcgttgataagttaagggaccttagatgaacttattccttgttcttgcgcgttatcatcaccgttgattcgtgaatcaggtttttactccatgatttttgtttttttttttggattgtatggcagacgcataacaccacactcacacccgtgaatacgtctcgtaacatatgctctaaagatgaaaatcctgttaaaaaatcatctatacgtgtgtaatattcgtaagcaccaaaatttcagtcttcgtggatagaatcatgcactcacgactctactttttcttttttttcccctatgatttttccattgttatgatcgttttacctgcaaaaatgaacaaagtgaaaagaaattaaaatgatttatagcaattttatgtatatgtttctttgttgatttaaaagccaaagaagaaaataaattatggtaaaaaaaactcaaaattaaattaaaaaaataaatattggctatagctaataaggtaacaaacatataacaagaaaaagtgtattgatgtaagcataccagtgaatcttgacagagagaaaaatgggcatggacgtgtaacagcgtaagaacatcttcaacagcctttctattttactcttcaaaccaaagtttagcaacagtggataaaaattgcattctcttcatcccactcttcaagctatccgactggacaaactccttcccttacttaccaaacttggtgagccaactacacttgccatatgtgggtctaactacctcctattatctttcctcccacttgcgatgcagatcaagtggaactttgccgctgcgcacctcctcgccaccatggtttcccgctcgcaatccccctaacgagacaatcattgtcttcatcgtttgccaccgccatcgtcaccgccacatcccgcacctccccctctactccaccgtcgcagcctacacatacctcctcgccaccgtggcctctactctgtcgttgccgtcttcaaccccacacgaccttcacagcctccgtccctgcatggactcgggggccctcagctctcgttgtctcctctcaacggcgatttttacagcctttgcctccgctggcatggaggaagcccacggcaacgacagggttggggagtgtacgggacgtcagtgagctcaagcgccactatagcatgggtatcgcgctttgttgacggccttcctttcatccgcgtcagccaccccgcctagcgcgctcacggatccgctgtcgccatccgccatcacacaaacatcgtcgccgcacggagggagagggatggagagtagctcagggtggccccagcggaagcaaaggaagaatggagaaataggaggaagaagaagagatgttagaggctgacatatgggttgcagtgtcatatgggttggagtggagagggtagatgaagaagctgttggcgtgagcaacgattttggcttaccaaatcaattggagatatagctgtataggtgtttggatagtctaatttgtatattctgttagagatactatcagcgcataggcaatgtagactgtctttagcattaagattgcaaataagcaagacttggggtgagttcatttctctccttttttttaacttatcttttttcacgtgcaagcttcccaaacagctaaatggtgcgtctttttttaaatctataaaaatgttgcttcagaaaaattcatattaattaatttttaaagtttttagctaatacttaattaaacatgctctaatgagttttttttttgttcacgtaaagggttcccaaaccttttcttcaaacacgttttatatcggtggctttgcaagcgcaatttgaagggtttttgtttttttaattaaaactagcaatttgaaatgtaatttcatgcttccgttatttattagtgcaaaagagcattttgttgtctgggaaaaagaaagaggttttgcctattttatgtgggcctgcgaactaaacccatatcagcgaggcctgcaacggtggtgtccttgattcaagcccagttccacttccacggcctcatcgcacgctacgcgacgcgagcgttcagcacgaaacaaacgggacagatgggcttctcctgctcggtctcgatcggcatctgctgccgcctgtgacacgggccgcatcagcttcaagcggccatttttcaacggaataagtctactttacattcctcatcttttcatcgagtttaaattggagttttagatgtcactggggagggtatgggtaacccatatctattttataattagctttcccatacctattgggtatgaaaattatccaatgggtataggtaatttatatgtgggctctatatagaaatggtctaaaacttgcaaaaagtgcttctatatacaataaatcatttctacgaattcaacccaatttgaaacgtttttataatgtgaacacgagttttaaaattttggattcgagctttacacacgtaaaatggtatggataaagtgtgtaatgatgggaacatatcatgtgcacacaaatctttacgtgtatacatcgtgcataccaaataacaaatatcataaaaaaaatctagaaactgcgtagacgtacttccaatagtattactcctacgcgtaaaatattaacctcaaattgattatattttagccgtaacaaaaaaaatcacagttttaaggtttctatcaaaaattttgcttttttttatctctatgtaaaatgaatttgaaggtacgactttacacgtagatatacaattgaaaatacatgtatgaacgtacttttatagatttttttgtggcatttgttaattggtatgtgcagtgtgtacactgtacacgtggggcttgtgtgcataggatatgttcccggataacaataggtattaccctcgcttctttatccaaaattaaaatagatatttttctccctatccataaggacataggtatggagatgggtgctatagatacccagtgcagacagtcctagactgcatgcacccgacactcaacacaaccaacctgccgtccctcctcgagagatcgatggtcagatggatcgaaagtgcagcacctcatctcacgcatatggctcaaagaaggtcaagaaagtggtacgtgtggtaaaaaagaacaagagagagagagagagagaaaagcacacaaacgcaaagaagccaaagcaacacacctctcaacgccgccaaagcacacaagagaaaaacaaacgaatgaaagtgccactgccaatgcagtcgcgtgtatacgtccaaagttgattggcctagctagcatgatacacacttttgttgccattcttgaaaaaataagaagaagatgatgatgaatccaacctagagaggcaaggcacctcggccatgaagtgctaactcgagacagaactagacactagtgtggaaaaaaaatatctgtgtcggacgggaaccttcatctgcatcgccgacaggccgcgttatggataattggtcaccgataacagtgatttgtctcaggccgatataaaagaccatcactaataattttaacccaacaaagaagtcaaatcaaagcctgaagataagtcatccgtgatacatggtaacgtactataaaccaaaaaaatgtgatggtcaccttttattggtatcgtcttgagaccattacggatgacttatcggtaatagcttttattttagatccaaagtttaattttgatgcgcacccagcagtcgtgacgttggttttttttttttttctaacacgagagaagctagaccgataaatgcaaaaatatgttgattggtgctcactttagtggatttccttccaaatcatctgtatggtctaggactatagtagtagtataatctgggcggttttgcaaagggacattttgccgacggccgaaagaactcgagtgtgtgcgtgtacccgttttgttcatacgtgttcagacattaatctaaacatcaaatattgggtaaccatgattacgtacttattaaagttgctacttaatgggccacgtaaagcattacatatattttataagattggcaagcaggagaagatctttgtggtcttaatcatttcatgacagagaaagcgtactacccatcactgataaagctaacatatatctattaatcatatatactccactaggaaataatttttccatacggacggcccgtatctaaccaaatgaatgtaaaaatcattgatttttgcaagcgagtcactatgacacccacatatgaagataatttttcaggggaaaaaatagcgcttgccgcctacgtcgtagctggtagcgatcgcgatcgtcgtcactagaagccaacaggtcatgattgaggtcgagatcgttgtcgcatccctagtcatggtcgtcgttgtggagccactgtactagatctaggagcggttgtcgtcaccacctcgactcacattccactgccgccctccaccttacgcccctcctcttcgtaccaccgcccttatcccagaaccgttgtcaccaggccactgccgagccatgaatctggtagcccaaattaatctgatcatctctcgccgcctaggtccgcctcctttactgccgctcttcaccatgcaccccttcccttgttgctatcgctgactcatctctgttgtcatggatctggcagtccatatttgcttcgcccctgccactccgcttgccatcgcccctctcctttgctgcttgcctagatatgcctcctctctcctcggcgaggagtagaggaagagtgtggaggtgggctggggaggacggtgaggatatctgtctccatcctcgctgcctagattcgtccctcctctttgttgcccccaacgataaggaccctcaatcttgatcagctgcttttggcaagaagggtggtgatggtgaggtagagtggctggaaggagtattgagggaacagaggctatagggacttagccaatattgaggctagtcgaagaagccgatcgaggtgactcacacttttaaggtggcaacatttttttacaggcgatgctctttagcacgagattataggagctcattggtattattgcaaactgatttttaataatctgccagtaaaaataataataataaataggtgcctacaaaaaatcgctttggaaagcgatagtagtacgtgtacgctttaattcgggcaagagaaaactcattaatcctagctagggtgatccacatgcaaacatttcacatgtcatgtctcatgggacagcatctcaaatgtgtgcttgaaactcaagctaccatccatagtaactggtgacagcgattttcttagtttaatgagagctaaaagttaaggaccaactttataaaggttgatatttaagtacgtatgcgcgcgcctgcttgcagctggttgctcgctgcacgtggattattttcatacatacatacatacatacatacatacatacatacatacatacatacatacatacatatatatatacatacatacatatatatacatacatacatacatacatatacatatatatatatatatatatatacacatatacatatatatatatatgtatatacatacatacatacatacatacatacatacatacatacatacatacatacatacatacatacatacatatacatacatacatacatacatatacatacatacatacatatacatacatatggatatatgtatatatatatatatatgtatgtatatatatatatacatacatacatacatatatatatacatatatacatatatatatatatatatatatatatatatatatatatatatatatatatatcttcttatatatgtaagatagtgagaattcttcatgtgtttattagcctcatttccttgcttattcacatggttatccatactatttattaacaaacaaaataatttgttttgtttctcggtaaaacttttatatacgtgttctcagctattgaaa

SEQ ID NO: 58228 - DNA, 1268 bp, Oryza sativa
gtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtggcttggaatatctttttaagttgcttctaaaaagacagataggtgaggcatacggtgagtaccgagtaggactttatatcatctgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttttgtccgaagcacaagagtggtatcataagtgagtcacaagagtcacaagagtggtatcagagccagtcattatagagaaatcaaattcagaagctaatattggaaaggtaattactaccaaagataatctgaatataaggtgtagattaaatcacattgaagaccatagttagcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggaatataagacaaggcagaataagatattacaaaacagtgactatatcaaagaattattagaaataataaattctagtaaaggaaaagagatagttttggcttcaacaggcataattacctcgtctcaagctattaattcagaaaaatggacctatctaggagtttgtttagaagaatagcaagcagagacgataaatctttaagttgtattgataaacaaaaaggtaaaaatgaagacatagatgagcttgaagatattgcagaagtagacaaacagctcgaaagatatcaacgagatactttaagggcaataagacctcaacaaatatattgcatgggattttttgagaataaaaatgggttatacagaatatctagagaagtagagttaagcgttttaacaagccagttgagttaaaaattgtagccaaggaatttgaaaatggattaaagtattcagggtataaatatattcaccaa

SEQ ID NO: 58229 - DNA, 23555 bp, Oryza sativa
tatatatatatacgtacatgcgtatatatatatatatatatatatatatatatatatatatatatatatatatatatatacatacatatacatatacatatatatgtatgtatatatatatatacatatatatgtatatatatgtatacatatatatcgaatctcacttactcctctcgttgcttatcagagctccgcaaattcgcgagctacttggacaagacaagtcaagtactgcttagcctccctatttcaattaatcgaactaaattttagcgtctgttcactttgatgccattttcaaccatgtcatttttttataaagttgttaaaaaatatatatatttaattagtttgttgctaaatttgatcaatacataagaaatcctggcaaaattttaccaagattactatcttgtcaaaattttgctaaacttttggcattgccaaaacttggtaaggtttattttaactacaatctgaacacgcccttacttataaatatatacattctattatgatgtgcgtttgcaacgcgagaatatatacagcgtgatccaccatcacatcatcgatcatatatatcattgcttagccaccctatttcaattaaatgaactaaattttacttataaatatatacattctattatggtgtgcgtttgcaacgcgagaatatatacagtgtgatccaccatcacatcatcgatcatatgtatcattgcttccctagttcccttcgttatttgcttctttattcattaattgtacgtctttctgtgcattgtgaatctagagtttggtgctatatatcggaaatgactaggttattctgaagtctcatcaactatgctaattaatattactctagattgaaaagttcatggtgcaaaatgattagtttttttaagtttaacgtgcatatataatattcgagtctgactgaacacaagttaagagttatttacaataacataacttaagacttaaatgacttttttaatatatattatgaaaatgagtaagtactacaaactgtccttttgtttaatctgttgattttatggttgtttatgcagcactaacctataaattttatattaataagcactagaaatcaaaaccaaaatgggtgtttcattggaagctatctaggaatctttgcttaattgtcaaagaagaaagcatctattccctctcgtgtaaagaaaacggcttgtccatccccctcatggaagagtaagctaggaacgattgagctagagcttaattgctttataatgttctcactcatcctctcccaaatgggcccctcaagccacaattttgaccaccattttttttgtttggatttgtatgtgtcataatgggatgcatgcttagtgacgtgtgcatgtatgggagacaatcttctattgtactaaagggagactactctcagtgagattgattgtaagctgctcacttttttgaccctttgtggcatcaatacctgtagacaatttgttcatcacattaatttgctttgaacaaatcatactagtgtgccaaaaaaaaacagaaatgaaatttatgtatagaaagttctttatttttttctttctgaaaaaacacactgtttagaagatcaaggagagtgtgcattcacctattcatcttttaagtagaaaaagagtagctagcagttccagcattatatatatgtaacatacaaaaggaaaaattgaaattgatggaaataaactaatttagctaccaacaagttcaatatcaatttgctatttggttcagtcaactaatcatgcatgaacctgatcaattcttgacaacaattaatttgtttgatttaccaatatggagtatattactatcaatttatatgcaccagtgaatatctagctagccagttcttaaaaaaaattaagtgccacaagatggcaattaatggtttatggttgtaggaaccaaaccaaaactaaaaactaaagctgcctgactggttgtggttgattggtccccaatgcacactatataaactttagggttttttttttcagtgtatatgttgtgatgtctacttgggcaaccaaccattcccacggggctcaatgcaaatgcatgtctttttaattccctcacaatctgcaagccatcatttggatatgatggtgttttttgagtacactcctttttccatgactaattgcatgatgtgtctagatatatgcatatatattatagagtttgacccacatatatataacgatatgatgattggatgcactagtgataaaagacgaagtcatctcttgtttccactaatctagcttctctgttggcgcgcataattcagcttaattaggtcgacaattttagtgttaattcgtgtaaccggaggacataagaatgtggagtatgttgtatctcctggtaattaattaagtaggtaaaaaaatccttctcatagcatagcaataagaatatatatattgatagatgaacaatgcatgtggaattaataatgcttcttattaataggggtgaaaatggggcgggtatttcccgccctcctgcccggccacattatttcgggacaaattcgggtacccgagacttttcacggatatcaggtccgaatacatgtcttttttggcggatataagatcgggttcggaaatatagtatccgatggatacggattatccggtaaaaaattcgggttttacccggataattatacggatattacctatattatgtttttgtgaggcattttttggtactatgtattggttctgctatgatgtattataccctatttatttcctaagttcctaatggcctaatataattgtattatggatatatggaattgttaaatggttattgtctatgtgatatataaggttgttgcttcgacttgatatccgaataaatattcgtaaccaatagtgtgtgtatctattttggtacgtatttgttccatatttttgcccgacattatacgagtttgtatccgtatttgacactatccttgtccgacccgattccgattataaaatgtgggttaggatatgaaaaggttgagatctgaccgaactcgatccgttttcacccctgcttattaatggataaacctttgcaaattgggtgaagtatacctgctagaatcgagaattcaacaatatatgatttacttatctaacaatctttataagttatacaccctatggtaacaaatattgtttgatttttttaaaaaaacttaataaatgcaggaaaaactaatttaatattttcgaggatacgtatatatgcaccggcgctctgagggtgtgtttgaggagaaaaaaagagaatattaagaaaaaaatagtgagtcattagcgtatgattaattaattacgtattaattatttctaactgaaaaacagataaatatgacttttgaaacaatttttctatagatttttcttaataaaaacacaacagtttcttctctttgtttttaaaaaacatggtgagacttccttttttttaaaaaaaataaataaaagttttcctctccttgtgttgctgccgaacgcagcataataattgttaatatatatatatattaagcgtcatataggagtttttatgtttcattagtacacaaacatttaaggtcaaagctgattaattatgacttaaaaactatactagctagctagtaaaaaaagcttaattattactcccttcattttttttctttgacgttggttagctcaaaaatacatttgtacaaggaggtagtactaacaaatactttctccgtattttaatatatgacgccgttgactttttattaacgatacggagggagtaatataattcaaggtctctctcctcacctctgttacaaagcgaggcggcaggacaaggagaccggcgaggcttcgagctagctagcagttggcggtggccgctttcccccccggatagaatatcacccggtgcgcgcgctttctacgccgagacctagagagagaaaggagaaagagagagaaacaaagcacctaaagcaacaaagagaggtgtagagagagagagagatgagaacatatcatcaagaaaagaagctaagagagatcaagtgatgtggtcgtcgccgtagcagcagtacagcttctctaccaacaccgtagtcctttctctcctcctccccctcccctcctcgttccgcgtgccgcgagaggatcgaaccctattcctttgttcttgaatctcttccaaatctgtaacagagagagagagagagggaggagatctagtgagtctagagagagagagaggttcttaagaggaggaggaaagctagctaggagaatagaatgttcccttcttcttctccttctccttctccttcctcctccaagaagcagcagcagctcagtggcggcgtcggcgtcggcggcgccgcggcggcggcgagctcgaatgatcggccgccgttgtgcgtccagggtgactccggcctcgtcctcaccaccgaccccaagccacgcctccgctggaccgtcgagctccatgaccgcttcgtcgacgccgtcacccagctcggaggcccggacagtacgtagctacgctctatacatgactgatcttgatgctgagaatttgatttgattttatttggttcgagttcggttcttcttaattaattacttgtatgtttcatgatcaaactcttgatcaattgtaaattacttgtatgtttcatgatcaaactcttgatcaattgtagaggcgactccaaagacgatcatgagggttatgggagtcaagggactcacactttaccatctcaagagccatcttcaggtgtgtgtgcagtacatatatagatccatgtctatatatggttttctagttgcactagctagcatggttagaactagggttagcttatgctctctctctctctctctctcatgttttgtagattgttgtttttcagaaattcagacttctgtatctctggatctctcatgtgttgtagattgttgttttttcagaaattcagacttgggaagcagcacaaggatttcaacgaccactcggttaaggatggtaaacacacgatctacttgttaaaatagcatattacattcctaattgtgttcttataattagctggctagttagcttgttagtttgttcgcacatgcatgtttttccttcctttaattccgcttgttaaagtttaccgacttgatatatgttagcagtgaatttctgtttcgtttgtactagctagctatttaaacagcttaatttacttaccatgattctttcagaatagttaatttcacactttctctgaatataatcaaaaggtgaattatattcaaacttatattcgtccattttcccactgcagcaatggacatgcaacggaatgcagcgtcttcttcgggcatcatgggaagaagcatgaatgagtaagttgatttttttttcatagagtaccctagctagattaggttgttcattaattcaaaatgtggtttttaataactatcttattattcaaaatttctatgaattgttagccgcagcgtgcatgtgaatgaggcactaaggatgaagatggaagttcagagaagattccatgaacaattagaggtaattaagagcattgtcagaaacaaattaattttctgtaattcagcatggtgtcaaattaatcacatactgaacttaatagcccaagaaattacttattaatttgctttgctttattctgcatatgctccttcacatgttgcctttgaacttttgcatgcatgcatgaacgttcttgggaagtttacatgcttgtggacagcttatatgtcaatgtttgtccttcacatgttctgaaaatgagatgcatccatgcaagaacattcttgggaagtttacctagctagcacaactttatttttttcctatactcatctgtggcactcatgagtttggcatatatgcattttctttggacacaaaagaagtgaatataactaactttgcatgcaggtgcaaaagcaccttcagatgagggttgaggcccaggggaaatacatgcagaccatcctggagaaagcataccaagccatctcgtcctcaggagattgcgccacgtggcacgcaggatacaaatctctaggcagccaagctgtccttgacattggcagctccatgagcttcccttctctgcaagatgatctgcagttatatggaggaagccatctagatcacctgcatcagcagcatgagcagatggagatcaggccatcaattgataccttcttggcattcaattacagctccagtactgggaagagcccaatggtgtggcccggcgccgacgacggcggcggcgagccggcgaagatctccggcgatcatcagctccagatggcggcgccggcgacgacgacgatgatgatggaggccatcaccatgtcaggaggagactccatgggcagtaaggggtttgagggtcagatgagctctaagcttgacatgagatcaccacctccacagcaaacagtgctacctgtaggaagtgagaggatgagtagtccaattgttggagccaaggctaggaacatctcctatgggtaaactaattgatgatgaattgaagaggtaattatattaactgcatgtttaattttgtggtgaaaccagcaagcaggctgaactgatcttgcaagatcactgaataagcatatgtaactgtcttgttattagttgggagagtatacaaaagtagtattgcattatgcatcgttcaattaattaggatgcatccatgcatgcaattaattaagttcttgagagaggagggtgatctagataattagtcgtgcctacattcttaattttggcttaaagtttgtaaattttaattttgtgttgtcttaattcatccatgcttgtctgaacattaacgaaagttttcttatatatatgtatttggagtcgtgtcacagtacggcatgcatgcatgtgataacatgtttttactcatgggtaaatattttaaggatataattaagtgcaagtgcttgatcgatcgtttcatgaaattctagaaaggtggatttacaagtggagaaaaaagaacgtacctaagataccgaaaatacagcagtgttcctagctgttagattttagttagttcccctatccatgtatctgatgtatctagctactacgtacagtcaacatatatatatcctggcactccaattaatggacgttactgccaattatcctggagactgactgcttacgggcaatccaactaatccagtcaaaggaggaggagcgctcggagttagctttccttgttagggagataagaaacctcatggctgggaatagggatattgttattctgaagattcatcgtaactagaatagtgttagccacgccctggctaataaagggcgtagcgaggctttaactgctttctgaccggccggatgatacttgtaattttatctctcacctgttgggtgctgagtatgagtaatatatccccgttcattgcaaaaaaaaaaacatatatatacttgcatgtcatctagattatattaacattatttctagaaattttcatgattattactcggggcctgggggtaggcatttaaaaagattattaatgagcccaagcacttaaaaatgttatatattattggcgttccttttatcgatcaactactagccaaaattactcgtttgttgctatggattattaaaaggaaaaagtataaattaccccccctgaaatattggatgagtacgaattatcccctaaacttgaaaaccagtcaattttcaccctcaactatcgatattggatgaatccccccagcagctttacaaacggttttggtttacgtggcaatccagtcagcaatttttttctttttaaatcagcgggccccacatgtcagtctctcaccctctcttttacccctcacctctctacctctctccaaaatcctcactcttctcgcttcctcaccttgaggacggcggcgggcaggagcgacgaagggggcggcggagctcgggacgatgtcgggcggagtgggcggcagcaaagggcgcccgcaaccaccggcgctcgggacggtggtgagctgagcttagggctgagggggtggcggagctcggggcagcagaggacagagttcggggcagcgggaggagggggcggcggagctcggagcggcgggtggaggggactggccctcgtcgccggtgctctgtcttcctctcaccgatagagaagcaaagaagggagagaaggggagagagaaagaccaacactgcataacagcacaattaagcactgttcccgaatcacgatgcaatggcttaatttaaagtagctagctcaaatatatccacagttaattagcttggattaattttgctccaattatatcagtgactgagccctgtatagcatgatgcatgcagccttttcttgctgagagtggaagcttcgtttgttctgcgtcgcctcctttctgcaatgctgcatatgtatgtacagtctaatgtctatacacagtgcccctggaattgctgaacttcacactgcttgtgctagtgtacaattcagaattcagatcatatcatatggtcagggacacaagcaactgttctatttttttttcagcagctgttaagattaattattcgaggtataaatgaatgaagtattataaagttaggaaatagatttaaattaaatagtatttactataagaaattcatatatgtacaaatttttcaaaaatcacgtattgttaagagtttgagaaacgtgtatgttaattcatgttggggaatcccaacaagaatcgtgttcgacctttaaaatcccaataataataaatagaagaggcaacatgatagggtggggcagttgacgcgatattaaaaaaatataaaacagaaccaaaataacgattatgtttgatttttaaaagcccaataacaataaagaggaggggcggtgagcaggttgtacaatagtaaagataacggcgggtatgaatcagcccatttcatgcaccccaattatattggctgtataaaaaaactggctgttttcatatccccttgagtacatgggacttgcaattatatatggtcccgatttctttcctgaaatccactagaaaggtggaatatttctggtttcaggaaagaaatatttgttcctgaaatgcacccgccctcgtcccttgtattattacaagcggttttccttggtagtagcgtgatctgcgcatgcaaattaacatatatgtggctcctctgatcatgctaattaattacctgatgataattagggatgattttagaatattaccatagacaaaccctttaactgcgccactgtactcctatatatatctcttattacaccggtcagagtactgattatttcatcatcttcttcgtgcattcgatcgatccatcgccatttcaattcccagtacttcagcaatggacaatcaatggaatgcagcgccatcttcaggcacgaattcagagtaagttgatttaccatggctatattaatttgttgttcattaattcaaaatgcaccctctttttagccaaacaatcaaaattaattttcttttgtctatactttctgatcgatctagctccatgcatgttcatatgttttcaaaattaattttctgttctgtcgatcttcacagccgcaacgtgcatgtgaatggggcagataagaaggcccagagccaagaacaacaagaggtgagagagcatatgtatttttaaattcatcattgcatactgatgactagttcacataagaaattagtacccctttaagttcattatttgctcctcccatttatctcaaaataaattagtacccctttaagttcattatttgctcctcccatttataaaagtagcagatatatgtattaggatcggagcatataaaatgtagtataattttattaggatttgataaaaaagaggatatttgcggaaggaatagcatgttgcttctgaactttacatgcatgaacgttccccattaaattctcacatgttctatctgaaaattaaatgatatgtctcttgcaagaggaacattcttgggaagtttaccctgctagtgctagcacaacttttttttcaataatctttcaactcatcatgagtattatatttggcatatgcattttctttggacacccagaaagtgaatatatttctttgcatgcaggcagaaaagcacctccagatgagggttgaggcccaggagaaatacatgcggtccatgatggagaaagcacaccaagccctcgcatctggtgccacgtggcccgccgccaatgagcaggcgaagatctcacctccaggaaggaagtgagaggataaatctggatttttcacattttggttcttgtgaaaaacttatttcgcaaatagacccctaaaaaaacttatcccataaccgccgacgtggcggggcgatgctgaggtgactagggagagcgcgccagaatggctggcgccaccccccccccccgaattttttatttttcttttatgtttttgatatttttttcacgcttagggatacataagaaccaaacatagaaaaaataaactcaaatggacgtaatatgtaacccgtagaatttttttctctcctctcctctctctccgaactagtgcagaggagagagatgtgcaacttttttatttttatttttttttgatattttttcacacttaggaacttacaataaccaaccatataaaaaataaactcaaacggacgaaatatgtggcctgtggaatttttcaaagctctaccgaaaaacttctctcctcaaaaacacaatcttgcaagtggaatttggaggttttaatatcgccgaacctggcaaagcaagggagaatcgggtgtaactttttatgtagatgtccgtggatatattatttgcctgattccgagtccgtatgagaaagttacgcctatttcaataaatgacatattttgtccgtttcggtgagttttggaaaattctacaagtcacattttgtccgtttgagtttattttttatatggttggttcctatgttctcctaagtgtgaaaaaaatatcaaaaaatgaaataaaaataaaaaattgcatctctatactgtttaacttatggctatcattttatatggttatattttgaattagattaagtaagtaatttcatatagtctaatttactaaaggatctctcctatgtttaacatgctgatcaaaaggttttactaaagaagttatggtctaattttagtgaaggtgcaaagtagactaagtggtagacttagctaagtggtagttcgagttgaaattttttttggtggttggttgtatcgtgatcctaagtgtgaaaaaacatccgaaaaaataaaacaaaaataacatcgttgcaactccatacagagaaacatgaatggaggtgaggggtgggggggcgccagtcatgctggcgccctcattcctagggcggcgccagccactttggcgtgctccccctagccacctcagcatcgccccgccacgtcggcagggggacggcgcggcgccagccaccctggcaccccaaaaaggaccatttctgggataagttttttcaggggtctatttacgaaataagtttttcaaaaggaccaatatgtgaaaaatccagaggataatagccttacctccgcttcaaaatatagcaactatattttgggaggaaggtaggtattacttatttagaggaacatcttctatggctatggggtatcataatttatgattaagaggtgtaataaacctcttgcatgatcactcaataagcatatgtgtgtgtgtatatgtacactgtcttgtttgatggtgttccaaaatggcataattaataatatgatatccgaatttatttgtagaggcatatgactcagcacctgctaactgctcccagagtccaaaaatgtaataacctataaccaaacgattttgctaaaaattaggcgcaaccggagtttcttttgtttttctttctctgttttatttttatttttcatcctagagtctccaataggcattgtgccattatcaacttataatatcaatatttattcgagatggtggtgaaactcatcctttataaactgcaatccctcgtaaaaaatatataaaaattagctataatacgaatcaggctgaaacgacgtatccagcccatcagggcccatactagagcccactatcagcccaatacagcgcggcctgcagccggggcccaccaaagacttcccaacgtcaacgcaatattctcctacctgatggatggccggaaaatggcattggacggacaggatgcacaagagggcaactaattaatcgcattttattttgtcttccaagatgacattgtttgaccttgacatttgaattttcaaatttcaacgagacccaaacctaaacggcgatgataacgatgactgttaacttgaaattaagtgtcaatgttctataggtcatggtcatgtgagataacgtatacgatacatcatttatggtcgttgatttttctaccgtaagtacgaaaatgagtgaccaacattgattccatatataatgataaattatcagcaagagagtgatgaacaagtcaaactacaactgtagaagattaattaattaacgactaacggtgttcatcttctagaaaggctagagggtagaggcgcagcacaaaagcaccaatatcttattgccaggtgtcacatgcatgaccaaaaatgttccgtatattgagttcgtcataagggccagattagtctaaggtgaactttgagtacctttcatatttttgttgtgctgactaaaatcacatgtgcagatttgtttgaaatgatacttccgtatcactatttctgccatagtttgtaacacataatcttgctttgtcagagtacagactgtccttctatctcgttttctccataatacagggactatatgtgctattatggtaggtatagtctgttccaaaatataactatttctagcacttaaaatttgttttaaaatacaataacttctccaccaacattctcttctcaaccaataacaactcttccaccattcacttttttcacctaacttaacttcttaatcaatcacaatatctctctatttaattctacctaatttcttaacaatcgtgtcaaactctaaaacctcttttattctaagaggaggtattaacatattatcataaaactttttagcaactacgtaaatatgagtatagtagctacgaaaaatctcaaagattttttttaaaaaaaacccattagtactaaacatgggaagaaaagtgcttgaaaaggaacaaaatagatctaactgatagctgtgaaaaaatctctaaaaaaaagaaaaacaaactatatattagtattaggccttttattttctgattaagttgctctacaatatcaaatcaactcatcttctaaatttataataatcaaaactcaataatcatatgttattattttttttcgtttttgcgtatactttcttaatcctcatatttatcagttgcaaacagggcctaaacctttataagaaaagtccttaaaaaagaaaagaaaaaaatattctagaacaaagacagtgaaaataaaacctgttttgaccatatgaaaaaaaaattaatcccaactcccaattcccaagccaaccaccacagcaaagcctcccttcctttcctctcttcgtcttcctcctccctcccctctctccacaggtcaaatcctccccttccttgcttgcaatcctagcaagctccaagatcgcggcaagctagcctcgagggaggcccgcctgcccgggcctcgggctccgggggcccggttcttgaggtttcttggtcgtggggtcgaggaggtggtgggtggtggtggctgcggcttggcgcgatgaacaaccacgcggcgggcgggagcacgagcaacggcggatccggggtcgacggggatggcggcggcggtggcggcgcggccaggaggaacaccaagatgcccaagtgtgagcgcgcgagatctctctctctctttgctcttctttgcttgcttcttgtctcgtctagccttagtgcaagatcaggatgcgatgagcagagctgttgctgagagcgaagtccatgtagtagttagtagcttgggttcttttcgcaatttcaccccgcaaaggtggtggtaatctggctagcttagggggggtctcagctctcgagatggatgctagctcatgcatgttttctttttggattagtatggtaggtaatgatttatgttgggtgtacttacctctagtgattatatagctagtttcaatagtccaggagaaaccttgattaaattgagctgtgcgcaattctaatattgtttggtttgttctttgcatagacgaacattttaggtcgaaaacgccgatcaagtgttaggggaagcgaatctgactagcgtttccaggttgtgagctgattcttactccgtaaatttttcatgcgcagattccaagttcacgcagcaggagctgccggcttgtaaaccaattctaactccaaaatgggtaagtttaattacttgttgcatacttccaaggattaatagatttagggtgttactagttttaggggataaaagatgaatatatgtgcggagccgttcactgatgttttggctttgtgctacttaggttgtatcggtgtttttccttgtcggcgtcatcttcgtaccagttggtgttgtttcgctgctagctgcacaaaatgtatgctctgtatcttttacacaataggacatgttctggaagtttctgtatttatctgtttgaaactgttgcaggttgttgagatagttgatcggtatgatgatgcatgcgtgccagccaacatgactgataacaagcttgcttacatccaaaacccaaacatatccaaagagtgcacaaggactctgacagtaatgagcttaattttctggcagttacctcatattgaatgattagggtatatagttggagcaacactgcagctaaatatatctgggacatttttttaaaactttaattagcatgtggttgtaagtggacattgtatcaaaatttgttggctaaatgggaactgttttgtttttatctccagattacagaggatatgaatcagccaatttttgtatactatcaacttgataatttctaccagaatcataggaggtatgacatgattctattcaaggttttcaatcaagaatttgattacttagccttcctaaccaatctggcaacaatgaaacctatgacttttttgccttatgataacaataacatgcatttgatacctagtatgtataactctttccaaattcagatatgtgaagagccgaaatgatggacagctaagggacgctgcgaaggcaaaccagacatctgcctgtgaacctgagaaaaccacggcagatggaaaaccgattgttccttgtgggctgattgcttggagtttgttcaatgatacatatagcttcactcgtggcaatgagaacttgacagtagacaagaaggacatctcttggaaaagtgatagggagcacaaatttggcaaaaatgtctatccaagcaactttcagaatggtttgctcaaaggtggaggaacacttgatccggcaatcccagtatgtgaactcttgatctttgctatcacgctgttgcacatgcatgtagttggaggcaaactgttacgcattttattacatatgcttaacatcttgattttctgctaatatcaactatagttcatttgagttcttattcacgtagatatataaaaaagttgcctagccttggaatttctatgagtaactcatatcagttcgcattctatgtgacagttgagtgagcaagaggaccttatcgtttggatgcggactgcggcacttcctacattcagaaagttgtatgggagaatatatgttgacctcaagaagaatgataccataactgtgaagctgagtaacaactacaatacatataactttggtggcaagaaaaagctggtcctttctactgcaacctggcttggtgggaagaatgattttctaggatttgcgtatgttatagtcggaggggtctgctttttcttggcatttgctttcaccttgctatacctcataaaaccaaggttggtaacatatgttccctgcaattaaatggaaatgcatgtgctatatacttgatatgcttgtaggccatgcagttaaccttctcattatagttcactatgtagatgcatatgctgtggaatgctacattcatgacatgggtgttatgcaaaaagctcatttcctggattattatgttttctgagaacatgtctactgtcgatcattttttggtgcatatcattcttacgactattagtgccattaagagtgatgtggcattgctgtactgggttgtatcattgtatcaaaataaagaaacaaagctaaaatgttcatattgaacatgcatactttcgttcctttgctgactgagattttatagaagaatctctttagttgcaaattttgttagggtaaaatactaaggcagcacagggcacagctagttagtatcatactcatgttgcattgatatgcacctgtatttacacacaaccacatgctgtatttggtatatgaaagtcgttctactatatttatctgcggtatttttgcaggaaattgggtgatcacaactacttgtcctggaacagacatcctggaggccgttaagacgtccaaaacacttgtcgcataaaaatggctcatccggtgacatgtatcatgtacttaatgatgatatactgaaaattgtcagggagtgtaatcaggtctttggtttgacctagaccttcatgtacatcttagcataagaaccacgctgttttgtttcattgtttcttttgttatttcggaactgcatatagcagtgatgaatagaatcggtactgattgttttgtgatgaatagaatcctatcattctgaatgcctaaaccgttctgttattggcttaagtggttcattcatcatgctgatatgcatgcttcagtaataaaacaaacaaactgtcttctgataatgggaatatgggattgaataatttttaacagatttgcttgtctaccatgatcaaatgctgcaaacctctcacattatctcaaacacgagcggcagaatcaaatgcctttgcttttttttttgttcttttttttcagacaggtgtggaatagaatgacaaacagaactgaaattgccctgcttttattgcttcagacaggcgaagatgccaaacaaaactagttttcttcgctgaaacacagttcatgggagactacaacaatgctctgccacactgatttgcttgacatattcagcaatcagcatcaacagttcaacaccaaacagcttacataatccagcagccaagaaccatcacataacctattccatcagtacaatacaaatacatcaatggcacatttcttttgcctccctcgtttcataactaggaaacaagagggaattcagctcagtgacaggggaactgaattttctaaggtcagacattttgttcagctgctactggctcatccttgagattcttgctgagccactcctgagcagctaccaggtcagggagcacagttgctccagacttcctccagctctcagcatcggcggtcttgaatcggtccagaagcagcgcgtgcattccgatgctccgtgcaggggtgtagtccttgcgcatgctgtcgcctatgtgaagcgcctcttctggcgcgaccttgcccgccatttccagtgcaatcctgtagatacttggatctggcttctccacaccaactattccagagaacaccccaaagtcccactcggagccctggttaaaaaaaaatcaagagaagtcatgaaccacaacatttacttgtgaagatgataacattagaggagcatgaggtgtaatttgttatgcggagaatatcgaacctggttcagtcctagagcaggcaagatgacgtctttgtaacggtattctgcgttgctgacaattccaaccgtgagccccttcccgcgaagccacctcatgaagggctgcgcatcagggaataccgagtacggagcagacgagccaaaagaagagtaaatccgtttgaaaatcttctcaaatgtctcctcgtcatactcataaccagcctacaagacagcacatatcaagcaaccgaagcacttagcctctgaacacaaagacatcactagttcctgaaaagcttcagacctacaaaacagtggcatcaccttaacaaaagaatccttgacgcacatcctccaccagtcgatattcggcatcttcgctgcaaatccaaagcatgggtattgccttgccatctcggtgtatgcaagcttgaagccctcatgcattcgctggtagtcaggacatggcttcccagcagccttagctgccatacagtagtaatcaccaagctgccctttgtaggcaagcagagtaccggtgacatccacagtgatcaaccgcagcttcgaaatgagcgacatgttttgacgatgatcttcttctgagcagcaaaaaaataaaacgatgaaaattctacagtggcggatctaacatggggaaccatcaaactgttactactactagtattaaggttgagggcagatctctagaacagaagctagaggctaacgcaaatttggagaagaaagacagaaagtgcgtgggtagagaggtgtgccgtgtgcgtaacggatgcgggcagaaggagcagaacgagcgacggatggggatcggcgcaggcgggctgcggtggcgggaggatgtgctcactcaccaggatggatgcggtgggaggatgccgacgaagcggcggtcgcgtgatggatgggggtcgccggaggcggaggcggcgcctcgcgtgatggatggggatcgccggaggcggaggcggaggcggagtcggcggcggcgcctcgcgggatggatggagacggcagcggtggccggtgggcgagatagaagcgtcaaaatggcgagggcagtttagtaatttcgcctagcgcatcccattccttgcaaattgcacatcccatccccaccgtacccgaaatatgaaaaatagaaacaatgtatatatcacttccaatcccatttttcaaattaagcccttgggattaacctttaacacggcgggtttttattttaattttttatatggttgagatggtggataaaaaatagctacctttggggcactgtccgattaggcacggctgaccgaacagccatgctgtgtcggccctatgtgctgggtctagagcccaggtacggtccagtgagatgagatgtcgggtcatgttgagttggcatggcacgattagtttacgtggactgtgttgaggccggttagcccaaatttaacatatactaagaaaaaaaaatatgaatagagtctgttctatcatgttgcacaaacttcggcacatgttgcacaaatgagatcccccgctcattaatagcacattcctcatcctcatcgtcaagcaatgccatggcccttcacttcctactttcttcgccccgagctggtgagtccatagtgatcgctatgcttagtagttgtgctcacgaattgggttggccataccacgatgctaccgtgcagatctatgtcgacaagcatcctccgtcgcttcctcttccctgaacccttggcttcttcaatttttccgttttcctttactccgtcggtcccatcgtgtcgcacgggccaagctatgcgctattcctgggtcatgtcgtgctggctcacacatgcacttgttgtgttggcatgacaacccgggtagcaactgaagcacagcctggctagacaggtcgtgccagcacgaccctccgctaaacggatcgaccatgttgttcttgagctgtgagctgcacatgtgtgctcggacggacacagaagtaataatatagtactttctttattaaaagtaggaatttcttctatttttatgattaatgatgcttccgaattttaccgtttgcttagaattttttaagcccctgtctttttaataaattcagttactttctttccgtggaagatttgcaattttttaagcccataagtttcttatgatataacacactgttttttaatacgctgtttttttgtactactgcaaccggatcaatggtgacacagttaataatagtctagcacatctatttgtacatttttaatagaacaactagcctgtgaatgtggacgtcagagaatacaccatacaaagtggtatgcttttgactctgatactgtggactgtccgaccattcaaaaatgagatatttacttcggtaaatatacttgtgcaggagacccatggattcgattgcccaaaagccttgcaaaacatcttcatttcccgaagagatccgtaccacatcacatgtacacataccggcacccatcataacctacacaaattaatgaaacaaaacaatgtgacaataatcaaaacccattaaaattcatcaataaaattcatgcagaaaaggagaaaattttcagaactaccattccttccttttcatatttgaattttttttatcaactttttttttaaaaatttgaccaactttatagaaaaatatagcggcatttccaaccccaaacaaatttattatcaaaatatattcaatattatatttatgaaattatttgttgttataaacatggtcgaacctaaatatgtttgaataggaaaaatgttttataacatgaaatggagggggaagtaaataaacaagtaaaatgggaatgggccgtccttgggcctaatgagcagaagaaggccttggcccaataatgcaaacgatcgacatggctgcgtacttactgggatccttggtgatgagcatggcggcgccggcgaagtcgcacgtgccgccggcgaccttggtgcgctgccagtagctgttgaaggcgtaggaggcgtgcgccatgagcgtgtccggcaggaagcacggcgccccaggcgccgccaccatgtcgcagtccgcgcccgacgcgcacgcgtagtccatcgccgtctgcgccaccgcgctcgccaccgtcgggttcgccacgcaccacacccccgcctccctcgcccccggcgccggcggcgtcgtcgttgctggcggcgggcttcccgttcccggcgcgatcgatggcggcggcgcaccggcctgcgccggcgtcggtgggtttccagctggcgcgatcgatggcggcgagtcgccggggctcgccggcgtcggcggcagcggggccggaagagccggcttggtaggaggaggagggtacacgcagtacggcggcggcggaacgtcgtcggcggcgaccggagttgatgggcccaccacgtctttgaacggtggcaacggtgagtactctcttgaggtgccatttgctccacctacaatgcacacaaaagataattaaacaaggtaattaactagattaattggaccaaattagacgaaatcatacatatatatgagcaagtacaaaatcaaatcatacatgtatatattagtatgcattttgtagctagattgaattcttgatgcataattaccacattgaatggagaggatgagagctaggaggatgtagcgcttgatgatgatcaccattagcggcacaatgaatttcatctagtcagatgatcctatatatgtatattaaatttactacggccgcgaggctaccaaactgatgcttgtaagacattggagtacggggagagtgagacattgatatagtgttgcaaaggaatataaggagaaggattctaatccttctatggactacaccctctgtcccaaaaaagacaaatcttagcatcccaatgcaaaattaaaggagaggataaatgaccaaataacccttattattagtaaattagtattggtgggtagatagataaggggtattgaaggaataaaattttttgatttgcgaaccgagagtagataagaaggtagatgttgatttattttgggacaaaaatttgaatttcagaagttgatttattttggaacggagagagtcctctattctaaaataaacgaatttatgttatggtatgacattaccataccttacattatcttgcacctatccagattcgttgtactagcaataaattgaattacacatttgcgcgcactaactaattatttgaagccttattatttaaggctggttacaccttatgtcaatgaacaaaggaaaaaaatatttataggtaaaaattttgtatctgtactagtcaaggctagggaaaaaactatgtgtgaatggaaaagaaagcgccaaattcagccactagcattaagtttcaaaatttaaattttggttgcacccaacaaacagatgatgaaagacacaatattatcatattgtttgaatatattttttaaaaaaatataacgaatttttcctatgtaactatatgggatcaatcactaatattttagatgttaggacagaggtaatatgtataatatttgagtaaaaagatacaagtttaaaagagcttgcaacaaatggttaacaagtctcaggtgagcaggcaaaggggaagcaggaagaattttccagctgcatgctagatgctagccagatttcgctatgcaggctaaggtgcataagaatattggttacttggttcttcagaaaattggttatgctgcaaatgtttatttcttttcactgttgttttcggcgcattttgttcggattcttgatcttttctccaggtgcagttttggcacatgtgcttgcttggtcaatgagaaattcaaaaaagaagaagaagaagaagaagaaataaataaataaaaagaaaagaggaaatttgattaaagttgcacgtatgggatgggtcctttttcgttgctttggttccactcaagcagagacaactggctgatacatcattgcaaacttgtttgcacataaatatggaatacttcatattttcacatggccatttcatcgtttaatttgttagagaaattaagaaaataccggtgtgaagattttacaatgtactcatcgcaaaaggtagttaatgcatgaatggtctgctaaatgtcaatgacacataaaaacaataatttttcaactccctgatttatactatttgtataggtatgtgttttcatcttaccaagctataccaagtactccctccgtttcacaatataagttattctagcattttccacattcatattgatgttaataaatctaaatagatatgtaagtcattct

SEQ ID NO: 58230 - DNA, 7934 bp, Oryza sativa
ataagtgcgatggtgaacgacgctacagaggagatgatgaccatggaaggagcaaccgccacacgagatgaaagtgataacaggaaaagaagcccagacactggtagtaggcatagaagataagatagggagcaccgtgagtgagacgagcaaacacagggaaagaagtcagagtgatgatagtatattgctaaggtagctcacgtatattttgtatagttctttttctgttactttacatacgaggatttcagacgaagacgggtgagagagattttgacagttttttgctctcgtgtgtaaacttctcagctgaatctcacatttcatcatctggagtctgattacacctttcatctctgatcgaattgtctgcgaactaattgcgaatggcgtgcatgcatgcatgagctgtaatttgctagccattttactttggttatcagagagatctgaattacttgctagctacctattatagaacatacttcacatccgttacaacatataagcattcacctagccagaaatgcttatattttgatattttgaaatagatggagtatcagttcctagtactgctgatttgcaaaatgtccaaaattattagttacgtgtacttcatattcatacatgcgagtataggttgaagaaatgctgctgccagcgctatgctcgacgattgatagtttttttatttcctctatgacctatgataataattaccataaaatttacaccaagttgttaagatgaaaattacgatctttactacaacagcatttcgtggattggatttcacatatcatcaacgcaccacggatgaagccatgtagatatgtaggtcctgtttagagaagcttctaacaaatgcggtctctcttggaatctattctcacccagattctgataatgtagttatagaatgaaaaataaaagaaaataagtcaagagcgcaaccaactgtttcttagaatgttaactctcagaaacatagccgtaatatgcggttgtgggcctggacagtttggaagagcttctgattctgggagaagatacaactggtagaagcttcccaaaactatctagcttttcatcgaattatgagaagctatagttatagaatctataaaatgagtcttagggcctgtttgggggagctcctaactgctactagcatccttctagaatcagaagctcccccaaacagcccagctgtcggaccagattctaagaagctgtagttatagaatccagaaaatgaactagaaattagaagctggaaaacccagcctttctaaattttcaaaagctggttaccaaccagctgcttctcagaattttaagctccctcaaacagactataagctacccaaaagaccctgtgcaacagtgcagggttggacgaaaagcatagcatgaccaaattgggccatatacgcgggcaaggcccagatatttcttggtcatggttttctggcccaggccgagaattcagggtcggcccttacatctccgtagcacgcagcctagtgcggtagacggtttaagcgctcagaaatcaccaattttttgtcataaaaaacaaaaaagaaaaaaaatagaaacacctcgtcggcgtttagaaaggcggttggggttcggcggcggcggcggaggccggtgagtatccgcggccgcgcgaaccagtcgcctgagctcccagaagcatccggcgctgcggctcctccgtgatttgtgtatttttccccttgaatcccgcgccgtcgcggccgccgtgtgctcttgccgccggcgagaaggggggaaaacgcccgcggagatgtcggtcctcatcgtgaccagcgtgggggacatcgaggtggacctccacaccgacatgtgccccctcaccaccaagaacttcctcaagctctgcaagtaagctttcagtttacccgcatctagggcttgttctatctgtaagtgcgcgggatcatctggctagtaccaggggtaacgctgtctcgcggttgaggggttagccctcacgaagcagtttagcggccaattttggcgttgcagagggtgctacttggtgtggatttggtgttgtattctagaaccgcgaagggtgtatgaactatggagtctgctgggttaagattaattataatttaagctgctgctgatgtgtcgtgaatcattgtgaatgaatttaccttcttagtgtagtcattaaaatgtaggatggaaagattgggtcaattaggggatcgctctttgattattagggttgttatctgaattgaaaaaaaaagtatgcttactgatattgcaaaataatgcacaatagcagtattatgaatatgaaatagtaattttatggttatgaaatatagctgagttgactatttatagcaatgggagtaatcatcctcattcctcctatgatttgacttaccaggatgaagtattacaatgggtgcctgttccacaaggtggagaaggatttcttggcacaaactggggacccaactggaacaggagctggaggcgattctgtatacaagtaaacaattgctcagatgttttactgccactgattgttgaatacatgcctgaaaagggattcatttgtttttctgtaggttcctttatggtgatcaagctcgattttttgatgatgagatccgaccagaccttaggcattcaaaaaagggaactattgctatggcgagtgctggtgaaaattgcaatgcctcgcaggtgtgataccatattcctagccttcctaccgaacttagctcagctgttttgataaccagtacttgataatccattttgaggtccttaactccttgctgctaacctgctatttctaacctttgatttatgtttctgtgactttattagttctatatcaccttgcgggatgacgtagactaccttgatgataaacacacagtgagtagtaccttattatattgactcacagaatattttctttggaaaaatccactttatctacagtgattcatatgtatgtccttatcaattataggtgttcggcatggttgctgaaggctttgacacgctgacaaagattagtgaaacatatgttgatgataaagggagaccatttaaggacatcaggtaaaataccttttttaaaaagtctaaactgaataattagaacatgcttgctaatatttacttactttctggtgttactttctgttgtttctgctttatttccaactgctgaccttctgcaaaatgttcaatggacaggattaaacatacgtatgtcttggatgatccttttgacgatcctcctcagctcagtgaacttattcctgagaattctcctgtagggaaaccacaggatgaggtaatatgagttctgctattttgctcatgttggaaagatgataaaccaaaattgtctcaccaaaatcacaggctgtcttttgtttaattcgttttacctccacattcttgaaaactatttatttgtgcacatacctttttaaaagaatatggtatgaatttcagttgaggcagccactgggtgtaggtgtattttttttccttgttctgtctgtacaaattatcccgatccctaaaatatctagacaggcatgtttcagattagtcctagaagggtgtggttttgccgtgattctcctgaatgctatgtgttgtccttttaacatggtcatgatattttcttttcactgtcaatgtacagattgcagaagagcgcttagaggatagctgggtccctatggatgaaatggtggctcctgaagaacttgaggagatgatccgctccaaagaagcacatacaaatgctgtgattcttgagagcgtgagtcctgatgccaaataaaaaattaacagttcgctcattattattcatcgtgttataactgataaaaatacctttgtcttattcaggtgggagatattccagatgctgagatcaaaccaccagacaacgttttatttgtttgtaaactcaacccagtaacacaagttcgtatcggttcttaattgattggctttgttctctacttccactacctttttatgtatagattcacagatcagtttggaagtcatataggtattgaatttatagcaatatagcttgaaatattgtttggtaactaaacggctagtgttcattgttttgtaggatgaagatttatatacaattttttctcgttttggaactgtgacatcgtaagcgcattttcctaagttcaattaatgtgcatatcttcctgtttcttattttgttaactttttttattattccttgcagagctgaaataatccgtgattacaagactggtgatagcttatgctatgcttttattggtgagtttcattcctcaaaagctggtgtacattgacatactgtgatcaagcatcggattgttgttagctagagttatgctagtccgttcatcgaacgcttgagcttcattgatagctttcccaggcattcatcctccaattctttaggcgtgttgaacatcatgttttaccctcttagatctgttatcctagtaaggaacaactgagtgacctaatttgcaacaaggttctggtgttttgtgtaaggctgagttccaaatgttagtggctatggatatactttagttgcagcatgtaaagcacaccttttagtttgttaatacttaataaaccagcaaatgggttaaatgcatgacgtggcaaaaagactaatggtgtttacttgtatctcctcaaaaataaacattaacgatttaagaaaacaaactgagtagctccattgcacacttctgaggtattaaacaatataagtttcttgatagctcaatttttctctcagggttacggtgtcagtgtgatatttggcacagactgcagtagacagtagatggcctagaaagaatttattgttccaccttgataaattggcaagatctgaatgctattataaaatgctaaattttatcttgctcttttgtagaatttgagacaaaggaggcttgtgagcgggcattcttcaaggttagttgcctaaaatcctgtttcatgtggcagataaaacttggttcttgtaattgtactttatttcccttcattacttagcatttctttgctagcatatttttataagtcatttttgcttgactagtgaatgttacttgattgtttgtgccttgacaattcagtattgtctatatttgtaattattttaccagtgttttcatgggagcattgcttactcaatgatatgcttgcagatggacaattgtttgattgatgatcgaagaatacatgttgactttagtcaaagtgtttcaaaactgtggggtcagttcagacaaagcaaaagaaatgcaaataaaggtattcttatttccatggccttagaatatgattgcagttttcagtttcttttttatttaagctaactgcatggtagctttcttttttcttaaggaaaagcagtaggggagatcctctactgttaccctttcctacaaggaaaagaactatataaatctatccttcatcaaaattcttttcatctagactttggtggcactcaatttcctttcagaccataattatagcatcctcctgtatcctatagaaatttatttattcctataaggaatttagtgttttgtaccatgcggaagatgtctagagaagtgtactgattattattcagcacagttaaaccgtgtcaagtgtaaagatggcaacaatgttcccaataagccacaggacaaagaagaaagtaaacatcaatctgagcaagacttccaacatgttttgctttctccttagcatctctttagtatcgcatctctgtctttaacatgcatttgttctctggagttcatctgtaaatggcagaagtgtgatctgaatactgtgtcttagtatattagaagtctgcagagcccctaacagaatatattattactagtctttatattaccagtttttggctaaaccacttgccgcggatggttcagattgtggcaaatagcaaactggcctagcgtcatcatttgctaggcattctgaaactcagattgttggtttctttgtatatgtaatatacgatcaatttcaaatagccctgtactcaacttagccattaattcttccagtaccaaactaacagaccatgttttatttcttacaatatgagctgagcaatggacctgaatattcatatctgcttaagatcatttctctactagagtaacttgcacaattggtgagccatggaactgaattctcataagagacctttgccatagaatattaaatcatgaaattcctatttttctgtagaaaaggttgatttatgaaataattttgatacgaaacatctcatcttatatttctaggttgaccacatccaagcccattaatctataggtactaggaagtaggaaggtgtacgcagatgcccacttcattgcggaatttaacattctcaactaggactcttgaactctagttagttgtgagaccatacttttttactattttggagttagaattaattcacatgaaagctatatgatgcaattctctttgcagatggatgcttcaagtgtggcgcccctgatcacatagccaaagactgtgaccagggcactgagcagaaaaacaaaggcccaagttatgtcctgaaagatgaaaacactcagcgtggtggaaataaccgtcgaaggtcattttcttttccctatctatcatatttcctgatcgtctcattttctgataatcttctgttgttttgcagctatgatcttgtctttgatgaagatggtgaaaattatactgatcagcaagatcctggaagtactggccgaagaaagattcaaagaacagatgatcgcaaatcagggctgccacctcggggtgaccatgacaggattagccgggagagaactcacagtgatgagaatggtagagaaggtggtaaagaaggtgatagggaccgagggattcgtaagcacgaggactaccaccgttacaataaatctggtgaacggagctctagtagatacgatgatcgtggctacagcaagcacgagagcaggggcaaatatagggatggcaatgatgattacagacgacaaccgggaggtggcagtcgatatggcagggataagtatgaaggtgaacggcgctacagagaagatgatggccatggaaggagtgaccgtcacaagagagatgaaagtgataacaggaaaagaagcccagatactggtaagcatagaagagaagacggtggtcaccgtgagacaagcaagcacagggaaaggaggcagagagatgatagataggtcactgcatcaccgtcagttttgtcttgcctgtttctcatcatacattgaattttgtcattcttaatccaaagatagcaccagaacactaaacatgtagcttagaatctgcgtgtagacattatgagagctccactggctacagattgttgtaacttgtagaccttttcttttctatacatgctcatggacgttgttctttttgggggacgatcaccatctgattgttgtcgaactgttgccacaactagcagcttgcttttttaattgctcttgttctagaggaagcccactgcaagtgttctacatatttgtgagtcttaacacgcctctagtttccttcagctacacgctcagactgttttatacccttttactcagagatgtaaatcaatttgatatcatttactaaaagttgtctataacataattcatgtactctgtcgggagactctggacaacttctcttcttttctttttttacattttaaaaaaatcatatttaaaccgtgtttcaaatacattcttttttttttcggaatttcttccaatcgggcgttgggtgggttgggg

SEQ ID NO: 58231 - DNA, 7789 bp, Oryza sativa
aggttagggtttttaatattgaatttattaaaatactaaaatatatagtcaagaaagaggatctagaatatatctagatgtgtatgtttatttatctatattctatatttaatgtaattctttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctcttactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcattcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccatgtatgtatatacatgtatgtatatatatacatgtatatatatatgtatatatatatgtatatgtatatatatacatgtatatatatatatgtatatgtatatatacatatatatatatatacatatatatgccataagtgtggctctgataccacacttatgcttcggacaaaaaacactgttcaaaaacactatttattcggctgaatactattcagtttactgtttattcggctgattaatattcaaaaacactattcagtttactgtttaaattactgttcaatactgttcacttcgagagatattttaactttaggatctttgcagggtggcgaatcctatttagacagcctcagaagcttgcttcggatgatgtaaagtcctactcggtactcaccgtatgcctcacctatctatctttttagaagcaacttaaaaagatattccaagtcacacttgttctagctaagagtttatcgtctccccaggcagttccacccgaagggaacacttctctacggataccgattctccagacgcctatgcaagatgcaggctaaaaacgagaacaaaccgaagaggtttctcctatagggtccttagcataaacacttgtctagaacaaacgtgcaggaatacttaaggaaaattacttcatattaaacagataagcttacatacggttttccctttcgggaaacccgaaggtaggtacaagcaagctgttcttaccttacacagcgttattacacaactccttgcttcaatatactatacaacgtaggctaaagtcactactactaagaatggtggaatggagggtgagagcgcgcttggaagctttgctctgaatggtgtcttcgttgttctttactttctttactctagctaattctctatagaaataaagttttttatctcttattttaggccactcacacttcatagagttattatattcttcatttatttcctttaatttattttcgtaatattttatctcactttcttgatctaatttttccataaactctgaaacactatgtcttctattatctattatatttctatcagatgcttctgtttctaagtcatctgtggttctgggtttgtaatttataaatctaatgctggtatttcctttactattttgataacttataaaattttcaggctgactcaaagttttgctttcaattaaatcactaattttccattcttctcctgccctttcttcagaacttatttttaaagggctcatgaaagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttacaggcatcattagatctggggctatatatgttatcaacatattctcattcatgtcaccttctaaaaatcctaatgctgctttatctattgtgtcccaccttttatctaacagagttattaaaactttagctcctaatttctttcttgtcatacctttgattcctattatatacataccttggtgaatatatttataccctgaatactttaatccattttcaaattccttggctacaatttttaactcaactggctttgttaaaacgcttaactctacttctctagatattctgtataacccatttttattctcaaaaaaaattccatgcaatatatttgttgaggtcttattgccctcagagtatctctttgatatctttcgagctgtttgtctacttctgcaatatcttcaagctcatctatgtcttcatttttacctttttgtttatcaatacagcttaaagatttatcgtctctgcttgctattcttctaaacaaactcctagataggtccatttttctgaattaatagcttgagacgaggtaattatgcctgttgaagccaaaactatctcttttcctttactagaatttattatttctaataattctttgatatagtcactgttttgtaatatcttattctgccttatcttataatcctctagctcttttagcactgaatttaatttattactgacaagcaaatattgttcttcagattgctttcgttctttaaacaaatcttcaaaccttcgctctaaatcttcctgctttttatcccaatttatataaaaattatatatcagatcaacaattaaatttaattgactattgttagagtgccaactatggtcttcaatgtgatttaatctacaccttatattcagattatctttggtagtaattatctttccaatattagcttctgaatttgatttctctataatgactggctctgataccacacttatgcttcggacaaaaaaacactgttcaaaaacactatttattcggctgaatacttttcagtttactgtttattcggctgattactattcaaaaacactattcagtttactgtttaaattactgttcaatactgttcacttcgagagatattttaactttaggatctttgcagggtggcgaatcctatttagagagcctcagaagcttgcttcggatgatgtaaagtcctactcggtactcaccgtatgcctcacctatctatctttttagaagcaacttaaaaagatattccaagtcacacttgttctagctaagagtttatcatctccccaggcagttccacccgaagggaacacttctctacggataccgattctccagacgcctatgcaagatgcaggctaaaaacgagaacgaaccgaagaggtttctcctatagggtccttagcataaacacttgtctagaacaaacatgcaggaatacttaaggaaaattacttcatattaaacagataagcttactgattatgaattttctttattccggacatgtctgtggaaacttctgccttattgtcgtcaattgtgtgaactatttcaggacatcttgtgaaatatttgtcatgaataatattctttgtacacccggtgtctactagtgctaatattttataagatactttgggtgtcaattttattttaacagggattcttatacctaatatttctttgaaaggcaatcttactatatatttatttccaaaattagttatggcatctcttagttgaattattttagcagtattactgtcgtttagtgttatcaattgctctttaaattcggtgtttggtatgtccttattttctggtaatgctttaatatcacaattattttttaggttctctaattctacttctagtttatttagtctattttctaacactcgtactctactagataaagtcttttcatctgattctaattctatttcttttctccatttttgtttatttgcttttatacattcagcacaagcttgttttagacatatactacaagtcactctattttcttgactagggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgattcgtcatcttttatttcatcatcacatactaatatgttttcgtttacgctatctataattagaaccctcccttgttcttcatatttactagaatatctcttttgatctttatttgggcatgttctacttaaatgatctggcgagttgcatataaaacatctgcatgttttgtcataggttttctttggattatatcttcttacatttcttttatgtaagaagggtgctctattatctgatcttcttaagaaataccttttctttgttctaatattattgttgtttctaggcttgtcttctccatatgacaagggtatttgaactattttattgcagaaattgtaatccgagtgtttcatagatctttgggcttggatacccgtgcatatttttcttagttgcttaaacacaa

SEQ ID NO: 58232 - DNA, 4067 bp, Oryza sativa
ttgcacctatccttgtacctgaatacattggttgcaaacttcgcagtggtaactcaatatagaagttagtttacctttgcatgttatagttttttgtgtctggatctcagttgacctctggttttctagtggagtttaggctactgcatcagtatcacttatttaactggtagtataattcaaccttttagttttatgtttgtacattctaggaatagtatgccttagtttttatgtttatacattctaggaatagtacgcacatagcgtaatttccacagtaccataagagaatcgtcgagaacgaaatcctcaacctagcatgtcataagtcattctctttcatgcacctgtaaatccttgtatgtatcgtgtggcaattatctgttgtcatatttttgacgtaatgccttactttgcttctcttgtaactgaattgtttgttataatgtactccctctgtcccaaaaaaacaaatctagtataagatgtgacgtcagttcaaattagtattactaggatgcgtcacatcctgtgtttgtttattttgggagttgttcatgtttttgttttgactcttgaacatacttgtttctggtcatttattgcactggatttgtcaagttaactagtgacgctgacatcaataatttttttgaagttttgatgaatttgttcattccctatccaacataatagatatttgtgagacccaacatatgtgaaaacgttactgttgtactgcaatttttttggatctacagcatatattcatccatttacttggtgatgtctggaatactgttctcaaacagaattatagatgctttcatcaaatttgctgtaccgaggtaattagtgtagtcgttatttttaagggttatatttttaatgggcgtgggacttccagattatgcttccacttggtataaccgatggcataaatcaatatatatgttctgccgtattttgccaacttcatatcgcccggatatatatgttctgcagtattttaccaatttcatatctcccgaacacttctgctgtgtgctataacggcgtgtatattcgaacttaacgtctcccattgttttgttatatgggtgaatggtagcaaagttcgcactgtcatgttgttgagcttgtgatttgtggagagctgctggtaaggagccatgttgcattgcgtacgtgggatgggttggtgtagctcctttccagcagtagtgaacaaacgaatcgccaatcgtgattgaggcgcagccgcatagcatattgcttgaaaactacgaaatggtataaacaggcgagctatcaaggattcaagttacaaaatgattaagcgaacagtacgtcaatcttagattgtacggcctaactcgcccgtaaaatcccagattctgggctcagatgcttgctaaaatgcaaaacggcgcgttaaacagaaacttctcttgtagaagttcgcaaatttctttaggagaaaaatccaaattccctcataagtcactttgtgttgtcatcctcacctctacaactcaattaggtaaaaagacatcccacaacacaatctctcttctaacatcctcagtatagatttcattgatttctcttgctcaatttcttgtgattttcttttcgtttgcccaatttcttgtgacccacatcagaactacggcgactttctgctcctgaaacacgttacagccacgttgttttactgttcgaaatttgaatcacatatgatagagcgagctttgtggtgaaaacggatcggataatatactgttcgaaatttgaatcacatatgatagatagagctttgtgctgcatctaggggtgaaaacggatcggataatatccgatccgctccaaatccgtctgaaatgaggatatagaatgtgcttttagaattctggtggatacgaatgtggatgcggatagtatgaggcggatgcggattatgcgacatttttgtcggattatccgataagccgtttgccggataatccgaaattatcaacatatataaccactatatctattgcatataatataagtcggtacatccaatgcccaaattcatcaattaacatagattttttagtctaacgcttttatcgttgcatgtcacactcatgtagctatattttttatattatgaacatcatgtatttatgttgtttagcaattaatcgtataattattacgatgggttatttattgactatattgtattattattccttggatttatcgatgttgcattcattgctatacacgtaacatccgataaatttaatctgtttccgaaccaattccgcattgactccacaccattttcgacgcccgaaacaatccgctccgcatccgctcggaatctgcttaaaaatatggtttaagatatggtatgagcactatccgtccaaatccactccgttttcacccctaactgcatccttccgctatggtatcataccaacatgttgatgaacgattggagaaattagtggaaattagacagaagggggaagttagaagagaatttgagttgtgggcgattttttttttacctaatcgagttgtagaggggagagtgaaaataaaagatttgtagggggtatttggattttccccaaaataaaacgataggcccatcaaaccctaaaaaggttaagcacggatggtctatcaaagcaaaaaaacaaagcagtccagtcaaggctgaaattgttaaaagggttcattaagacccaaaagattgaaagggcctactgaggcccaaaatgttaaaagtgcgtggagctaaatttcatgaaattttgtcatgattttgatatccacaaattccacactccacggtcttggagctaagctagcaaaattttggatcaaagaaaatattttatacttttttttaaaggttaatacttataggttttactagaaggctaactctcaaatttatagcatgtaggctaaatttcatgaattttttgtcctaatgttaataatcacaaatttcaacgcaacattcttgatgctaataatagcaaaattttgggccggaggaaaaaaattgtgcatttttcctaaggttaatactcgagaagcctacaactcacgaatttatagtgcgaggggctaaatttcatcaaaattgtcatccatatgttccttgtgctagtactagtgaaattttggaccgaggaaaaaaaattcatgtgtttattccaaaaggttaatactcacaaattttgccacaaggctataactcatgaatttatagtgtgaaagctaaattacatcattttttctcctaatgttaataatcacaaatttcacacacgactatacatatgataatactagcgaaattttgggtcagcgaaaaaaatcatgtattttttttctaaagattaacactcacggagtcatgggttttggctaaaggctataactcacgaatttataaccttagggcaaaaattaatgaaattttctgtcataattttaatatgcataaattttacatagaacgatcctggtgctaatattagcaaaattttgggcaagagggaaaaaaacttgttttttttcaaaggttaatactcgcgggttttgcgagaagcctataactcatgaatttatagcatggatgctaaatttcatgaaatttttcttcttgatgttaataataaaaaaattcatgcgtaacgttgatgctattactagtgaaattttggactggaaaaatttcatgctttttatccaaagtttaatacccatgggttttatgtgaaagctatataactcattaatttatagcctcgagacaaagttttattaattttttttgtcccaatgttaatattcgaaaaattcacaagcgtattttttggcctatgaaaaaaatcatatttttttccaaaggttaatactcacgggttaatactcacaaatttatagcatggtggctaaatccccccccccttttttgctatttttaatgtttttcatgaattatacacacggttatcctgatactagcactagcgaaattttgg

SEQ ID NO: 58233 - DNA, 18293 bp, Oryza sativa
aaccagatacaacgggcccttcaactatcaaaaccggtgcaaacaaagtccctcggcggtttagatggtggttttggctgacgtggcacctacgtggctaatttgactcggtcttcatctaacgtggaattgacgtggcgcttacttcgcaattcgaaccggaaaaataataaaacatgtagggcccacgtgtcactctcacatacaaaataataaaaaatggtgggacccacgtgggccccacatgtcatcttcacacctcccttcttccctcttccctctcccccctctctctcatcttcttccctctccctctcctcatctcctcttctgcggaactacagtaacatgccgttgggggcatttatacccgttggatcaagttttggatgcacgagattaaatgctacagtaacaataaaaataattagtatattttttattgtggctacagtgttgttcactgtagcaacgagatggcactgtagctcccctcacgtttcactgtgcgcctctgccgttttcccctcaacggcagaggatgggaacccctcttctgcaggcgagcgcagcggaggagcgatgacgccgtgtgccacgactggcgctgcctggccacctccctcgacttcctcctcgcccaccaccgccaccagctgccgccccctcgtctttggttgcgcgaggtggaggagcaacaccaccgtcgccgatgccgatgctgctgtggattccatcgacctcagccaccaccttgatgagctagtgcgtgacggggacctcgtcgatgggggatggaccaccggaggagcggtaccacgggcgccgccaccttgatcatgtgttcccactccactaattcctttatcatcacaaacaatcgaatgaagtcaatcgaacgaagagaaaaccagtcatagtactaatcaatccctcaaaataagcgatttagtgtggaactactaactaaagcaaagcatgagcgaacaaaagctactccgcatccttaacttcttagtaccacggatggacagagatgctagttttggcattcctacaagctactacgaccattcatcaatcactcagaccgaaatcagagaaaggggaagaggtgggacctggatggggagggcgtccatgtcagcgcggagcgcgacaatagggggaaggccagagccgacgtcggtgacgatgccgatgccggcgactacgcggcggtgaggccgagctgctccagctcatggcgggcgagggcaccgttgcggtgctctcggaacgcgagctccggatgggcgtggatgtggcaccagaggtggagcgcctctccctccttcccgccggctgacgcgcgctgccgctcctctcccgtcgaccggcccgacgaactcgcgtcagtcgccctctcccgtcggccgctggatgccatctacagaagcaaaagaagaaaaatatagatagagagaagagagtagttaggatgacatgtgggtcccactattttttattattttttgtgtgtaactggcgttggtcccactgattttattattttttcggattgaattgccacgtaaacaccacgtcagtgccacgtgggacgaagacctagtcaatggagtgccacataggcgtcacgtcagccaaaaccggggacagtactgctgagggacttttgcacgggtttgtaagttggggaatgcgttgtactcggttttgtagtgtaggaacgaattttgaactggtgacaaattgagggacctaaagtaaacttattcccaaaaattacggtccggattggatggggaataagtccactttccatccctcacctcatggccgtgtatgaatagcaccctcaaccacaaaaccgggtaaaacccatcccccaactccgaaaaccgttgcaaattaactccccgggcggttttggaggcggttttgtcctacatagaaattgacttgcttacgtggtagttgacttgctgagtcatcaagcgggacccacatgtcagcagtctccacctcatctcttcccctctctctctttcatatcttcctcctctcaccttctatcagcagggcggcgactgcgacgacggcgcacggaggacgagctcgtcggctggacacgccgcacgcgggggagcggcccggctcgagcacgcagaggaagcgggaggcgccggggcatctcctgagagggggtcgtggaggacaaggcatcccctccaaattgccggccgtccacgcgtgtggaggatctcgccggccatcctcgcgcggagagggtctcgtcggccggccacgcatggggaggatctgtcggccagccccgcgcggggaggatctcgccagccgtccttgggctgggaggatctcgccggccgaccgcgcgcgggggaggagctcgccggccgtccgcgcgcagggaaatagctcgccggccgtccgcgcgcgggagaagctcgccgcccgtccgagaaggaagccattggggatgtcgccgagcattgggttgtgctgcagcatgaggacagagaggctccggcacggggacgacggtggcattgcctgcacctgcgcatggcggacaaccgctccgcgtcgcgcgcacgctagaagaactccgctagcttgtttgctgtttgctcgtgctcttcgatgatttcatggtctctgatttgttttgttcgttcccccttcctgtttcgcgtgatcgccggcgtcttctctgaattcggcaaccaccatgtgctacttgtcttgccgttgatcttgctgctcgattctatcgcctcgcctccgcttcttgatattttcctttcccgtttcttgaagggaatcatggtgagggagaaatgagatgaggtggagactgctgacatgtgggtcccacgtgatgactaagcaagtcaattgccacgtaggacaaaaccgcctccaacaccgtccggggagttgatttgcaacggttttcggagttgggggatgagttatatctggttttgcggttgagggatgctattcatacacggccatgagttgagggagggaatgtggacttattcctttggatggtgtcaaatcctagtcctggccaaattatatgggccgaaaatttaggcccatactgatagtggatcgggcttacatccagtaattagaagctctcggccacccacttccccgttcaaacttttggcccatctgaatgaggattatacttcttgttacgcctgtatgaatcctattaaatatcaattattattgatataatcctcattagatgggccaaaagtaatttttagtaaatcgtcatatatcctataattaggccacacctcagacccaaaattggctcaaagtggtccacaagtctactggtgccaaaactgttgcactaaataggtaaatgaattatgaacccacatggccatcttgtactcggccaagtattggcccacttgttgccctaaataggccgaaatgaagctcagttagaggccatgattttctcccggaattaagttcattttgacttccttagccagttgccgaatctgattcgtatccctgaataataatatcggatatctcgaccaccaactattaaaaccaaatgcagtttaactctctcggtggttttggagggtggtttcactgatgtggcgttcacgtggcatcccagtcatcaaatctctactattataaaaattgaaaatatttttgtcggtattttggtacatcatccgtgtatgagtcggtttttaagttcgtttgcttttggaaacacatatccgtacttaggtcggtttttaagatcgttcacttttggtaatacagaaggaatcatataagaaatctattttaaaaaaactcgcatgctaacttgagacgatcggactcctaactgcagctcatgatttttttcaaaaatataaatatccaaacgaacagtgaatttcattttaactaaaccatataacaataataagattaaaatagacttcacccattgtaacgtaaggatattttttctacaaattgaaaaaataaaatgggacccacctgccaccctctctctatgactctctccctccccctttcttcctctttcttcttctcggccacccttctgcaatgcgttcgccgcggccgtcacacaaagcgattaccgcatccctcagatctcgccgcgcccggccgtcgtgccctgcccttgcctcgctggataccggcggcgcggtgggtcggccgcgcgatccgatgaggcggcggccatcgtcgttcaagcgccggttggtggcagcagcgcccgtggtgattccgcctcgtgccctcctcctcacgcttgcctgcctcttcctcctgcttgcgctccggggctcgcccgaccccgaccatgtagtgttcccctccaccgacttgtccagatccgcggccaccaccttccctctcctccgtcaggtgagcgaatcgcatctttatatctcatgcaagaccggcggcatgtgtgtgcactgttggaattaatagatgggctaaggcccattcgaagattaattctttgtaaaatcacaaaagcccacctcatgggatggcatgcatgtggagtttagtaccactttgcttattctaggagagggggacctccttaaaagggaggatgccctcctagccacttgaagcatgtgtggtggagagaagagggggaacaaacgagcgcgctcgctggcctggcatggcatgttttgttttggaaacattccaaaaaattcggtgcgtgaaaacggcgtggagtccggataagttacgcgcgacttatccggttcggttacgcggagtggagatcgtgcgggcaccctgatcaagcgacctatctctatataaaccgagccgccgccttcacgcaaaacacacgaaatccatctagggtttgcctcctcctctgtgttgcgccgtcgctcgtggactactccatcccgctcgccagcgtggaccggcgatcgggagagcaggtctccggaacctctgccttcgacatcctgcaccgggagaaggcggcaataagatttttgggaagcgctttgcgcaactgctccctgttcgtccgtgacggttcgccttcctctccgctcgcgtgctgcgcgccttcgtcgacgctcgcaaccgcgagtagttcctgccgagcaaccggtctttccgccacctcggtacgtgttcgacatgttgcgcatatttgaactgttcatattttactgcttagtttacatgtgtagatctaatgatgcgttaatgctagtatatatctgtaatgtcatgatttatttatggaatatattaaatcattataggcgctgtgattttactatggctggttttgccgatgcactgaggccggataaatttaccggtgtgcactttaagagatggcagatcagggtcactctgtggctgacagctatgaagtactggcaagcctatgggcgttcttaatgctgaccagcagaaagaattcaatgaggccactactctctttgtgggatgcattcttagcgtgcttggcgatcgtctgatcgaggtgtatatgcatatgaccgatgctaaggagttgtgggatgcactgaatactaaattcggtgctactgatgctaacaatgatctgtatatcatggagcagtttcatgactacaagatggctgacaaccgttctgtagtcgaacaggctcatgagatacaaaccatggctaaggaactcgaactccttaagtgtgtcttatccgacaaatttgtggccaggtgcattattgcgaaactacctccatcttggagaggtttcggtactgcactcaaacacaagagacaggaatactccgttgaggggttgatagcatctcttgatgttgaggagaaagctcgggaaaaaaagatgctgcgtctaagggcgatggtgggtagtccactgctaatgttgtgcacaaggcccagaacaagagcaaagggaaatacaaagctcagcagaccaccaacttgaagaagaagaagaacaacaacaatcctaattaggatgagaggacttactttgtgtgtggtcaacctggccatctggccaggaagtgtccacaacgcaaggggatgaaggcacctgcagggcagacctctaagtctgctaatgtgaccattggcaacactggagatggaagcgggtatggtaatttacctactgtttttttagttaatcagtctactaattggtgggttgatacaggggccaatgtacatgtttgtgctgacatctcattgttttcttcttatcaggtcgcacggggttccaccgtcctaatggggaataggtcacatgcttctgttcatggtgttggcacggtagatctgaagtttacttcggaaaagatcgtgcagctgaagaatgtgtagcatgtcccttctatcgacatgaatcttgttagtggctcccgtctgactagagacggatttaagttggtttttgagtctaataaagtagtcgtgtctaaacatggatattttattggtaaaggttatgagtgtggaggcctgtttcgcttttccctttctgatttctgcaataagtctgtgaaccgtatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacctctagaactcctacactcagatctctgtgaaatgaatggggtgttgacgtagggtggaaaacaatgtttcatgacgttgattgatgatgctactagattttgctatgtgtacttgttgaaaacgaaagacgaggctctagactatttcaaaatttataaggcagaagttgaaaatcaacttgacagaaagataaaaagacttaggtctgatcgtggtggagagtttttctcaaacgagtttgacttattctgtgaggaacatgacattatacatgagaggatgcctccctattctcccgagtctaatgggattgctaaaaggaagaaccgcacactaaccgacttggtgaatgccatgttggacaccgcgggattacctaaggcatggtggggggaggcattgttgacctcgaatcatgtgttaaacagagttcctaacagaaataaggacaaaacaccatatgagatatagattgggagaaaaccatcactttcttacttgcgcacatgggggtgcttggcgaaagtcaatataccaataacggagaagcgcaaacttggacctaagactgtggactgtgtctttctgggatatgctcaccacagcattgcctatagatttttaatagttaaatctgaggtacctgacatgcatgttggtataattatggagtctcgtgatgctaccttctttgagagctttttcccaatgaaggatacacatagtagttctagccaaccctctgaaataattcccagttcaatcacaccaccagaacaaactgaacatacacatgaacatgttactgaggaggatgacagtgaagctcctcgaaggagcaaaagacaaaggacggttaagtcttttggtgatgatttcactgtgtacctcgtggatgatactcctaagtcaattttagaagcatacgcatctcctgatgcagactactggaaggaggctgtccgtagtgaaatggattccattatcgctaacgggacttgggaggtgacaaagcgaccctatgggtgtaaacctgtgggggtgcaagtgggtgttcaagaagaagctcaggcctgatggtactattgaaaagtacaaggctcggcttgttgctaagggctatactcagaaagaaggcgaagatttctttgacacttactcacctgttgctagattgaccacaattcgtgtgctactttccctagcagcctcacatggtcttcccgttcatcaaatggacgttaagacaacttttcttaatggagagttggatgaggagatctatatggatcaacctgatgggtatgtagttgaaggtcaatacagcaaagtgtgtaaattgttgaggtctttgtatggtctgaaacaagctcctaagcaatggcatgagaaatttgacaaaacattgacatctgcaggctttgcaatcaatgaggcagataaatgtgtgtactatcgccatggtgggggtgagggagttattttgtgcttgtatgttgatgacatactgatatttgggacaaaccttaaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgatgcttcgcaagaacaagagaattgctaggaatcaactggaatactcccaaatcattggctcgctgatgtacctggctagtgcaactaggcctgatatctcctttgctgcgagcaagttgagccggtttacctctaatccgagagatgatcactggcgtgcgcttgcgcgagtaatgcgctatctgaaagatactatggaattggggcttcactattctgggtatcctgtggtactggagggatatagtgattctaactggatctctgatgtggatgagatcaaagccactagtggatatgtcttcacactgggtggtggtgctgtttcgtggaggtcttgcaaacagactattttgacgaggtcaaccatggaagcagaactgacggcactggatactgctactgttgaggcagaatggctgcgtgatctattaatggatcttcctattgttgaaaaacaggtgccggctatccttatgaactgtgacaatcaaacggtaattgtcaaattgaatagttctaaggataatatgaaatcgtctagacatgtgaaaagacgattgaagtctgtcaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcccgtgaattagaacctgggaagaacaaaccattagtaaactagaggagagtaccaatctataccctctctaagtgaagatgcatgtactcttgtgagctgcaaggcaggttggctatgccttaatgagttctgttggctttaattagcgaagatgctgtcctgcagagcattcttgaaagaactgacctttgtaagcttgactgttggtcgcagtctatgaagattttgggtgaatcttctaggaagcttactaaagacctaggagtatgacttatacgctccacccgaggggtagtctatagacggtctagtaccagataagactctgaatgaaacttgcttgcacaagacttgcaattcaaggcgtagtccattgttcaagttgtgagtaagtgtagcttggagttctaagtggatgttcaaccttgatcggtctccatcgaaccgctggtatataaacagtacattggaaaagacaaatctcagtgggattttgagatttggtgggggattgttggaattaatagatgggctaaggcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtatggtggagagaagagggagaacacacgcgcgcgctcgctcgcctcgccgggccggccgggaccggccgggcaggcggcgcgtgtgcacgacgtactgcagaaaaattcggatttgttttgttttggaaacattccaaaaaatccggtgcgcgacttatccggttcggttacgcggagtggagatcgtgcgggcgccctgatcaagcgacctatctctatataaaccgagttgccgccttcacgcaaaatacacgaaatccatctagagtttgcctcctcctctgtgttgcgccgtcgctcatagactactccatcccgctcgccagcgtgcaccggcgatccaaaaaatccggtgcgcgacttatccggttcggttacgcggagtggagatcgtgcgggcgccctgatcaagcgacctatctctatataaaccgagttgccgccttcacgcaaaatacacgaaatccatctagagtttgcctcctcctctgtgttgcgccgtcgctcatagactactccatcccgctcgccagcgtgcaccggcgatcgggagagcaggtctccggaacctctgccttcgatgtcctgcaccgggagaaggcggcaataaggtttttgggatgcgcttcgcgcgactgcttcctgttcatccgcgacggctcgccttcctctccgctcgcgtgctgcgcgccttcgtcgacgctcgcaaccgcgagtagttcctgccgagcaaccggtctttccgccacctcggtacgtgttcgacatgttgcgcatatttaatctgttcatgttttactgcttagtttacatgtgtagatctaatgatgcgtttatgctagtatacatctgtaatgtcatgatttatttatggaatatattgaatcattatatgcctatattctcaacatgtactactttgcttctcattcgttagctcattggcatttggtttttgagtgatccgattttagttcatgatcatgagtagcgcttgaaatttttggctcctgtatgtgtgtatgtgtagagatcttaccttgatggcgttacggatgcgttcaacatgaccgacgaaatgctgggtgctcactcgtttttaaggcagcttatggaccagatttcccttgcaaaaacctaccttgtcgttgcgaaagaagcaaataacctgcagttttcagcagagcttagttcgcagatacggcgggcgccgcagagctttcttgcgcatgctgcagctcatggtggcacggtaatggagcagaaagtagagaaggcaattgtcagttccgctatgctagtgcagttacaatcatgaagttgataggtcagattcaatccctaggggagaaatcgaaagcagaggtggaaaagagcacgaagtacgggccgtgccagcccggcccatttacgggccgtgtccgaccatgctttctaccatgccgggccgtcgtgccttgggccggcctgataaagcacggcccaagtcccagctctaggcagattgctgcctaggagcaagacgggcgaaggggggagcaagagagggggagaatggagaaaaaggaagacatgcaggcctcacatgtcagtgggcccacaatttttttttaatgattaatgggtcacatgtatattttttaattctaatgccacataagcgacacgtcagtaccacgtggaacaaagatcaggtcaataccaccacgttagcgaaccgtcctccaaaaccatcaagggagtcaaattgtaccggttttaatagttttgggtcaaaatatccgatattatgatttagggatacgaattagattagatcactagttaaggagtcatagtggattttttcgaaaagcgtaatctcaaattgtggcccatggtaaaggccgatatttcggcttacattgcttataaacgggccatatttactctatagttttgggaagggttaagtccactttgacttccttaactagtgcctgaattcatatccctaaaccacaatactggatatcttggatatcttgaccctcaaactattgaaaccagtgcaatttgactcccttggcggttttgtagagcggtggcgcttacgtggcggtgttgacctggttttcgtccgacgtggcggtgatgtggcgtttacgtgacattagaattaaaaaaactatgtgggacccatttgttatttacacaaagaaaattgtgagacccagtaacttgtgaggcccgcatatcatcctttctcctcttcttcctcctccctctctcttccccttctctctctctttctctttttctcattgctcttcccttcggccgtctgcaggtagcggggagcggagcagcggtggcggcctcctcgcacgcgcgcagcagctccgcatacgggataacctcgccgtccccatgtttccacttcaggccctccacatttgccagctgccgtggtcaaagcagacatggagcttccccggcaccgacgccgccgtctcctccgcctcaccatccttccctggcactgccgccgccacctccgcaaccatcgggagtgacgcgtactagcaccgcttgagcttccccggcaccgacgccgccgtggtcgaggtggatgcagaggcaaatggaacggttgtggtggcgacatggaggaagcaggaaaagcggcatctgttctctctctctctgcttgaaccgcgtgggcagaagcaggaggggaggtcggggacatgataagggacggggaggcagtaaaagcggggaacgaggaggtcgtcgaggtggggagtggaagggattggagcgatggtcgagggagcgaaggtgtcggtggtggtgtgcttcatgacggcggcggcggtggcgacggacttctaggtgagtggatgcgccgtagatctgcgttgatgctgatcggtcatgagggcgcgccatcactgcgcctctaggccgctcctccttctcggatggagccccctcgtggattcatctccccagccatcatcgctgctcaacctccgcctctcggtgtaaaggatggtgaagagctcaaagccggagtggaaagcccaagcgtcggcgtccctctccgtgaagacggcgatgatgaggaactggatgacgtgcgaagaagcaggtgtagtacgtcattgacagcctcgccgggtacttcttcagcaacgggccaccgacgctgctccacgtcgttgctcctcatccccgctctccgccaccgagctcgtgggcgcgttggcatggggcagagagagggaggaggaagaagaggagagagatatgtgggccccacatgtcagtgggtcccacaatttctctttgtgtgaatgaaaaatgggtcccacatattttttttattctaatgccatgtacgcgccacattgaacgaagaccaggtcaacaccgccacataagcaccatgtcagcgaaaccgcccttcaaaaccgccgagggagtcaaattgcaccggtttcaatagtttggggggcaaaatatctaggattatggttcagggatatgattcagattcagccaccagttaaagtagtcaaaatggacttattccttttgggaaactatagatgaaaacctacagattttgtaaaactataaatatagcctttatgtaaatgcaaaataccccctcccatacacacacacaaaactatagggagtagctatattttaatataacgctatattattttataaaacagttaaatcgttctcacactatagattacttacacttaaatactgtaattagattgtaaatttcaaaacatatattgtaattacattttatgttttaatatttgaatgtaattttaaatatttgcattatattttttctaatacacaaataaaattatatttaacagtaatttttatctctgtgaaagaggagataggttagatagaagtatacttgagagcaaagtgactgaaaaagtggcatcatatttttaagaacctgaaacagtgttaggagaacggccttatttatacaactccaataagataatacaacgagtttattaagataaaaggattaaaagcaacagtgcgtaatattatttttcaaattatagcttctttcatttcaccaaaaagaaaggtaaacaaaaaaaaatgatctacacggataagaaaaaaaggttacagcctaaatagatttattttatcccgatttctagggagaaggagagtttgtcaaacaacatggtcgtcgcacaatttaacgctttccattatttaatgtcttgttttgttttaattatatggagtcatgtgtgaagcttctcagcacgctaaatattatagcattcgtcatatgtatgactaaggaagtacttttgtttgattgtatagcttattacatactttacactttgccacttgccacttactgcgtggaatttattaattcagctcactcatatatggcttgttatatatgtatgcatgcatgcatctcaatttgaatataggatgtgattgtatgcgttcataagtgtaatttcacgcgttatgtataataaataattaacaaaaattgctatactaatataatatttttttttgagaaatatggtcttccaaaaccctgtcacctcccaatttatatataatcagtggtgaactggtacttaccaccggtatgttttaatgcacatcgtaataagaaaacaattatacgtacagacaatataacaaaggacaatttagctaggagaaattgacatggtagtttgaatgttgtttttatgagaaatgagactattaaatatttatttgtggagtgttactatgcaaaatttctttggagagctctacagtttactactagtttttatagtttatatgctcctcatagtatatctcatattttttagaattgccttgtgggggttgataaaaaatctaccaaacttattcttgttagagcatccgctatatgttgggctatatggttgtgtagaaatgatatggtttttgataaaacaccatctatgttctataatcctatatgcatattcttttcagagtaacatactggcctcggttctgagctcaactactaaagtgtgatgaagaaatcaagtcagtgaaagttatatgtcgtaattttgattcaatagttatgcagttgctcgctaactttggatggagattcacaaatagaattcaataatttttgtgatcttgttatgctgtgtgagtttttattagtttgtgtgtccttttgtttattcaggtgtgagtttttggtgaattggtgtaataattaattggttgtagctctttgagcaaaggtcgggattatattccattataaaaagaaaacatattgtattgtagttgtaaatgtcaaactacagaagagaaatgggggagagagaccccggggggtgacttcacttttttctcggcgaatacgtttatcaccatataattaacgattggtgcatcagctgatttcagattattgactagaaatattaatcatgaatatttctcaagaacacatagcaagtttgagatctttgtatctattcgttagaaaaccagaaacaggcatgtaatggaaggaaatgaggtctttgccccgtgtgttgcagcgggattttaataaaaaaaattatcattaatatgttattattatatcttaattgttgtacgtatttgatactaacatgtggacatttttagccttacactgttctttttttctttcaacaaaaagtgaagagttggttggagtagctaacatttagaccatctagacctacctgtcatttttccccttaaaaaaactaggagttggtagtggggaagtggtatgtagaaccaccaccactactctcttttataagaagcatagtatacacctaccacaaaacaccacatcagtgatgcctccttcgttgcgtcatgcatggaggaaggaaaggggaaagaagagggcatgcacggcggtcggctgcgcatggccagcagtgatgatgggccttgtgagaggagctagctagcggcaacagcaaaccatgtgggaggagaggatcctctcctctaacaagcggtggagtacttgcccgtcagagttgcccgtcagagatgactatcacctctgacagtcggtcacccgtcaaaggtgactggacacaacaatgaccactgttctttgaccaggcctaaacccatcaaaggtaagggtttatggccatcaaaggtgacctgatccggtgtagtgggagtaaaggactagtgatagaggactggcgagaggagcggcggcgagtccgttcatagggaagagtctgtgtcgtcacgtggagctcagccagcggcgggagggaatgacactggcagctgaaatattttgttgatttggtgttcgttctgttggatgaatcgtttttatcttttggatattgaaattattgatccgttggagaattcttagatctgttcttggtagatggatgtgtttcttatggggccgattgcaatctcatcagtgtgggctcgcaatctggcaataatgatccgctggctgattatcgctgagacagaagtgccggttccaaaatcgtcaccgacgttagttttgaaccagcactgatgtccaaacctgtggtaatgatagttggaaaattttaaagtctcaacacataatatagtactacctcttttttaaatatgtataacgtcgttgactttttgtccaacgtttgaccattcatcttattcaaaaaaatttatgtaattatttattttaatataacttgattcatcatcaaatgttctttaagcaagacataaatgttttcatatttgcaaaaaaatttaaataaaataaatggtcaaacgttggttaaaaagtcaaccgcgtcatacattaattaaaatacggagggagtatatagcaattggatagtttctttagcggcacaaaaatcatcacttgcttatgtagagcttatctaatgtgtgattatattctttcaacaaaacggatgcgcatcatttctcggtttattcctacatgtatggataatgcatgtatgagaattaattctacaatatgtatatgtcagcggccgtttgcaacgaatcaggagggaggccggaggtacagttaggagaataggcaaccaagccacctagcatgacaacgtagtaccaagattaatgttttattttaccatgaccaaaattattgttcattactgaattaactacctttaagtactcatttttaaacatcctaatgtggttggtgtggttctccaagtcgttggttatatttctttcattgatgaatctctattacttacgtattgaatctcgtatttaattctatacaataatattgcttaatttatttttcttcccttgaaagtttcataattttgtgatatggaatacatttggccaaactacaactgataatttaattttatttctagtccattattttagtttatgaatcatttcaatttctcttgtggtttgttcttttttattttttaactgggaatcaaactttatttaattggcgtaattgtgttatgtctctactttcatattcatatgtgatttttatccctattttcagggtttatgattttgcccattcttttttttaaaaaaaaacaaagctttagcttgcacctggtatattagtatatatgttaagtcacgttgacggtgataagtctgtggcattcaccattgaatattattgtatgtttacctctacttttggtcatcactcacatgggtctgccccttatacccttaaatctaggcttcttggttcaattgaattaagagatcagcgaactatgttcaaaatagcatcaacaatggccaaagttatctactctttcagaagcaaacaagatggcaatcataaataattcccaatgtggtgctaataaattaaccaaatcttatctagctgttgctactagacatgtatatatatatatatatatatatatatatatatatatatatatatatatatatatatatatatatatatatatatacatatatatatatacatgtatatatatacacacatacatatacatatatatacacatatacatatatatatatatatatatatatatatatatatatatatatatatatatatatatatatatagagtgcataggactacaagcatttgcaccaaattggtatagggatattaagtctaaaagggatatagaaaaaattattcaaagattagaagatatccaa

SEQ ID NO: 58234 - DNA, 56842 bp, Oryza sativa
cgtgaaaaaagataagttaaaaaaaaggagagaaatgaactcaccccaagtcttgcttatttgcaatcttaatgctaaagacagtctacattgcctatgcgctgatagtatctctaacagaatatacaaattagactatccaaacacctatacagctatatctccaattgatttggtaagccaaaatcgttgctcacgccaacagcttcttcatctaccctctccactccaacccatatgacactgcaacccatatgtcagcctctaacatctcttcttcttcctcctatttctccattcttcctttgcttccgctggggccaccctgagctactctccatccctctccctccgtgcggcgacgatgtttgtgtgatggcggatggcgacagcggatccgtgagcgcgctaggcggggtggctgacgcggatgaaaggaaggccgtcaacaaagcgcgatacccatgctatagtggcgcttgagctcactgacgtcccgtacactccccaaccctgtcgttgccgtgggcttcctccatgccagcggaggcaaaggctgtaaaaatcgccgttgagaggagacaacgagagctgagggcccccgagtccatgcagggacggaggctgtgaaggtcgtgtggggttgaagacggcaacgacagagtagaggccacggtggcgaggaggtatgtgtaggctgcgacggtggagtagagggggaggtgcgggatgtggcggtgacgatggcggtggcaaacgatgaagacaatgattgtctcgttagggggattgcgagcgggaaaccatggtggcgaggaggtgcgcagcggcaaagttccacttgatctgcatcgcaagtgggaggaaagataataggaggtagttagacccacatatggcaagtgtagttggctcaccaagtttggtaagtaagggaaggagtttgtccagtcggatagcttgaagagtgggatgaagagaatgcaatttttatccactgttgctaaactttggtttgaagagtaaaatagaaaggctgttgaagatgttcttacgctgttacacgtccatgcccatttttctctctgtcaagattcactggtatgcttacatcaatacactttttcttgttatatgtttgttaccttattagctatagccaatatttatttttttaatttaattttgagtttttttgaccataatttattttcttctgtggcttttaaatcaacaaagaaacatatacataaaattgctataaatcattttaatttcttttcactttgttcatttttgcaggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcgtggctaattttgactcggtctcgatctgacgtggtatgacgtggcccttacgtggcaatttgacccgggaaaataataaaccccgtgggacccacatgtcaatttcacacacaaaaaaattaataataatggtggaacccacgctgccccacatgtcagtctaactcacccctcctcttctgcttcctctctctctttctctcctcttttcatctctctcttgtgctaggggatgcggccggcgatgacgatggcggcggaaatggagaagagtgactgccaggggcataggtgtgacgtcgctgggggcgctttgaggcggaagtagactcttacgacgtggccgtcggaggtgagcgaggtcgtcatggactcacgggattggcggtgtcgtcggcagcggtggagcaggagttgtagttggagtccttgtcgtcgacctcgagttcgtcaatgtgctcgagcatcacccaccattagtagtcgccggcggcggaaggtagcgccgccatctcctgttgggtttccatgggccgcggcgagcggatcgatatgggttcctcgtcagtccggccggaacagtgttttcttgcctaaaacaatgatcattcattcattcatcaaccccgtcataacacaagcaaatgatgatgacgaagcaaaatatactctagtcagctagtactagtcgctattgcttctacctttgtatgattaggcacataaacgcggagcggaggtcgtcggctttggtgccccagccgaggccgtggacgaagagcttcctgctcacgggatcggcctccgccgtgcgccgcacggtcgtcatcatcactggggtcgtcttcgcagtcggccgcctctcccctctcccgccggcgaggtggccccctcacccgcccacgtggacggccgccttcgaggatgcgcgcgtgtgtcggccggtcggcgggacacgttcatcccgccgccgaggatgccgaggtcgacgtcaacatcgtccgcagccacggccgcggcggcgctgcctccgccgccgggctggttcctttctctccgctagtttccctcccaccggccgccgcgccgcgccccttctcccagccggacaccgtcctctccccggcgcccgtgaaccggagagaagagaaagaggagaggggagagagatgaagacagagaagatggtgaagaggagaatcagaatgacccagcgcaagagagagacgaagagaggggaggaggagagagaggaagcagaagaggaggggttaattagactgacatgtggggtccgcgtgggtcccaccattattattattattatttttattgtgtgtgaaactgacatgtgggtcccacggggtttattattttccggatcgaattgccacgtaagggccacatcagtgccacgtcagatcaaaaccgagtcaaaattagccacgtaggtgccacgtcagccaaaaccgccattgaaaccgccgagggacctaatatgcaccggttttgatagttgagggaccaattgtatctggttttgtggttgaaggacgaaaatcggattcgttgacaagttaaggaaccttagatgaacttattcccaagaacaatcggtacgatccaacggcccagaaaccaccgcatcgcaccggaccagcccaaccatttcgtcgagcacctcacgcacgcgctcccctccaagccctaaacccattccccaccaccatgcgagccatcggcgccgccgccgccgccgcgaggcggcacgcgcacctccccacctcctactccgccgccttctcctccttctccggcatcggcggcggcgccgggcgcgggcgtgggcgcggcctcccgccctccgcgacgccgccgcgcgcccccggtagccccgtcccggacgacgacgacggcggcggcgcggatcccttctcctccccggcccccatcggccgcggccgcggggaggccgtgatcccgtcggtctcgtcgccgccgcttcccggcgccggccgcggccgtggatcgccgccgcccctcggtgaggtcgcccccaagcaaccggtccccgccaagctgttcgacgcgccggccgccgaggcctcgtcctcagagccaccgccactgccgccgccgcgcacgctcccttccgctggcgctggccgcggcgtgccgcggatcagcaagccgccagtggagatgccgcaggaggagaaccgattcatccgacgccgcgaggagaagaagaaggccgcgtcggcggcgcgtcccgctcccagcgggcagccgaagctgtcgcccgaggacgccgtgaagcgcgccatggagctcctgggcggtggcggcgacgacgatggcgggcgtggcggcaggggtcgtggtgcccgtggtagggagcgcgggcgcggcaggggacgtgatggcggccgcggccgccgctctgctgatatggaggagaagcatgggatctacttgggggacaatgccgatggcgacagactccagaagcggctcggcgaggacaagatgaagatttttaacgaagcgtttgatgaggccgcagataacgcgctgccagacccgaagcaggatgcatatctggaggcttgtcacaccaataacatggtctgtgcagcaatgcggttgaatccgcaaaattgttagagttgttagatctggccgttcatgcaaggttcctgaattatttgtttcctgtgggtttatgtatgcagatcgagtttgagccagagtatcatgtgaatttcaataatccagatatcgaagagaagccacctatgtcattggaggatatgctacagaaggtgaagccattcatagttgcgtatgagggcatccagaaccaggaggaatgggaggtgatttctttgatggaccttgtactatattatttttctccacagaaatgtttgtgcgagtagatgttttggtacatatgttctcttgcagcattgaggaaccagattgcattagaaaatgccggagaaagcctgcataaatagtgtaaatgatactttgtttttccagcaataggattatagcatgctcaacgggtgcaacgctgcaagtctatagttggatggcattagaatcctagctgcattatcaagttttcataaataaactgatgaactcgagcatgttaatagacttgttccctgtttggaataatcattcagcctgattgaggcttcagaaataattctaatgagtttgcagatgcatattgctgtggtacgtaagtatgttcacagccagattggcctagctttgcactgatatacctagatcgggctgaaaatgatattagtagattttgtgttgtttcacctttcagaacatgttatttggtaagctgatttatgcattacaaatggagcggatataaggtttatacaaaggatttattatctttgttgcatgaacgctgtccagctgattacttagtaattgtgcctgctcctttctgatgaggttaaactgtaatctccagataagtttcaacttgttctaaaatccaagtaaagagggactgttggctacgttagattagagattttaacaggattgggtcattctagcttttatgtatttcctgcagtcctggacttattgaactaaaagaatatctattattccgcttccatgtttctgctaatcagctttaagtccctgtttggaaattcctgtatgacaccacattagacacttgtctcataggcttctactattacatgaaccagtacatgcttgaacttgcagctgtattcgccttgctgctaaaatgagtttttttttttttggtgatgtatacaactgacccagtataatgtaccgtatcactaataggaagctgtgaaagatgtaatggcaagggcaccccatatgaaggagctgatagatatgtacagtggccctgatgttgtaactgcaaagcaacaagaagaagagctgcaaagagtggccaacactctcccaggaaatataccctcttcagtaaagcggtttactgataaaactctactgtctcttaaggtttgttttcttgttataattgatgctctgaacagtatacacatttttatagagaacattattcataatattaatggtctgatatttgaatgttgtcatctttataattcaacttctgatttctgaatctccagtggtgatagaataacacaattcctgtctaattttctaacttgatagacatgtgaaattatagtatcaccctttctaagcttgctttcaaaaatagagctgtattcaattagcatttgaaatttgaattctagctacacaaatgatcaatttagctttttttaatgcaatgtatctacaatttaatggttcgttccaaccatcaaggcataaagtccctctgtagtctgacatgccctgtggtctggtcttactaagctagttctataacatgtctgtgtttatcatcacttgccatctgagatgatatatttgatagtttcttatcctattgctctcaaagatggcgaagtgcacatgctttaagttggctagttcacctgactgaagtactctacatgttggagattctgttatcatcacatgtgcaaaatttaccatactggttgtcatcatcttgtttgataaaatattttcatagccattagaactttttacctgtattcatattacaaaaagaagtctggagaccctgttcagtgtgtttatgtattcctatttgtttcaccttcctttgaagaaacacaaggtgctgcttattgagatgaattcgttcttgtttctccttatatcttttgcagaacaatccaggctggggttttgacaagaaatgccaattcatggacaagtttgctcgtgaagtttcagagctatacaaatagaaaactcccatacactgttgtaagatctcacttagccccaggaagattttgtggtttattttttctattttgagaaaagtgaggttttctttagtctgtgcacttcttttcctttgtattggtatgctaattagataaataaaatcactgataaacatgtacatttcttttgggagatgtttacttgggtgctctagtatgagatctgctatgatctcagcccttcaattcctgggccatccaaacaacgctgattgcaactcccctaccctttttgttaatattttaagttcttaaggtgctatatcgactggtcatattttgaattgaccatggggttgatctgattcctgcctcatttttatatttggggtagtctagcaatagatggaattttgtgctcaaggccagctctctgcagggagtgctccttcagttagcaagtaatggaaatgtttccaacaaaacctaatctggtaataatgtcctgcccaataagtgccactgaagaagaaggttttatgatcactccacatggccctgatcaagaatcttttattagatacttggccgtcggccgatatcatagcccacaagaaaaccagcaagtgatcaactctcttatcatggatttctgaaaacaagagcctggtgttttcaggaaagcatgccaaaacaactccaaatagacagaaacaccttattttatggtttttgatacaccgccatccatatttttcttaatatggttatctatgactatgatacaccgccacctgtatttttcttttctaaaaattctgtgtgtattgtattgtatgtcgttccacatgagagcagaaatgcctacctagctacttctctattgctcaatcactgtggctcggtacaaaccatttcttttactatacaaaaatgaagctaaaatcattggaagcacacttaagtatctgctgagtatggtctgggatcaccataactagttcccttgaactcatagcccatctttgtatcaatctcttcacaaggtatatagctaaccaaattctccatcaaatggccaggtccctagatcacagacattttaagagatcacttattagcttatctggtattaaatttagggcacaattgtgcaattgtattggttgggagtaaattgctggagttaccttaagcctctgaatcatgctgtcgaaggggttggttctcgttgttctggctgtcaagcggcatgtactgggacatgatggccatgatctccgagtccatgtacgactgcacaaatcacatcaaacatttttctttttcaacatcacatacttgcaacagtttcagtttaattatattccttttcttgttagaaaaaaacataccctgagtctgtacttgtagaacacatagccggcaatccccacgccggctacgcacgacgccaccaatatagtgatgaaccagccgaaccttgacatgctgttggctgcattataaacccaaaatttagctatgtttcatattttcatgtcgaaaagcaaagtgtttcatgccatcgtcacatgaaattggaactatcttcatccgtttcataatataagactttttaacattgctcacattcgtatagatgttaataaatttagacacgtgtgtgtctagattcattaacatccatataaatgtgggtaaatgctagaaagtcttgcattatgaaatggagggagtagatttttatgtgatgtattatcacctatgcatgtgtcctctcctcttatgtagatctggttgcccttgcacttgcactcgtagttgccccaggtgttcttgcagtggcagttagggcaagtgcacgcaagcttctccttgcattcatccaaatctgaaagggtaacacatggagcacagaattttgttcagtatttcatcagttctgttaatctacacccaccactactagcccatcaatcacttgatagtccagtagtaattgtatgccaatatgtcagtttcagaagttatttttcttcagagaagtttcagaaatatgtttaccttcacatttgtggccatctccttggaaacccggggggcatcggcatccagtcaatgcagtgtcctatgaaattgtgcagagagtgattagcaaagatcataacaaacaacgagaggtttttctgcaagtgaaggctagagagttacagagcaagcagagaacgtctgatgacccctagtctctgaccagcagcctccgttgtccaccgtacacctgcctggcccaacagctgaaacaaaaagaacaaacatgcaattacattaaaattcaaaacatggtgagcctgaaatcgaggttcctttggaatgcatgaattttacagaattttcatggcctatcgaccaactatacctttgcaaccgatgtacccgtcgccctcgtactggacgccattcaccactgggcactcgcacaccctacccctgaacgtgtcctgcgtattgttgtgaacacgacgccagaaaaaatcagattaaaaaagctttatcgatatcagacaattacatcgagatgatacaattaatctataaaaccatgtagtaccttgcaagccgtaacgttggttttctcgtctctccagcaaccgccgttcctgtgcaggcactcgttcgtctcgatatctacagttgaagaaatgaaaacagagatttcattagaatttcattccaatttttcagaattccacgaaacaaaacaatatgtttctctgcgttttctacgcaccattgctcaagcagacgcgaggttcagtgccctccttgaagccggcacagacagctttcagcacggccgtcctctccagtttcccttcatttttcacaaccatttttgtttttttaataatggaatgtaacatctatgtctttactcaaagagctacagttaattattacagaaagctatttttattgttgttaggaatctctaatcagcttcagtgtttgcaagtaactaatttgttcttaattatcattcttggcgaaagagatgtgccaaccaacctctgtactggacgttgttgatgacgagagtaggcaagatggtcacatcccctcgcgatccacggccaatctgatcaaaggcaccaaaaccaccgacgttaatggcttaacacatcatgtaatgcaagagacctgcgagattgtgactggccaacatctctgacacctgaagattaaaacgctaaaaaaaattcttctcctaatgacaccatgaacagtatagtttcagtcactttgcatatatacctgatcttcctgctctttggccaagacggcgttgtcggtgtcggcctctggatcgcccatacattccagcaccttgtcaagcgacagacctaaggaaagaaaaaggtcaagaacaaaagaacatttgctattataaaagcaccaaattcaaattatagtgtctacagataatacgcatgtgcggatatgtttttaatacggagttaggaaagtggatcttttttaaaagttacatatgaacaattgcacatatgtttttaatatggagttaggaaagcggatcttttggaaaagttacatatgcagtatgtttttaatatggagttaggaaagtggatcttttctaaaagttacatatgcacatactacatccgttctaaaatatagtaaccgacgcatcctagtattcatatttatccagatttatagtagtaagatgtgttcaattcagctttagtttgatacacgaaacgatttaactattttttgataaaaaatatgacgtcataaatataaaccactcccattagtgaatttaagtactttttgctggcctctatatctttgtagacatactcaaggtacatgcgtgtgatatgcataatactccctcctttttaaattgatcatcatataaagaaatctaaattttcttaaattgatcatcatataattgcatggacatgaatttcatcggaatacaattaatatagcatgggagaatctgtacatactagggtgtaattgatatggtgttttaatcgatacatacattgtgagagaatgtgtatatgatgtcttgattgatgcaatttaaattatccttgatcttgatgcataagcatatatgatgatcattttgggatggagggagtataatactcaaggtgcgtctttcgtgtaatggcaaattagagcaagtaacgaagaacgatgaactgatcgatgagcatatgcacactgaatgtatggtaccatggatctcattctcacctagggccttgacgacgtcctcggcgcagcccttgctgtacttcttctccttcatggagcacctgatcttgtagtccatgacgtagtcccaccacgcccatggccgcccggtctcgttggccacccggtgcacgcacagctgcctcaggttctccaccaccacgtccttcccctcgtacccctccccgaaatcctgctccgggtccggcgcacaatacctgcacgcacccatcctcaccggagctcgatcaaccactccatcgattcatggcgcatgatggtgtccccaccggagacgaagaagaggatactatgatactctttccgtttttcagtttttcagtgtatgacgtcgttaacttttttttatatgtgtttgatcatacaccttattgaaaaaaaaatgtaatcaccatttatttcattgtaacttaatttgtcgtcaaatgttttgtaattaagcatgtcttaatttttttaggcaaaattggttatatagcatcgaaagttcacatttttggttttatagcaccgaaagttaccggttcactttaatagcatccaaagttcaccatgttcctatttttagcacttccgtcaatttttccgtccgtcttgatcgttattgatcgccacacacatgatatgacatttctacccctcattgacatacattatacttatacttgtgaggggtacaaacgtcatatcgtatgtgtggctggatcaagacggacggaaaacgatcgagaattgacggaagtgttaaaaatgggaacatggtgaactttgggtgttcttaaagtgaaccggtaactttcggtgctataaaaccaaaaacgtgaactttcgatgttatataaccaattttgccttttttttatttgcataattttttttaataaaatgaatggtcaaaagtttgtaaaaaaaaagtaacaatgtccaatattttttaaaaaagaggtacttcatattataagtagtctaagtttaaccaaatttatagaaaacttagcaacatttccgacacaaaagaaaaatattatcaatatacataaatgttagttttagtgaaaccaatttggtgttgtagatgttactaatttttctataaacttaatcaaatttaagtttggatataagaaaagtgaaaacgacgtaataataatataaaatgaaggaagtatgattaaaaaaaaagaaatcgaaacgatttataatctgaaacgaaggaagtcacttgcctgccatggttgatgcactgggacttgcactgctgggtgagcttgaaggcctcggggcagtaccaggtgatgtagtgcggggtgaagagggcgtagccacctctctccatgatctgggcgtggccgcggaagccgcggacgaactccatctgctcgtcgcaccgggcgccgcactcgtcgttgctgttggtccacagctcgtactccacccgctcgtcggggtggggcatcgactcgcgccagtccagcttcaccaccacctccaccgccgcctctgacgacggcgacggcgacgacatcctcttgagggactcgccgaacgcgcggttgaccagcgcggacgggatgctgatccggtcgatgtactccgtctccggcgactcctccggcgtgtccatcgtcagcagctgctcgtccacgttgtccgcgatcagcaccgccgccgcgcccgcctgctgcgcgttccacgccttcagcgcgaagtagcactctgaatatcaacaaacggaacagtttgtcaggctcacatacatacagggggcgtaagtggctaacccggcgtaagcccacttataggtcaaaataaacgggctcgtggtttattttgatttactacagtggatttcgcgggttggtcacttacatcccacatagtcatagtatgtaaggttatcaccgacaaaagaaattaaaccataatgtttattagcgattaaaaataatttattggtaaattttttatatacatgttcttagcgatttaaaagttaatgctgaaaaataaattacggtaaaaaataaccaaaatatacttaaaataaagatttaaaattcaaatagttgactgataagttaaagaataaaaattcaaacgatgaagctgattatctgcattaaaaatattaaaattgcttcttctttattgcaactaaaatgcactgaattgagtgagaatttcagtatattagtacagaataagtgggtcaatttgcaattcctatttcataatctgatggtaaaagtgtcctggtgcagagttcagaatctgatggagagtggcttggaaacgaaggatgaacaggttgttcagtgctgcctttggcttgaaggaattgagagacacctgctgattggtagtggaggagttgtgatcaagtgcgttgcagtggttggatcaaataccgaatcaggtatgagattcaaaattcaaagttgcaatggataaatgtacggcatatgtatcaagaacctattctcgctttccttggttcagagttatctgaaactctgacggaaagaaaggaacaaactcgtcgaaatgcttaaagttgagccgaatcccgaaagtaattaaactaagtgtgtgtttgaatcttataagtagtgaataagaagtggttaacatgtcttcaataatggctctgaactaagattccgtcctagttattggtattatgttaggtagtattctgcaatattggacttgtttttccaggcgaaacaaacaaaacaatttgattcagagtaagtgatctcagttctcaaacaatttcaaaaataaattaaaaagttttggtctaccatcgttcaactctgctttcagaactgaattataaattcccttccctcgccacaataaaaaaaatatatatgaatgcaatctttcagacttctaaagttggacaacaatccacatcaaagaattaaaatactatacaacttaaccatcatgcctaccttgatactctcttgctaaccatttcttttgttgtttttttaatcagtggactagctaaccattggattgacacaacccattaacagaacaaaaattggcatgacttagaacattggaatcaaatcatcaccaaaccaaactctcaaaatccaaataatcatcaaaaactaatactacttctcaagtttgttcagttcagacttgcagactttggaacacaaatttcttgaaaaatacttatgcaaatcaaaacaagcacaaactaattgaatcaatcattggaagtttgaaatcaatctcctacctccacggtcgagcaggaggatgaccgggcggcgagacttggacttgaacttggcgtcgaactcggcgcagccggtggccttcttgtcggggtagacgacgacgccggtgagcgtgccgccgtagtccggcacgccgaagttgccgatggcggcgtcgtggtgcccccggatgtgctccggcgagagcaccctcacgctgctcttctccaccacgaacctccccatcgccggcacggcggcgcccaccaccgccaccacgacgacgatcaagaacggcacggccccaatcccggcgagccatggcgccctcctcgccattgctgcaactcgatcacctctctctctctctctctctctctctctctctctctttccaagaggcgacgagaggaggagggaagaagacgacttcaaagaagaagaagatgatgaagcttatgcttggtgggcaccaagattaggtggctctcgctcgcaagtagtataaattaaatagaaatttaaggaaaaaaatgttcttgctgttaattaacaactgtgagacgagctcaaccgtgcaaaggggaatggatggatggatgaaaaaaaacaaaggatatcacgagaagaagatgaaaaaattgtgatcttttgagaggaaaaaataaatgggattggattgcttgggttgtactgaaatccgtttggttcgagaggggcaaaggtgtcaacttttgtgacgtagaagagaaggtgagaggaggagaggtgtgaggcagcatccaactactagcagatggggtggtatatagagtaggagcgcgaaagcgacaatttttttttgacaaactgatgaactggaaattttggaattgagactgttttgagatgaaattcacttggggattattaattgatgatgctttcatgatgttaagagttggagtaatatctacaagatgaggtcaacatgaccctgacctgttctctgatgatagaaaaacattttttttccaggatgcaggtatctatcagaactgctgctacacgccggggcgggctcacatcaagaatgcttacttgtaattgcagcaaaaacaaggaaaaacaagggaaaaataattaattaattttgcatgtctgatggttcacaagttcgatcatattgtccatatggaatatatgccttgtagtgatacgatatttcttcagatgtaacactgcacttgttctgaaactatattatttgagggggtgttatgtgggtgattgcttaccttaatggacacatcatgcccaactaaaatccgtctctgaactttcaatttcttgttgaggacacagtacgtacttgcattgcttgcttcaaagacaactcttgtctgagagagagaggagatccagcagcagtgttctgcaattctatgcgtatggtagaagggaaaagatcaacacacttcctagtctgttcttctggatgggcatattgcaggaattgtgtggatttcatcagaaacaataggtgaaaaatgttgttttttttctggtaaaaagggtcgctttggtaattaacttggtcggctgagtcttgatcgggtttggtctcctgttattagtgcaaccgggcaaagcacggcaggttagagtcgagactgaccgattcttcagtggacacgagtgggttgacggtcacgcgtgctcgttgggtttgggtttgtactgctccgtattcactatctattgacattttaggaagacttgcaaaaagtgatagtatactactacctccatcccaaaatatttgacgccgttgacttttttaaaaatatttgaccgttcgtcttattcaaaaaatttaagtaattgttaattcttttcctatcatttgatttattgttaaatatatttttatgtatacatatagttttacacattttacaaaagtttttgaataagacgaacggtcaaacatatttaaaaaagtcaacggcgtcaaacatttagggaaggagggagtagttgctgagttgagttaggaactccacctccacatacggaaaacaaatattattattaacacatgattaattaaatgttagtctaataaatttaaaaaaatggattaatatgatttttaaaacaactttcttataaaaaaacttgtgaaaaaaaaacatatcatttagcaggttgaataaacgtgtgggcggaaaaaaaagtgtgttgggaaagaaggacgaccatagccttaaaggagattttcttccttctttctcaacttatctccctcgttttctatgcgcgtgcttttcaaactgctaagcagtgtaatttttttttaaaaaaagttatatacggaagttgctttagaaaatcatattaatctatttttaatgtaagccagctctcttgcacactgctatttctaaaagtctggtctcattctaaatgttaggatttgagtttaagattaatttttagtggattttttcggcgctcttaaaaaaattctacctaaacttattctcaacaatcacatttaaaaatgttagcatttgagaaaaagcattgtcaagcgacgccaatgttctaggtatgattccttataatgatcgaatggtagatttttagatatttttttaagaatggttctaacttcgaaatttaattttaggtctagaatgaaattttgaagttacctaaacgcagctatgcctatctaatttattttgtgagagctcttcagccaactccattctatttttgagtgaagtttggttaagcttatgatctaagagtgatggagctgaagataaagccgtgcaaaacgggcctaaatatgtcttaaaaaatactacaatgaaacgtcttattaaaaaataaaataaaattttgtaatatatttttccaatttttgcaatgaaacgtggagggcaatatccacacgagccacgcatcatccagcaaccaaccaaccactactaccactggctacactatgccgttatcctctctctccctcctccccctccaccgcgctccgctcccgccaacttcaaattacccgccaccgccgcctccctctcgcgccctcctcctccccctcctccgccactcgccgctcgcgcgccgctcgcccgtctcccgggcgcgtgccgtagcagccgacggcatggccgcggcgaccgcggcggcggagacgccgcccacgctgctcgagtacatgggccaggctggcgcggccgacgacctcgtcgtcctcgtggcgcacgtccagagcgcgtgcaagcgcatcgccgcgctcgtggcgtcgcccgggaacgccgagctgtcgcgggggaaggcggggggtggtgtggcggtggcggccgggcgggacgcgcccaagccgctcgacgaattgtcggtgcgtgcagtgtcagggttgcgtgggttattattgtctgcattctggttctcgcatctatctacatgcatttcatccttcttcttttttttaaaaaaaaaagaataggtccattttttgtgagattgttatcacatctcagtcatacgcttagcagctggagtagcactcatttggagtgtaaaatgttcatttactaattaagtttacttgaggtaagttgtgcaaagtgcacacaagagactttccccacattttcattcttgcattctcaacaaaatactacttgcatttgtggtgaaccatcaacagaagcacttcctatttgcaaaaaaaaacagttattgtttgtctgatgctactaacttgcattatagcttccaacaacatcaagactaacatatttttcaatttagaatgagatcatcttgtcatcactccgaagatctggaaaggttgcagtgatggcttctgaagaaaatcatctccccatttgggtttccaacgacagcccgtatgttgttgttacggatccgcttgatggttctcgcaacattgaggtatccattcccaccggaacaatatttgggatatacaataggctggcagagcttgaccatctacctgaagaggagagagctcagctcaattcactgcaaagcggcactcaccttgtcgcttcggggtatgtgctgtattcatctgccaccatattctgtatcagcttcggtgcaggtacccatggcttcaccttggatcacttgactggagaatttgttctaacacatccttccatccaaatacccccaagaggtaactaataagctgtaattcaataatttgctaattcccttagtcttcattaaatgttaaccagatgtcacctaaattcacttacactagtagcgcaagttttctcaatttatggattggtggatgaacagtttatcaatgtcagtaatttgaggagatgttttagttgaacagcggcaagagtgcttgcattgtgtttgagaacatgacgtagagaaatttcttataactgaacgactgaaatattaactgtgttgaacttagaaatgcatgctttcatctttgctgaaaagctgtaatcctgagctatgccaggacagatatattcggtgaatgatgcgcggtatttcgactggcctgagggcctaaggaagtacattgacacgatcagacaaggcaagggacagcatccgaagaagtactcggcacggtacgtgtgctcgctggttgctgatttccaccggacgctgatatacggtggagttgccatgaaccccagggatcaccttcggttggtctatgaagcaaatcctctgagtttccttgctgagcaggcagggggcaggggttcagatggcaagagcagaatcctctcgattcagcctgtgaagctgcaccagaggctgccattgttcctgggaggcatggaggacatgcttgagttggaaagctatggagatgtgcaacagaaggttaatcctggatatgaggtgtgaagatatataaccttagataatgaggtctgaagataatgtagcatgcgaaaagagaacagggggacctactggagaactctgtatttgcaaaaccgatgtttttacctgtcaggttttctgtttttgtctccgcgactatgcggtttcactgtgtaatatagcagaaaaattaggctgcatttctcccggtacgaaatggaagggacaacacaaatttatatgtaatgcatcctttggctacatggacacttttatctgcaacgtgttctgaaatttcttttgtctctgcagtctgtacacttctctgcaatgtggtccggttagttcgatttaagagcagcaataagagtaacttttactatgaaccctgcaactttgtaaagcccttgcttactatagaacttggtgtgattagccttcagttgaactggtcctacctatgaggacaacctgcagccaaattgctgttcttattaggcagtgtaaagagctctcttatcctgaacttgaactgtttttctcaggcaggctggctgacggaacaatcaaaactagagggcatttccggacgtgtgattgcgatgagacgtgttgcaatatccagaccagtggctagacgtgttaattttaacttgatgaaacgtaaagaaggctggatccaaactttaattcttttccatcacatcaacctgttatacacacaatttgttatacacacacaatttttcagtccaaaatttacgctgaactaaaaacagccgaagtttgagttggaaaaaaactttatttggatttgttgtgatatgcccattaaacaacttaaccaagcgattaaagactgctgctatacgtgtgatccagttgtatgatttatgtataattagagatatacaatcatataattagagacaccgtccatttttgtccatgtgtcataagcatagcaattttcggtgattaatcgctaatcgactaaggcgatcacatcaaatatttagacacatgcacggagtattaaatatagaaaaaaaataattatatagattgcgtgtaaattgtgagacaaatcttttaagcctaattgcgccatgatttgataatatgatgctacagtaaacacttgctagtgacggattaattaggcttaatattttatctcgtagtttgcaggcggaatatgtaatttattttgttattagactacgtttaatactttaaatgtgtgtccgtatatctgacggagcacacacaaacttttcacctgaactaaacagtgcctaatttatcggactaatcggccgttttattgcgtccatgaaacaaaaaccgttctgaactgcctcgactcccgtctcctcgccggaaagccgccgccgccgccgcccttctacttccgccgcctcctccttcttctcgagaaggctctgcaccacagacgagagctgagccgcggagcacaatgtcggcggactcggcggcggcggggagggacgctctcctggacgagctgcgcgcgctcatggcggcccactccccgtcgctccacgcgctcgtcgtcccgtccgaggacgcccaccaggtccgtccgcgcccgctgccacctcccgcggagtcgatcagatcagatcgggcttggatttttgttgttgttgttgttggattttccgttttgcgcgatctcttcttcctctcgatgatggttgaggatttgggtgtggttttgtgggtgattgattgattgattgcagagcgagtatgtgtcggagcgggacaagcggcggcagttcgtctccggcttcaccgggagcgctggtatgttgcttcctcaattcatcccttctcgtttcccaggcgatgaacgctgtgtattgtcctagaccaccagccgatgagtctgttgcgatgagttcattatacaatagtgcaattggattatgcaacgttgttcagggttgcaatttttaccattttggtgatacacaaagtggagttctttttgctctgcctgacatgaatcagaaagcagttgactagtaatagaggctaatggttgaaattttaggagcagttatgatttatgacactgttatgtttttggaaatttaggtgattaacagacatttttggactggattgttttatacattgcttcgaccaagcaaatcgtaataaaattattgatagcttcgctaccatttatagttatggtttaatctagctggactaaagtatggaatgataaccacctttgtactgggaggagcttaattgattcctattttgtagtaggatggagttgaatatcataaaatgtggatgtaacatattgaacttgttgatttcttttgttttcccccagttgtcgtaatcagagagttgcattaatttctcagaccgagctatattgcgttgctacacaggtttggcgcttatcactatgaaggaggcgctactttggacggatgggcgttacttcttgcaggcagagcagcaactcactaatcgctggaaattgatgcgcatgggagaagatcccccagttgaagtttggatagctgatgtaagtgttgacatctcttcttgatcatgttcatgagtttaatttcccaagtcttacataataaaaatattggttcacaaaacttgtccatggaaatgaatttatttggttataccctctcatttttttttgaacagccagatcaaaggtttatccttgctttttgaattctgccacagtttttgtgttgtgaaatcccaaaagtggttttattcttgttaattttagctagttttatctcccaaatatggtccttttcattttgttaaccatattcagttgttttgttaataccccaagcctactatctttcttcctgtctgctgtagattcaaggaactgcatgatagttggtttgatatatgggagttccttccaaaattatcagaactaccagaattttgggcacataaatttattttgatcataccaaatgcaagcagaaatttaaagatctacttgaggcttttattttgctagggagaaaactaagaatagtcatgccaattattcaatgattagagagaatgggtttagttatttgttgatctgcattgcatagcaatactcatgattagcgtttaattttattctgaataatgttgtttctaactaacttttgtggcttgtgtttgttgctgtgcaatcagaacctgtcagatgaagctgtcattggaattaatccatggtgcatctctgttgacactgcccagagatatgagcatgcattttcaaagaagcaccagacactgtttcagctttcttctgacttggtagatgaaatatggaaggatcgtcctcctgttaatgctctacctgtatttgtgcaacctgtagagtatgctgggtgtagtgttaccgaaaaacttaaggagttaagagaaaaattacaacatgaaaaggctaggggcattataattgctgcgcttgatgaggtactattagacttatttatttcttggtttcttatccactacaatatattcaattttgatttcttgagaattttgtcaactttgccagttttaatagttgtccttttgttattcttatttaggttgcgtggttgtacaacattagaggaaatgatgtgcactacagcccagtggtccattcttattctattgtaaccttgcacagtgctttcttttatgtggataagagaaaagtatctgttgaggtcagctaatccactgaacacattttcttcaattattccactatgtcgttcatagaatcgtagtcatgattttgaggggcatgtagtgaactgtggctcttgtttggtccaggtccagaactacatgactgagaatggtattgacatcaaagactataatatggttcaatcagatgcaagcttgcttgcatctggacagctaaaaggttctgcagtcaatggtagctctcatggggaaaatgatatgaatgagaattcaaaagtttggattgattcaaattcatgctgccttgcactctactcaaaactggatcaatatcaagttctgatgctgcaatcacctattgctcttccaaaggctgtgaaggtttttttttcttttgtttttaattcataccacgcctgctgaaagtttcagaagaacggggatagaacattttacactagaagtgtattttgttcaagtattccttttgtttcattctatttattttaggctttttatctatggaaaatctgctatctgacattaaaagctttatcatttattaatctatctctttttttatttcttctaatgatggtatactaaaatcctgtcgagctggatggtttgaaaatctgctatatttgcaagttttatcatttattatgcctatatttttaatttcttgtaatcatggtacagaatcccgtagagctggatggtttgaggaaggcacatattcgagatggtgcggctgtcgtgcaataccttgcttggcttgacaagcaggtcagtatgaatttgtctctcatgcggcgtattagtcttggacttcaagcaagtgttcttttgcagctgcaaatttgtttagttgtgatgtagtccttctaattattttctactagctcagatgatcttgttttaatgacagatgcaagagaattatggagcttctggttactttactgaggccaagggatcacagaaaaaggagcatatgtgagtatgcactgatattaaacttatggttcttttgggaacatactccctctggccacaaatgtcatttgactttcttttccagtcaaacttttgaaactttgtcgatcaataaattttaaaatacatagtttgaaaacatagaaatggtatgcatagatattgtcttgaaaagtattttaatattatcatgaaattattagaatttaccataataaaaaaatcatggtcaaagtcacaccctgaagacaaaagagtgtcaaacgaaattatatcatcattgtatggagtattgaccttttattcacctatacaaattggaaccatctattatcaaaagatgcccagcttttctttgtagcttaggtctattatcctcattaggcccagcttttggctgtcagaactgtctaaatcagtggtttcatgccttcctgataattataaattttagaatatttttctaaggaggttgtgatagagttttcttgaacttcatgtgcaatactgcaacgtaacttggttgcaaacttgagacgcattttttttaatatacgttgttactgtcattgttcctttttgtataatatttaaaatgtagttccttcatttttttttcacttctgcatctcagtagtgtgtgcttactctgaacacgctttcagaaaaaaaaatcttctgtattcagatcatagaccaaggttgacatgttccttctttgttttacctatctggaatttttgtttgtccaattttctcatttacactgcccatttatttcctttgggaggtgtgcacattgttttgttgttttcactgaccatgatagtatgacaccgtgtgctctgctcagacagttgtatttctctgcccccttgtgtattttttctaaaattcaatgttgtaccaaatgtacttggtcttacttgtgggctcttgtactattgctacgataatacatatggagtacgacttttacatttggcaaatcccctgaagtctgaagtttcaatgctccatgattcctttgttcttagcctgatttttgttatatatataaagaatcttaccattttcttgatacgtcatttgttctatgcattatattaatcaattatcgtccactttattaattatgaataatagtgtgcatttggttgtgttaatgtttttgtttcactcctgtaggaatgtaaaacttacagaggtttctgtgagcgataaacttgaaggtttccgtgcatctaaagaggtatgctgctaacgtgaccttttttcaagcttaagtatactatattactagagatcttttataactgccataaacagctatagttactgccattaccatttttaaaagtcaaaagccagtaagtgcacttttggtattatggaaattgttaaaataaacaagttcctcatacttacctatgactttgttgtagcaaccccaaatatccattgaaactttggaactgatatagccaaggcccatcggtttcatttgtatccgttaaagagacaatggaaaaaattctactatactaactattttgtatttcttgtgcaatttttgagaggaagtttttactgttctttgtaagcatattttttaaataaaagaatactctctggatgacattatatgtattgttactatcacgtaaacacatggtaagtggagatagagggaaccatcagaggctcctcaatctcagtgcagagcccagagtgaatgcataaatcttttgcgtaaacagtccaaaaataaggcctattttttgcacaaaaaattctacattcactgacttcgctctgagctcttcattcaggaatcaggacattgagggtcttgagtcgtcccctctttctctgcttactgtgtgtttatgtcaaagtaaccaaaaaaaaagacttgttttcgtggaacatcttttctttggttgctagatgaatgtaggctgtgttcgataccatgggttgggaacccaaatcctgtgcacggaaaacggagcggtctattagcacgtgattaattaagtattagcaattttttttcaaaaatggatcgatatgatttttttaagcaactttcgtatagaaactttttgcaaaaaacacaccatttagcagtttgaaaagcgtgcgcgcgaaatacgagggaaaggggttgggaacctcctcatccgaacgcagccatagaaactacagagccaaatgagggcattttgcagttcatagtctcctgctatactacatcttttgactaactggtaatatttctgcagcacttcaaaggtctgagttttcctacgatttcatccgtgggaccaaatgcagcagtgattcattataaaccagaagcaagttcatgtgctgaacttgatgctgataaaatatatctgtgtgactctggggctcaggttgagtacatttcagtcaaactcaaattttgtggtaaaagacttgcttgagtctaattctttctatggtggtatgtttgcagtatcttgatggtactacagacattacaagaactgtacattttggcaaaccctctgagcatgagaagtcctgctacacagctgtaagtttattttttcgtcacttgctaaaattttcttttatttagaacaaatgacatgtcaaatactaagttctatttagaacgaatgatatcctaatagtgtaattgttggtcaaagtaatatgccttatattttgaaatggagggagtatatgagtgtccaataatcagttgacttgagctggagccttaccagtgtaaccgcttcatgtgttttactaaatacggtagaccagcatgcaggacatagctgcataactgctagctatctttatttatttgacaactgtagtattattttccatgaatttaagagcttagtggctgacatgcaacatgttgaaagtttgttttctgacacgttgcaatgttattggtttcctcatttcctgtattgcattacttgcccctacttaatggagctgaaaattccattgttgaatattatgtcaacagtggctggtcaagttttctttacacacttgttactttatttctcttgtagaaataaacatcatattaaatgcttgaatctaatagtttacaagatattgtctgtgaggttttaattttctttgctactatttaatctatttctaatgcaagtgatatcgaacattggaaataggttttgaaaggccacattgcactggacactgctgtatttcccaatggaaccacaggtgagtgagtgttttgagcttttatacttccatctatatgaactcaggagatttaacattgatcatgtgtcccaatgataaaatagctgccagatgtaccatggagttttaacatcacctaatagtgtagtatgtgataacattattgttctttatgagtgcatttacttataaacatgcgacatcatgttttctcaaagcctcgttgcctcagagatcatgtccatcgtttctttaacatttagaaactgtaagaagattccactaatcacaaatgttatttagtgatagactccattgtttctttaacatttggaaactgtaagaagattccagtaatcactaatgttatttagtgatagactatctcactaaatttgaaaaaaaaaaagatgacagaaactagcaagtgatgaagaaaatgatttatactaccatgttttgacaccaatttatgttcattgtgttatacttactttttcaagttatatttcaacaaaatccatgatatttgtgcgttacttaaaccttaacagggcatgctattgatattctcgcacgaacaccactttggagaagtggtcttgattaccggcacggtacaggccatggtattggatcttatttgaatgttcatgaaggtcagatactcaattgctggttcatcctcttctatgacagtaaattatctgattgtagtgctaccttgaaatgtttaatccattctgtttgtgcttacaacccaggtcctcatctaattagcttcagaccttctgctagaaatgtaccactacaagcatcgatgactgtaacagatggtcagtaaatatcctaaattaaccactatttattttaataggactatcaacagtttaatgtgaaactactttgtaattcttacttcgatgatagtccctcttgctgcaatgatcgatgtaaagttcaacttgcacaatcttttcttgcagaacctggttactatgaagacggaagctttggtataaggttggagaatgttctgatagttaaagaagccaatactaaatttaattttggagataagggttatttggcttttgaacatataacatgggtaagtttcttcaatctccattttattaaattattaactttctctttggtaatctccaagtctccgtatcaatttcacaagatatcccggttgataatacattgtattcttgttttgttgctctgtttatacctgtatgaccattttaaagtcagcctttgttgccagttcgactggcatttcatgatctctaaatacaaaatgctgctcaccatgtatctgcgtcatttgttttgctcatgttcatgtattgatgaatttcttgtgctatgcagactccgtaccagacaaaactgatagacaccaccttacttacccctgctgagattgaatgggtaaatgcgtatcactcggattgcagaaaaattttgcaaccttacctgaatgagcaggagaaggaatggctgaggaaagctactgaacctatcgctgcgagctgttaagccatcaatcaactagctggttgacgctacatggacacatgacacagggtcccaaccggttgcaactattcgtgctagatgtgcagatgatttctggcatgccatgcgcgtagataaataaatggctatccctcaatttaattacttgcaataagtgtgaatatatagcagaaaacatcacaatcgattcttttgcgttgtcattctgctaatgttgaatgtgaggatggaagtagagataataaggccgagtttagttccaaactttttcttcaaacttctaactttttcatcacatcaaaacttttttacacacacaaacttccaacttttccgtcacatcgttccaatttcaaccaaacttctaattttggcgtgaactaaacacaccctaaggccttgtttagttctaaactttttcttcaaactttcaactttttcatcacatcaaaacttttctacacacataaacttccaacttttccatcacatcgttccaatttcaatcaaccttccaattttgacgtgaactaaacacatccaatcaaacttccaattttgactgaatttgcaggttgcatttgtacagttattcagatgcttgcttgaatgccctgagcagtttggttggactaattaacagtaatcgcatcatttcaaagcttaaaattgaacacggtctgtttggaaaattcctatcccaggggcggcatcacactgaagtttaataaagagtaaatatcacattggaatttgaccaacattttcacttgacaccacatatctttacagttgcagtttggaatatcataggtgtttgtcagagaatgtcaaagaaatggttcaaaccatcattcttagtgttgtagtatcacgataaatatctttagaaactcagaaaatcccatcaaatggtcttttagaaaatcagaaaacaaccttttttttaaaaaaaatcacactaaaatggtgatgtgaatatgtttaaaagtgtcacaaattaatctatacggagggcaactgaataaaaatagaatagaaagtataacttaattagataccactcaaactaaatagaatgtaaaaacatagtacaatgctttgttttttatatgtatccctgtgtaaatctcatatgaagttccctcacatatttcgtcggtacccttacccttaatccaaacaaaatgatgcatagtgttaagtgaaaatgttagtttaactcttggtcaaaataaatgaccagatgtgaaatttaccctttaataaaagatgagccttggccccattcgtttctaataaaaatgaaagttaggatatggataaaacaaaccaataacacatgattaattaaattttaacacataattaattaaattttaatcattacaagcttaatttgaaacagatttatttgatgttttaaagaaatttacatacaaaaagttttttcgcacgcatagaatctgtatcctaatcagaagctaatggggcctttacttgggccgatatttgcacgactgaccctccaactattcgcattttgcatttcgatcctccttttgcctttcctctctcctctactccacacggcggcggacctccggcgaaccccgccgcgcgaggccggtccacgggaatcgatgcagccatgcagggttaacgagcgcactcttacctgctgcgcctcgcctgctcgtccgccggagaggcttccaggcgacgggggagcctccgcctgctgcgccggagtccgcggggcagctgggggatccgacggcggcgacaaaaaaaggtacagtggagtacaggtgcaacctaggattcagaatatccattcgaaattggtgttgcctgtgataatcatggttggttgattagcattctagagaattgaaatcgagaaggagcttttttatccaataattagaagaaattatgagtgtgtttagaattaaacacggaatcaccccccttaccgctacaatatcaagtgcatctcttctattgaactgatttacctttttgaaattcaggttacttgattggatctaggagctttttttttttgtttgacatggtgaacaaggttcatgcagagatagaacacacaggcgagggctgaaatggtccatcgatcgaataatggtatcacaacatgcatttggccaaaatgacaccatggtgatcagcaacaaagggagcaactgataaactgaacccttacatccatccatacagcctgcatactactacacctttggaaaggaggaggatcacaatgttgataatgatgatgatgtacaaaagatggcagtcaaaatcaactcaagtatcactgctccaaggcaagcttcttgtgccggtcgagatcgttgaggtaacttgagcgagtataatcctctgaatcgccggagtcgaacatgaggggtttcatgagttttggtctttgcatttgcatcatttcgagtgattccctatcccccttcaagaaacggaccacctacaggcatcaaaccaacaggtcagtttacaatccaaattgtttcttttttagcctttacaatggccgtatagttagcgtgttcatcgcactcaccgatttcatgctaggccgcgagcttgagctgtggtgaatgcacatggatgccactgctaggatgtgagccatttcttctggatcatatccaacatcaagagaaggatccactagttccttcatgttgttcgagtcgagcaatggttttgcctatgcacatgacaaacaacagcttgtgaattcaagggcttcagatgtatgtgattataccagttcatgttatccattcaagtattgtagaattaacttttgatcatcacttgcctctctcaatatgaccagacaatgatataaaatgagctgatttgaatttttgtataatggagcatattagagatttgcttttattacccatattactaggctttgtctggaggaatccacggctttccgtcctgtcactagttcaagaagcaaaactccatatgcaaacacatcagtcttctcatttatgatcccgtgcatgaaatactctggagacatatacctaagaaagggtgtaaagtctaagttaaaaccaacaatggcattgtttctttttctgggtacgattaaatcattgtgatgaaactgaaaaaaacttatcgaactcacccgaatgtcccttcaatggggaacacaacatgatgagtccatttgtcaggaagccactttgcaagtccaaaatctgagatctgtgcaatgagggagtaaaaactgttgcatttaaaagaaccctaggaatcatataacagataggactacggcaagagactggtagtagaatacatacctgaggttggtaatcttcagttagaaggatatttgatgctttgatgtctctgtgaattatgcgtcgatggcagccttcatgtagataaagcagtccttcagcaattccaagagcaatattgaacctagccttccacttgagggctccctttgtgcctgttcagctgaactccattttatcaccagactaagggtattctaagtattctcttatattgattttttttttagaaagaggatgatgcttgagttcagatatgtgatacggcctatagtatatgcatttaagaggcaattgaaatgagggctacaagaagtgataatgtaaaatttgtatgaagcctaccaaaatggaaatcacaaattcgcacatacttattggagaactacatttcatagttcagatactgcctaaatgaatatgttgtactacatggtagcatgaatgtcaagagatatctgttctctagttgattcctaatagtaaggtctatatatttcttacttttctaaaaaatgatatatgatgtaacatgccaccacatagcagcaatgcagcatatctctcagaaattggattcattaagtaaagaatatttagaggaaaccataccatgaagaacagaagccaggcttccatgaggtgagaactgaagaaccaagtgcaagcccccttccacactgaaccccaagagctgtgccgcatttggatggttaacatgagctattattccaagctcagataagaaatcgctaatcctgtcctctttgttaccaccttttgttagtctcttcactgctacaaattgtccatcagcaagatgtcctttgtacacctcagcatgcccgccttttccgatcaaattttctagtaatatcaagcatgaagcaaaagattcagagaatatttaacatagatgaagataatataattaggccaaaagctgtactttgtatcacatgacccttggagctatgatatagaggcagagcataacagctaagatttctgtattatatgctagagttaccgcaatgtagaacaaaatcaggccctatttgttaatgatttggtattacagtgttatgcacttatactttaatacttctcacttttctaacttctaatcagtaatcagtcatcattacactaaataacagttcatgatttgaatctcaagccctatgtttccttggtgaaattatactgctgcagttataaattcatagcttagtgttaaagctacatcccataagttctgcaatgatagtaacatggcctaatcgagtgacagcattgcagcaacaaagaagtaagttttgcatatcacctgaactgaatttgtcagttgcagcacaaagctcactgtagtcgaagcttctccatgatggcctccacttgctgatctcaggaaggatctcaggagcaatggcgccgcaatcgatctggttcttgccgctccgcatcctctccaggtacctcttaagccctgtggtcttggttctctgagggaatgtccccgctctcgccatcgacttcctcctcctgagtatcaatccactgatcaggttcctccactgcgtattgtgattcgactccgctggctgctcaacggaggagctctcatcggagtcgacactaccggataccgagatgtctagcaccgcgcgaggagagctctgatcggtgcactcgctgctgtcatcgttaccggccttcgaatccatcttaggcgcctctttgctacctccatcagaatcagcagattggctgctactgtcaccaccactactactgtcactgggttcttcagtactgctcctgtcactgggttcttcagtgctgctcctgtcactgggttcttcgcttgatacgacggcttcggttactgacccgctattgctgcaatcctcatttttcgcttcgtcggaatctctgatggtgttttcttggtgctcccctggccctgaacacagcaaaggagatgtagacatagcatgggctattatcataggtttgttatgctacaaaactgaattttatcaagaagacaaattaactacctactactacaaacatcaagacaaacaaagtgcaaagcaagtcaaggcaagaaacacatcatcatcacacacacaaacacaggctctcagatcccttgacagtggatgataaggggggagaggcttgtgtttgtctcgtttcccatgaaaaccacatgctgccagtcgacagtatctgaggcatttctataattcagagatttgcaccaagaattgacatgcgcaccaccctctgcacccttccaaaattgatgctttctttctatctatcacacacagacagacacacaactaagtctgaaaataacctgtgcatctctgtgatttgcttgcaatttgcgaaagatcatcaagagggtgcttaaatcaacataaatgtcgatttcaaagattttggtttggtgagaaaaattggaagaacttgacaatctacccatcttctatatgatgatagggaatggaagcctgcccaacctaatagcatatttaaaagttacaaagaagaccagaatccagcagctgacatctctcttttttttaatctcttgttgccctcttagaaaatgacatgttagagcttcaaagctgtgagcatgcctggaaaaaaaagccatgatttttccaggactaatggagcacttagactaaagcaagaaagaaagagaagatacagacaagcactaattgtgccacacatgcagcaaagagatgaggaaattaagcagtaaaaaaaataatcaaaatcaccacagctaaccttccttaacaagcagatcctcctgcctcccatcttcattaccgacctctgcagattcaatcaccaaatactccttcagtttcgtcatcaccaacaatttcttcttctgaatttctctctctctctctctctctctctctctcttccccaagacggacagaagaagaagagagaagagagcagaagaagaaagaaaaaagaggagcaaacttgtatgcgagaaacagaatatttgagagagaagagaagaataccttcgttggaggccatggacgacattaatccctcctcctcctcctcgtcgccgtcgccgtctccttcgctttcaaacgacgacgaaaaactcaacgggaggagcaattgctgccgatgctttcttgcattgaagtcgaccaaccgttgaagcagagaagaagcaaccaaaccaaaccaacccaactgaggcaaacagtgcagagctaagctcgcacggtgcccaagaaaatggaggatggaaagaaattaatactggagctagagagagaattgctaggacagtagagagagaaagaagatggcgggttcttttgaaaacttggctgtgcctgcacactgcacagtgcaagcagtgccttcctttgtgttgcagctattcctctcttctctcaaaagaagagaacatttgtagatagagagagagagaggggcaagcaaagcaagcagcctagagagagaaagcagcagcagcagtaggaagaggagacaatgcaatgagagcaatgaggctggtggtgtggtggtacaaccttttgtaggagtgtgtactactagtgacctctagacctttgtaggggacctacagcaacatgccaaagggagaagaagaaaaattattcagaaaacataaaaagaaatggactttgtaattagaaaaatgagctttgtaataatggaatggtttctcttggagaagagaagaggagatcatctggttggtggtggagaaagaatggatttggatgtgtctttgtctgtgtgtgttatctctgtactctactactcctcctcctgttcagtaattaatcgtcgtggtgcatgggattggatgttgctgttaggggacaatgaggttgatgtcgtgtgattaagtaataaacaatgatttattagtgacagtagggttggtaggtgtggaggataaatatctctcaaattagagagcctctcttccagtggagtatttattgtcctttgctaattttgctatggctctattttaggtgaggccttggaagattttgtgatgatctggtttttctcacaattccacctcttcagattttcaattttagaaccaaatttataagtttattcgcttgttttttgttacccaactctcttttcataattgcgatgaagacgagtaaaaattatacctgaaattatttttaaaaaaatcaaatttcaaaattatactcaagcatgtgtattgaaaggaacaatgaaaatgcagtggactattttattgtagaaagtcggcaaagtttatggatcatgatttgctctaaaacgtggcagcaatcaaggttcagttggaaagcttgcctaaaccattccattctttgaagataatgtatcatactacggttttgtctaaggatttcatgagaaaatcgcatgagaatgagatactatcattttttttacttggatatgccagcttattcccagtaatttttttttttgaataacctaatgagtgtgtatcataacagcgataccgttgaaattgtaagtgaagtcactttacagaatacagatactttagatttgtaaacaagtcacgagcaggaaaaaaagattcactcccttaggtttgcttgttggcttagaagccgcatcaacctttaaaatttcaaacttaattttaattttaaattatcctagatgttttattttcaccatttttttggcttctgaaccgttaagaatataaatataaaaagttttattctaattgtttttaagaaaaattatattctattttttcgttacttctttttttttctaccgcttatcaaccaaaatcaatcaatgatgctgggaaaaagaagaaaagaaaaactggttccgttagtacaggagttgttcggaatattgggcgcggctacagtaagataacgtttatctcaaactcaaattccacagttgggaacttcaaattccaaatcttcgtatctcaaaattccaaatttcgaatcccatgggagcatttaccccacagaaagcagaagcaaggacaaattgtagcattctcaccggatcatcagaataaatcctcatcagaataactcccatatctaattcagatatgagaagattcacatgtcctgcacagtgcagatcgccgacgtttacctcgcggatccattaatacgtcgttcataccacgagtatacactattgattgcatccgtagcactgttccttcttctactacttcttcttcttgttctgatatcttcttctcatcaataattcacaagactggttcttgaaatgttcccatcaatctctgtccagatgctcacccaggtcgaagatttttgttttttggaagaattttggtgaaatgatcgctgaatgcgagccagaaaagattatttcgcacattgattccagcaataaatttcacaaagatcacgtatgaatgatggcaaacggccccatcttttcgcttaagctcatgcttatcagccaaaattcaaattttcaaccttaaatttgaagctgattttgaggtttttttattgaagtttattttcaacctttatctttaggtcgctaaaagcatgtatataaaagttttattcacaaattaattctcgtttgtaaatatgctgtttggccaaataatggggccgaaagcttcttcgagaatactattgaattgtggatgaacgagtattcagctatagtatcagacatcgatccatggtttggtgtcctgccgttttcaggctcaaagccagttgacagagctcccattcgaggacgaaaatcaacgaaactccttaaataaccaccgtttcgaattgacacgtgcaccatgaacacgacacaaattctaatccaaatcgcctctcccaatctccattctccgagaatggatacaaattgctgtccattattcaactctgacggctgacgatggcaacgatgcatgcatggcaatatggcatgcagaagaggcaagttggattaggtaggtagtttagttaagtttaacagtgccatcaaggcatcaactaacctgaaaagtaattagtatgcagagttaagcaaagggattattgtactagtactgcaccttttgctgttcattgctgatgttgtactgcttgtactgaacctgtgtcgccaattaactgaagaatcatgtatggcagagaaattattttccattaataataatagacattcataaatagatatacatacatagttaaagttataattggaatacttagaccccaaaccttgtaactaaggataaaaaagctattacaagactaagctatatttgcttcaaccttactatgttcttatgcaacaccaacccattacatcgctcgtctacgtagaaacctggatattagaattgttgccagagaaaatgcgcaggggtcttccggttagctccacaagttggtgggatagacgacctgcgttcaaagcctcacccccttctaattatttgataatgatcattccctaatattcgcgttttattagaattgttgctagaaaattatcatctgttgctactcgaaccatgttgaatagaaaccacattgaggcacgtaatcgattggcagtgaaaagaatggagttggcggaccgaatcctcgccgtttttaatcgtgtcgatgcaactcgccaactgaaactgaatcaacctgtggtatcttcaagggatctccactccatcgagcagcatattttctttctcctcctcttcttggtctttggtccccttcttttaagcgaaaagtagcatcttttatgttctgaagaaacatgctaggaaaagacaaacaacaataagaaaaaaaaagtattactaactggatgctaaactgctaatgtttttcattgctcaataaattatccatgagaaaaaaaaagattataactgtcactagaatgcaatgatacccctctattcttttttacctttagttttggacatggacatggacatggttctctaatgtatatgtttcattcatcattacgttttctagttatatgtttataaaacttgttaaaaatattcccatatagtgttttttatgaaaaatatattaataccattttttccatatcaaatactaatgttttttaatctctgaatgttctaagagtttaagatttgactgcatgcatttaggacatcatccttttaaaaacagagtgttaaaaaaatttccatattaggtcgctggtttgtcattgaagtgagaggtaagttgcagcggcaaaggagaattagctcgttttttacagtagaaaattagccattccaacaaatcctagtctcagattgtttatgcattgaaaaacgtcgagaggttttccagctagctctactaagacattgcctgagttcaaagtctcaccttttctatttatttgatattatgtcattttctagtatttgcgtttttaattgtttacgcgatgaatgataagctgtacgaaataaacgaaacaacaaaaattaatctatagaatttattttcttttgttcttaaaagctgatactgaaaaataatttttgatgaaaagcctccaaaattaagttttaaaacttaaattttagtaactgctgataactcaagaagcagtgtgctcggtgcaaaccactgttttcactccattacctacatggtgaccaacgcatttgagcgctagcttattcagttgatggcaaagcattaatgcaatgcacgacatatataccaggatacagcttcctctgtcccaaagaccattatggataatcaattttttaggagaggacacaatatggtcctagaaaaaccacaattacaacacgcccagcactaatactgtcttggtaccattagcacatggcttcctagtgataggaaaattaaataaataggcctcatttttaaggcatcacccaaaccaaacggctccttaaattgccttcgtactgtactgatacccccttcacacgtcaacaccaaagaaaaaattagctctcctgatggcatcaaaagaaaattcagaaaaaaaattaaatcgagggaaattagctggcaccaaatttaaagaaaaattaagatgtcaagagatgacgccaaagaaatcgaggacaaaaaaaaagaagcttgagtttttttttaggaaaatatattgctagcaagtttcctgagctgctaaacagtgtgttttgtgcaacaatttctatatagaagttttgcaaaaaaattcagcatatctatttttaaaatttaaagtaattaataattaattaatcatatattaacgatatactccctccgtttcaaaatatttgacatcgttgactttttagtacgtgtttgaccattcgtcttattcaaaaaatttaagtaatcatttattctttttatatcattttatttattggtaaatatactttcatgtacacatataattttatatatttcacaaattttttttgaataagatgaacggtcaaacacatgctaaaaagtcaacggtgtcaaacattttgcaatggagggagtatctgttttgtgtttgactgaagagttccagtcattcgcttaaacgaacgcaccttaaataatgtgtggtggaagaatgtctttttttagaaaacttatgtttctaagcatgtaataaataatatgttttaataattcggtgaataagtcgaaaagagcaaatcaagggaaactagcagcctagcaagctccaaaataaaattaagatgtcaagagatgacgccagtgagatccaggaccataaaaagaaagcttgagattgaagtggtttggtgtacttggtagtgtcgcaacagcagccggtcaaaatacagttgagcaggcctgccgtctgcactgcactgcacttttgtccctgaaagactttttttgggtgcttcagtggataaggatagtatagctttggtgcatctggattaagtcaccttccgctaattaatcactggattttgacatgacatacacaatgctgctttgctgatcactaagctaaaaattggttgtgtggatgctcctgtcatggtttctgaaacatggagttggagggctttggcatatgcaggagaagagcagatgatctgagcttctgacttcatgtctgtgtgtgtggttagcaaaacaacaacactaatctttttgagtgcaagttttgcattagtacaagcttaagatgcagtgaagcaagcaacctaaagcaacagaagaagagagatgatggatcacgagcaggtgagcgactccaattatccattctggtaatctggcccaagtcctgggctgtgtcacttgactcactagatgtcagagatgacgatatgctcctgttaatggtgccgctgtttgcaacgcatgaaacctaacttcgcaagattgtctctcctttcttttctttttatctaaacaaagtctaaaattgggaattaatcatttcctacaattgtcaaggagaagatcagaagagaagatgagcatcaatcaccatgagttacttgtcaacagaacggtagtactgacaccgacaagtactggattttggaccacgatcacaggagtgatttgtgatcaaactgtctctccaataacaaagatttttattttgtttttcctcgcagaccagttcaaacgaaagtacaaaacctgacttattaaccgatgtatcgatggatgtggatcgagagtttggtcaggcacatgctgcagatcgagccattactgcggcggcggcgtgtgtggaagagattgagagatcagaattgcctgtgaaaatgaccgaaacctaacgaagttttgctacgccatttgtgcgtgcggatttgaaggctcacacgccgaactccggtggctcgccggccgaagcggcggtctttccggcgagatcgtgcgttcgtgtaactgaagacagcgacggtgttggatcgccatgagtgtactgtatacgaggatatcgatgggttttattatatcgcatttgttcagaatcacgttggttgcctgcagaaatttgatgaaggatgtcaggtttgggtagttgtatgggctataagatgaggtgtgttgggtagatgggccggataatgttgagcaggccaggaaggctttggcccagaaattttcagagatctagggaggaataagtccattttcattcctcaactttccgtcgagtttaattgataactctaaactgcaatatcagacatcttcaaccccatcatagtaaaaccattcaagtcagatcccgtgacaatatggatacttgtttttgctgacgtgtttcagcaaaaaggaaattaaaaaacaagtgggcccacatataagtggacttccacatctccccacctattccatctctcccctctctttcataggagctcgtcggcaaggagagcggtgacagctggctagaccgtccgcacgaggcaacggtgggaggtcggtgatgaggtggctctggtggtcagccatagtggaggaaaagagaagggaggcgagggagccagccatccgcgagaaggcatcagtgaaggagaggatccaatgccccagcaactccgccttaggtactcctgcggtcctgtgatgctggagtgggctcttccccaccactcatgctcatcctcgtgggacgttcctccccaccactaggggtgggctcgccgcctccacccaatcatgttgagaataggaggaggagccgtggaggtggaacttgagctttgagtggtggttgcgtcaccatgtcctagttcccgtcccgagccgctcgttctttggcttattcaccgaatcttggttcgtctccaccagtgggacgcgctccacagcgagtcaacggtggcggtccggccaggcacctctttgtcgctcctcgactggtcgacagaagcgatagagctgatgaggtcgaaggtaaaggtagcatcggcatggtccgccgtcttccggtaagacactcacactgtttgctagataagttcaaaggggaggtcccaacatagatgacggccgcgacttctccttcgattcggcagcccttgctccaatttgaccgcgcgcccccttaggagagagagagagagaagctagagagaagaggggaggacagtgatgatgacatgcgggggccacttttggttttgccacataaattcctagttagcacgagtggaacagatcaacttgccaattgccatgtcaacaaaatctcagacctcagattattggttgtggattactcgtgccatgctccaaaaaaattcgatttctacaaaatcttttcgaaacatacatacgcatttgctcacaatacgtgtactctcactcctatgaatgcacacacgcacaccctaccgctatgacctttcggaagactatgtcgacatatctcgagattgacgaagtcaccatgttgtctcgctgtcggcaggtacagcacctaccactgaaagaataattagccgtgaatgtgagtacatgtgtcaaatctagaacttgtacccaggtaggctggttccaccacgaagaatctaaacaattgagcaacgcttacttcacgatttctccgtaaactttaaacgttagaactgttcattgtttagactgctttgtgtttaaatttatttttaaggtttgtaatatataatatttgactaattcacataaacaaatccatcatctttaatccaaattacatggttctttgaaacgtagtattgaaaaaaaatggaataatggaaaaagagcaaaggatttaaacgtgaacataaatgcaaaatagagtacaacaaaacataagaaaaatatagaaatagtggtttgtgtagaccgcggaaaaaacacatgaatcgaattagataaatagactcgcatgaaatttttcaagggtttagagttcttgtaattttcctctaaattttttttgtagaattgtccattttatatgattttaaaacaaaagtataggattaaatctttgtttcgaagactttcctacgattttcctataatatagaaattctccaaatttatctccgtttcaggttataagactttctagcattacccacattcacatatatgttaataaatctagacatctatatgaatgtgtatctagattcattaacatttatatgaatatgaacaatgctagaaagtcttataaactgaaacggaggaactatatgtttttttttagaaggaagtatatgtttttggtacggttcaggaggccctcatggggaaaaactaccaggacgctctccaaaaggatgaaaaagaacattactttgggcgcgttggatccaatacagatggtcgagattgacccacgtcgtccaaggattcgtccacgattcagaagacgttgaaccttatccgtttctgcaacgctacgctgtgtttctctggtttggggagctttggaatgaactgaggcagcagcagaggacggagccggcaagccatggctccctccgccgccgccgccgccgccgccgccgccgccgccgccaccgcctcgccgctgtcccgtctcctgctcagcctcccaaaccccagcgtgaaacttcccgtgtcttctccgagccggaacgccggcgccgccgtggccgccaagaacagcacccccgtcgtcgccctccgccggcgcgaggccgtggccgccgtgctgtccgcatccatcctctcccgcgtgctccccgcggcggcggaagcgtccggcggcgagtgcccgctcgaggtggcgcccaacggtctcgccttctgcgaccgcgttgtcggcaccggcgccgccgccgagcaagggcagctcatcaaggtcagcacgacagcacgcacctgcccgcccaccggccgccgccggcgaggcgaggtctcggggttcttgctaacctcgccgtgtgtttcgttcgtcccacgcaggcgcattacaccgggaggctggaggacggcacggtgttcgacagcagctacaagcgcgggaagccgctcaccttccgcgtcggcgtcggcgaggtaaacacgatcaatcaatcaagcacactaacagattctgcaagatattcaaacattgtactaatcggcaacagattacgcagctacacgatgaattagactcatctctgataccaagatcactcacattgcatattcactgataattcttcaggtgatcaaaggatgggaccagggcatagtgggcggcgaagggatcccgccgatgctcgccggtgcgtctccctgcctgaactgaaccctgaaaaatgacaaaaatctgaaatgaactcaccatactcgatcagattcacctcgattttgtatcaatttagagaaatggtgaagctgaatggaaatgtggttgaatgttcaggtggaaagaggtcgctgaggctgccgccggagctggcctacggcgcgagaggagccgggtgcagaggctgggagcccacctcctgcgtcatcccgcccaactccactctcctcttcgacgtcgagtacgtcggcagagcagtcggatgatctctccctgcagatttggtttcttgtgttgattgatgtatgcagaatgttcagagtatatatcgataccgagttgagagtttcagactgagaacatttgcagagagatttaagcagcacgatcgtggtctacgggtttgaaataggttatagattgtgaaaattccaaaagctttggtgagtttgggcatgatcaagcacatcatgcccaaaacttcaattccaaactacaacattatcctttttcattagcaccatttctcgagctgctaaataatgtgtttttgtaaaaaaaaatatttctgtatataagttttttaaaaataaatcaaagaaatatttttttttaagaaggagagcagcgctctcccatttcatttactgaaatgcagattacccaaaatcaaagaaatctatttttgaaatttataatgtttagtaattattcatgggccgtctcattttatgtgctaatatgctataatctaataaggagtttcaaacgggcctaaaaacatttagggagagaatttaggaacacgaccatgctgagcgagtttgaacaacattgccaaaatgcccaaaaaaaactttggtgactgatttcggcaagatcgtccacaccatcaagctttcatattctctcaatgattggttatacgtacgagttctcattcagatgattttcgaagaattttatctgaaaattgtagtatgaacgaatccggaaatgaaacgattttgctaaatttttgccgggtgattttttttcatagtatttgacgtttttctagccgcacgatgttttccaagatttgtgcaaaagcagggtcagttgagtccatgaccaagtcaacctgactttatatcgatggattcatgtacatcacgcatgtcagattgtcagtagccatttacttcttctatctatttctttctttcttttttctaggtaccaaaatttacagtgcacttgtactaaaataaattacagtacacttacataccatatctactgtttttacaaatataattttagttataaagcactgtatttagttataaatgcaatatttaacacttcagatatctgcacggtttctcaagcaatgtatttatactaaaacgacaaatattctagttacccaaatttacaacgcacttgtactaaaattatagtgcacttacatgccatatcaactgtttttacaaatgtaattttagttataaagcactgtatttagttataaatgcaatatttaacactttagatatctgcacggttttctcaagcaatgtatttacggagttgctagaaatatggcgccatatgctacagtcgattttttttcagccacttacacagtagttacacctcatttacaccccaatttacatatgtaattttagtacttacatatgtaattttgagacttacattgtaaatacactaaaattacatatgtaatttagggacttacaatgtaaatacataccgactattttttgatgaaaaatatggcgccataaatatagctacacccatgtatttatactaaaacgacaaatattctagttaccaaaatttacagcgcacttgtactaaaattacagtacacttacatgacatatctactgtttttacaaatgtaattttagttataaagcactgtaattttagttataaatataacatttaacacttcagatatctgcatggtttctcaagcaatgtatttatactaaaacgacaaataaattatagtgcacttacatgccatatctattgtttttataaatgtaattttagttataaaacactgtaattttagttataaatgcaacatttgtcggtaattttagttataaatgcaacatttgtgttaatctttattgaatactactctactaataagtacaatcacatgctacttggacggtttctctgtattgttatttttttttttaccgttggatgcagatacgaggggagaaaaaaattgggtgatttttttctcaaaaataacacgccacatgcctagacagtcccatcaggaaaagttcttcgaagtaaaggcccattgtatgacatatccgggccgcaattgtggcccatccgtcgcaagtttcccgggcaaagcgagatgggccgagattgcgatctgtcaactctcttttgtgggcccacctgtcagtctccgtgtctcgctgacttcctctgcatctctcgcgccgcctcgccggcgaaggtcgcctctccggctccgccgccgccgtcatcacgagggctgccacggtcacgagcaggcgggcgccggcgaggtggaggacgggagtagcggttgcggggagaagaggaggccggtgaaggggaaaaggagagggtaggcttgccggcggcggcatcgggcgacggcgacgtatcaggtgagagaatctcggcgagttctctcgccatccgattcttcgattctcttccctgtcagtacgccccgcaattccacagtgctcaaattttacggttcaagacaaatcattatgctgatgcagaacgcagctagaatttttcaggtttgcagccgtttttttttttttttggatttccggaccgctgtgcaagattctgcaggcttgtgaggaacacaagaggaatggataataccccacgattttcaggaggaggagatgattgtgagttgatgcagcagaaacaagaatgggccaagtataccctcagaaccattcaccaatcaagaggagtcagttcacatctcatgctggttttttcctgtgctgtagaacacaagacatgctaaagagcaagctcattcttgaggatgattttgggtggaatttaccttcaatgggctcaaattcagatcagagcaatgctaataataagggcaacctgaagtatataggaggtgttgacattagcttctcgaaagaagacccttccacggcgtgtgctgcactggtagttttagatgctggtaccttagaagttgtccacgaagagttcgatgttgttcggctgcaagtgccatatattccaggatttcttgctttcagagaggtattgtgtgtcctcttattttggcgtgtttggtttgatcaaaacatatgtttgctagatcatgagcaacagtttatccatgccttctgtattattattcaggggcctagacattttcattttctgtagtgatgaacaggcagacaagcaaacaatgaaacaaaatcaagatgggtacattcatatttattgtgtttttgctaactattctttcttcttatctgtataaccatatatgggtctagcatgttcaatgcaaaatcaagttatgattggacgtggataaactgttgttatatgctaactattcttttaattattctactttgttagatggtttaaaatatacatcaagtatattgttatacagctaaaagtgtcaacatgcactacttgttacaggctccaattcttctaggactcttggaaaaaatgaagacaaacaaccagcatttctaccctcaggttgctttgtcgttgcaatttacccttctgtaaataggtttactgtggctttatgctttgtagcattccatgttgtcatatgttgtttccattttgactgtgaaaacagtgtgaattgtctgcgctgatgtataatcatttgtcatcataaatatcatttattctagaattttgatctggaatgcttaatggcataagcattggcattaaattttagatatgttagcgtcttctagttttacatttaacactagttatgccagtgccttctctatggtttaacttgatgaactgacaggtactcatggttgatggaaatggattacttcatccacgaggtatacctcattagtgattagtatcatggcaatcttagtttgtaagactaagatgattcatgtgattagaaaaaaactgcagaatcacacacataacatgattatattatattcttttagaacgaactaccttgacagtccttgtagtccctagtcaattgacttggtgatagcgtacagcatgtctagttatgcatatacactgcaagctgcatcaataaactacttgaatgcatgaccctctaacttacatatgttcaacaggttttggtttagcttgtcatcttggtgtccttgcagacctgccgaccattggagttggaaaaaatgtattaatattactgccattgcaactactcctatggaagttctctcatctagttgttttccgaccatttcaagtacttgatggttttctgatgttctgatcctctgagagaagactaagtcctcagtgttttgaatgccccagctgcaccatgtggatggccttaaccaatctgaattgagaagacaattagaagcaaaagaaaactgcaacaaggagttaattttattgactggacagtctgggacaacatggggagctgtaggagattctatattggacctctgaatgcatccttcacttcatttctgtcatatatttcctgataatgaaaaggtttctattgttggaactaaactattaacttatcccaggcaatgtgctcctgccctagtttgtcgaagccgatctacatctcagttgggcatcgcatttcacttgactcagccattgggatagtgaagttctgtagtaattatcgcattcccgagcccattcgccaggtagaattttgtaaatagtatacctcaagtttcatcttgtcagcacgttgtatcttgggtactaatttgacgtttcgtttcatccttcgctaggctgatataagatcaaaggtgttccttcaaaagcaccaaaaacttgaagagtaataacaagattgaaatgggagttttatcttctacctgagtcaaattttccacagcatgaagtaacttttccgcagctctttctaatcgtaatagattgcacattgcgccgtcgttttctttttcttttcctttttttgtacatgagggtgattgtcacttgtcaggtcagtgttgtttgtaaaatagactgcaggtcacctttgaacaatctgaaatctgttcagctgttgatgtccgcacacttgttagctaatttaatcaaagatttcaatttacgactgcagaaatattgctctgttacaatactaaacagtggctcataaaccagctgggggtgtgtataaacttggaagtcattttaattctgtgaaacgcaatagtaaaaccaaatattatcgtgctgatgtagtgcaggcatcttaattccataaaggtaatatgaacctagttgttctaaaataaatgtgaacctaatttgttaaattaaatataaaaataggtggttgatttactctgccatgtgtcaaattgtcaatgagtctaaaaacggtcacaaatagtcacatggtaaaagagccctagcatggttatctttggcacataattaagtgccttatccttgtcgtatctaatctaactaatagagacattatggcatgttaaacttagaagagtcataaatgcatatccttctagaggcttagattagctgaatgctactattcaccaaaattaccctctttatttactatcgtgctgctatatatacacatgatcagagatgactgcgatgcagcatcactcaaagtctcaaaccatcttgcttccaacaaatccaatcagaagagcattcagcagtgggttgcaattaacagcgagatggctgccaccttctcttctgttatgtggaagatccttgtcattgctgtagccattgctgctctccttatcccttcaggtacacattgcaagattttctaagattagcataatgcccgtgtgttgcaacatgcttttttcttctaattgtctaatatattatcattttgtttatttttctatcattttgtaaagatgaaaattttcataatattctattgttatatttttctttctataagatctatagcatgtgggggctaagagataagcaactcaccgttcatgggtcccgtatggtagttgggtggtggtggtggcagactcatcaccaccactactatcttttatattagtatagatatagataatattgttcctctcaaatcactattacgattctgatttttacggttcataattactcagtatcgaaagagaacatcggagtttcaaattatgatttactctgtttggatgtggctgatttgtgaactaaacattggcatttttcttttctgatggatgcaggagagggcaagttcgtgtgccgaggcaagtgcgaggatatacgtgactgcgacaactggtgcaagacggccggaggctacccacagggagggcagtgtgtgccgcccctctaccaattctgctgctgcatcgagtagcagtatggatctccatcgtcttggcctacaatgttggctaaattaagagcttgatttgacaccaaaatctgcaaaaaatgaaatggaaattaagtaagtaggccatgattgagattaattacaaaacgggaatcaatttcagagaatcgcgagaattattcatgttttccatacgaagttttgttccgaccctagctgcattcgaggataaagatttggaaccttttggaaaacgtggtagctcattatcacatgattaattaagtagaactttttttgcaaaaaaaataacaatttaatagtttggaaaatatgcatgtaaaaaatgaaaaagtagagttgaaaaggttcgatttgaacacagttttatcgatttgaacacagttttatcgttaaacctatagtggcttataaaacgtaccgttttttagcggcaaaagaaaaaaatctataaggaaaaacctttttcatatgtattcttagcatttaaaagctagtactgcaaaatgaaaaacatcaaaatcaactgtatgactatggttttgaagttaaatttaagctacggcataaaccgaaggagtctatacggaagatgagaatcagcagctcatttgcgtcactggaaatccggattctgtcacgttgatatactagtttttggttctgatttgcttctgattcatgactaatttactcttaaaaaatgagcaaccttgtctcaccatttaaaaatgcccacgagcaaaattcacgtggatgacgtggttgccgttcatgtcaacagatctctccgaagattcaattaccgaaaatcgcaatattttataaccaaaatttggatccgcttacacctcggatctgacctaaaagcggtagctgcgtcatgtacacatgtgttgcctctattggcagattttgattttgccgaatcaaagtagactcacgtttcattggttttctcaaccaggccaatcaaaattcaaacaataatgaattcaaaatgttcaaatcatctacactggacaagtggacgctggacagtgactcatcaattcatcattcccatttcagggtctatttatatatgtttctctttatgcttctttaggaaataattaaagttagtttattgggtaagtggcagaagaaacctagtactgatttcttatttttcccttttaatatctagaattgtacttttctggtgcaaacaacaaaatggtaagtgtgcaatactaagggcacaaaaaatatttaaaaacttgaataggtattagaaaactgtagggtaattgagaagcaagggaaaaacttgtgacaatgggttgatcatcttatcatcgtcattatcacacataaaccctcctatcaaagaattgttcttatttttcacgacgaaaagacaaccgaaagaaacggaaaacgaccaccaatgcctccttttatgatgacaatgattttatactctactgctgacataggcaattatttctcaacaatcacatgagcaaattctacacgtttaagaaaataagagaagtcgatcggcatgatcattttcatgtctctataggatgcatgaaaaaaaaagtggtgaaagccctctttcctagtacaaaacatgatacaaaactcgtgcagaaatttgatgttcgaattaacagtgttgtgtttgaccatcgagattatatttccatgaaaaccaagaaagagaaaaaaacaaaaagactcgttattaataaaagagtaaattttacgcaattacagttttttttatcaaaatatcataaaactatagattatatataaaaatgtatcttaaaattacagatttagcatcaaatttatcattatcactaaactaaataattaacatcaatattaccacaaaattttagcttctgtaacttgaaaaaataatagtgctatagatctaaatttgaaaatatctatagttatatgataacttcatcactaaatatttaattttctgaaacgatctaaatctatagctttgtgataaatttagagctaaatctatagttttataatataccctttgaaatctgtagtttcatgataatctagtcagggaatttgctcttaataaaagctagcggattttcatatgcgtctcaatgatggtcaaagtattgtatgactatcggcctaactactagtagctcatgcaacattgagaggcatacgatcagcaactaccaagtcaatcttcttttcaaaaaggaaaaaaagaataaaaaatcctaccaagtcaatctttcgcatttgatcaactagtagctgaaccagagcctcccaagtcccaagtcctaagagcaggtataatagcaggctataagccagttataaacatattttaaaaagataaaggaaaagagagaagagcagcgggttacagatctgtagccagctgcagcacatgtttcaagacataatgtgtgtatgataggtgggaccaggtattaatagtatagtaagcaattattgtatgaattggctattatattggctatagatgatttaaagttagtaatgggctatactattaaaattgctctaatgtccaccttcccttgtgtacatacttgttcgagaagtcatgaaacatcctagttattgtactgttcgcacagacattccctccctaaattggtcgtagcccctgtacttgtcatttgtcaaaagaattgaaaattttctccatctcttgagtcttgaccggctccatcttagggtttttttggcacctatataatgcaagatgcattccgttctctgaactttctgagttactccatccgttttttcttaatatatgacaccgttgatttattgagatatgtttgatcatttgtccatcatttaatttattgtgacttgatttatcatcaaatgctctttaagcataacttttttatatttgcatttttgtaataacatgaatgatcaaacatttataaaaaaattaatggcgttacatattgaaaaacagagataatatttaaaaaccgcccatacgacaaagaatggattgtaaatctcaatgacaagtgagctccaacactagtataggtcaatacattacacaaccaaaaatctatgctctctcataatgtattttttcattagcatgagaaatattcctttacatcctaccaagtaccattatcaataaaaggttagtagcattcctacataaggcaataggttctgaaatatagcagggtacatttttttaactatagacattccctaatagttgtagaattgtagttatatactctgggtattccatactatcaagtacacacgcaaccctagttgacaacgaaaatactaaaccatatagttctgtgtctaaatatgagcatactgccttgtctacatgttttaatatacttcctttcgaaatcatgtattgcatgtttagatttacaatactagaatatatcatatctagtgctagattaacttattttaaggtaaatgtggtagcaccgtgcatgaccttctagaaggttttcaaagtttagagacgggttgagaactgagctcagaatatagatattggttaggtcgttactgctcctcgttgacatgcataatatagtatttgacaaaaaaaaatcatatgcacatcagcgtcggcacacggtttgaaggttttttttttatggttttgtcatggcctattgcatttttattttccttctatagctctatgctatatgcataaactaatacaaccttatataacaatctctgcttacaaatactatataattgtcactgcttacaaatatttaacgtttagagcaaaattcggtcaaacttttaaacttttatcatcaattttatattaaagtaagtttatgaaatctaataagtttgtatattgtggtattacttttgaagaaaaaaaatataggcatatcgttttcttgtttcaaaactaaacatttaagaaaatatttatagcaaaagctttaaaattttaatcaaatattatcataaacattaaatatttatacaaactagtcaactgcatccttgtttgaatcatctcaataaattcaatgtacgcatctaatagaataaaagatctcgagggtagaggactaaaaaataattttagaagatagagacgtgttatttatgcatacatggatggtttataccaaggaaaatatatagtttaaaccatatacacagtgaaaactgaaaactaccgttgtattaaaaaatagacgcatggtatttgtccacatcaccaagaattaaaaacaaatctcaagcatctatttttttaatccaatgatagttttcaagtatttactacattgcgatttacacttacatattttcccgaacaaatgtagtctattttggagatagagggagtaaaattaacactatctccgttttctaatagatgacgctgttgacttttttgaacacacatttgaccattcgtgttattattaaaaaaatttatgtaattacaatttattttgtcgtgagttgttttatcactaaagtactttaagcatgatttatatcttatgcagctacataaaatttctgaataaaacgaatgattaaacatgtattaaaaagccaacgacaccatctattaaaaaacagagggagtaataaatataaagagctgatttggtttgaggccctaccaaaatgttggtagtgtcaagcgtagatttattactagctaggc

SEQ ID NO: 58235 - DNA, 792 bp, Oryza sativa
ctcatcaccttgcttattattgcatatttacccatacttttgaacattacttgtgtttttacccctattttgtagataaaacctacaattattttgaactgagattttgtgagataatttatatctgagctgaacttgaacaaaattttgacacatgcaatttcatccaaaacgaggtcagaacaacatttattttataagcgaaaatagggagcagcacccctcaaccatgctcgccttgtgcaactgcatacgtcactatcgactcaacaaacaccatcgaggtgaggtgtggccgtgtggggcccgttcggagctcgcgtccaggagctgccgccgcctggtgctcgcttacccgcgctgaggagctactgccgccttgtgctcgtgttgaggattcgccgtctctatcttgcgtcgtcgcgccgatgacagctcacagcctccgccgctgtctgctgctcgcgtagccgcaccgcgcgaggaatcgccatcgccgccgccgcgtggtgctcgtgtattgaggagtcgccatctctgcatactgcttgcgtcactgagccgacgagccgtcgcctggtgctcatcgctgcgttggctcgtcagatccaccgccgccgcctgcgcatgctagaggagagtgaacaggtatgttaatactcagggtcaggggtagagtagtaatctaatatcttctaaattattttttcctttttcatttgtatttcttcaattcaatattatggaaccaccaaactgccatccatactatttcagaaaagcaggggaaat

SEQ ID NO: 58236 - DNA, 657 bp, Oryza sativa
tcatgtgttccaattggatccactctaggtgtatgatgctttcacaggaactacaggatactatgcgcaatggtgctacacgcttagaattagtagccaaggaacttttattccattttagatggcgtagtacctacagaatttcgtgatagaatctacgtgattttgaaaaaaaaatattattttagtagatcatatcatcggcagaagttgggggttcgtcccatctcgcctttttttatcttttctgttcacgtctgaattttttggctgtgtgcctacgggcagaggccggagatgtaacatattttcattatctaaaaaaatagagtacaaagagactgtctaaacaaatttttccaagcaattttgtgggcaatgttctaaaattgaaattatatatttttaataaaactgtagcaacgatctaatacattccaattaatatttcttatacaatgcagaggagacgtagatgatgttttttcaccttattttagaagattatcgatctaatttcacaggctagctatttgtgtactggtttttgtaaaatcaaaggtgtttttgattattattctgtgatgaataattggcatcggagattattggttttgttatttagaatttatttacgaagtggttttggagatgatt

SEQ ID NO: 58237 - DNA, 607 bp, Oryza sativa
gtatgtaaggattcgtccgtccttacctaaattttttcatccgcaacatcctgagtccaacactggccgtgccaaagaggcaagccgagcggatggagctagcgaacaaggctgagggttgaaaagaaatgaatgggactttcagcctaaaaccaaggagtattcaactaaaaaaaccaagcaagctagataatgtatatcaatttcaaaatatttttactcgttgcaacgcacgggcatttttttctagtatatatatatatatatatatatatatatatatatatatatatatatatatatatatatatatatatatatagatgcacacaacaaaaaaaaagtgattggtggacagaaaaataagtgattgacgaaaaaaaaatagttgacgatcgataagttataatttttaagtagctataatataagatgtgcatgcagaagttgcattacagagacataagagaaaatcagagagttctagcccatcactttcattgttgcagaattaatcgacacaactatggatagggcagtcaaaataatggggagggatttccctttactatcgcgtccctttcaaaatctaatccgacctacttaa

SEQ ID NO: 58238 - DNA, 656 bp, Oryza sativa
ccatttgtgcattcttgtgaagtctgaatggtaattcgtgtgtttggtattgttgatctgtatcttctttgtcaataattgccatggtaattctagagatagttctgttcattatgaagagcatttatcagcacatgactttgtaatcttacctgtgttgattggtcttgcaaaagatatcagcaagtcccttttgtcaacgtctgttccagctggttgatctccagaagcaactggtactaaatgatcaacatagcttgcaattttgtacattttcatgtggtttttgttgagcctgctaaggggaaaaacattgagtatcttcagctcagcaaatcttccaaggaagaacttgttttacatcagttacttttaaatatgtcgatgaattggtagtttaggtcctgtctagtgtagagaagctaagtttgttacatcatatatgtgccactccatatgtcctaaaatatagcacctagaagctttttgagtagatcttctttcttcctctctagtgtgctagcattggttccagtgtaaaagtgggactgaatatattctcctatagtggttggaaataatactccctccatcccaaaatttaagggattttggttggataaaacatattctaatactatgaatctggataaatt

SEQ ID NO: 58239 - DNA, 947 bp, Oryza sativa
ttttaaatgctgtttactgcaaaacttaacccctatattattatccccttgtactcccttgcattaattatgcatctccggtgtggcttgctgagtactgtggttgtactcattcttgctctatctctctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacgctagtatcaccatcctttggagtcaaagtccacctgaggatgcggttgcggtagatatgaaaaggcttgagtccctctgtggtcccaagtcacattttacaagtcacatttttcgtccatttgagtttattttttgtatggttggttcttgtgtgctcctaagcgtgaaaaaaaaacaaaagaaaaaaaattgcaggggggcgccagccacattggcgcgctctccctgccaccttagcgccgacccgccacggtggcaggagaatggcgccagcctctctggctccatcccgttggatgacggcgctagtgactcctgcgccccaaaaaggatcattttttggataagttttttcagggatctatttgcgaaataagttattcaaaaggatcaaattgtgaaaaatccagcagcccatcgctgttttcagtccgagggagcggagccgcgacgactagcggctccggcgagcctactcctccttcctccgatgagtcctctcctcctccctccggtaacaggttagctcttttctcca

SEQ ID NO: 58240 - DNA, 687 bp, Oryza sativa
aaaaatcggcaccttgttaacaacagaattttgcatcatactcggaggaggaacaaatcgaggcagatttggtgcggaatcgaactggattaggagataggctgtgcatcggctggacatcgtatcaactgaaaatagagatggaaacagacttaggctacgttcgttaggagtagttcccaactcctccttgtcgttttccgcccgcacgcttttcaaactgctaaacggtatgttttttaaaaaaagtttatatacgaaagttactttaaagaatcatattgatccattttttaaaaaaaaagataaaacttaattaatcacgtactaaacgctgcttcgttttacgtgccggagactgagggttcccaaccctcactcccgaacagagccttagccgatatgccagatagccaatacggattgatttaggctcgggttgggcctagattggaataactgatattgtcgtatagagattgagctaatttaaggtaattttatctattaattaggatatttataccggtttgaattagagatatggtaatagtcagccatgtggacttgttcaaattttatctttagcaaagttttgaatcacgtccataatggacaggttttgtactcggggtataaatataagccccaaatcattgtaataaagggattgattcaatcaataca

SEQ ID NO: 58241 - DNA, 704 bp, Oryza sativa
cgcgatggttgggttccggcggtccttgcggagacagcaggtcgtggaggtagcgccacttgtggtcctccatggcgcggagcgcggcggcgccgtggtagtaggggccgatggacaccaagcgcggctcgtaggaggtccggctgctctcgcgaagaaaggcggggacgcggaagatggtgaacgtctgattcgttctcgattggactcctcttagaacactcaaccttgcctccaccatatcttccaaccgcgccatgcttgcaactcactgggagaaatacaacagctttctcctaaaatataaagtcactggtacttagcttgatgttaatacttatttcgttagttgagatttatagcactaggtgatatctaattaaatactatgttgctagtacattttaggatggacaaaagtttgtttagtttcataatcagaaatgaagttaatctatctattaacttatcaaaggaatagaaaaagaaccctccacgttcgctctcatagcctagaaattctcacattaatcggagaaaaagaaaaaatagagtccatatagaaatacaatttaaaaatagtttaaattcggaattagaaaataagaaatattaaaaaagagactgaggccatataggaatacaatataaagctaattaaaattcagaataaaaaaaggaaaacatagtctatacatgaatac

SEQ ID NO: 58242 - DNA, 982 bp, Oryza sativa
atctgctcgagcaattctgattaagcccaattatcacccacaaccaaattaatgcgccagcgccactgcgcccgggaaccgggcctgatctgatgcagcgtcagcttgtgcgtcgcccttcagcaatagcgtcggctgcctcaagtcagccggggacgcagacacgcagtgccgcaggtcatcatcgtcgaggtcgtggtggggccaatggctagggaagtggatttgaaggaggaaacaagaggtagcgggaggcgacgatgaccttgggtttgtgcttagctccgcctagagcttccgagttgaaaggagacagcactgtggtggagtgcggctgtgctgcaggtgggaagttttcggccgagatgccacgcaggcggtgtcggcaaccttttcatgtatatttgttgactaaaaaaatacccgtgcattgcgacgggtgaagccattttaatcttattattattagacggtttagctaaggtgaagtttgctgtgggaattcgcttggatattttttttaacaaaatcatgagcttcaattagaagtgctatatatagtctcaagttagcatgcgagtttttttaagagatttcttatatgacttctttcgtatttcaaaaagcgaatgaacttaaaaaccaacccaaacacggatctatatttccaaaagcaagtaacttaaaagcatgttcaaatacggatgacgtactaaagtaccggcaaaaatatcttccatttttataatagtagagattcgacgaataaccgtgacaaatacaaatacagactataaattaggccttatatacatgtgtgccacattagaaaggctcgcaccacatataattgtatagcgtacgaaaggattgcacatatcatatacctacttacataatttgttactttccgttcgtcacatcaattttccatctgtaagtccgatcgaatgatggcatccgttctcacacgaacgagtaa

SEQ ID NO: 58243 - DNA, 655 bp, Oryza sativa
ttattctccacataacaccaataactcttactcccatgaagtggacagacccgttcaaacgaattaattttaaaatcacatccactagcatgcaagtggatcggtagttttctacatactatgaaggtgtaagattttatatatcatgaagatatacttatcaatggtatttggcaatcttattaattcccctaatgccaaaatatagaccggtttatgtcactctaagtggtttaagctaattgttgaagattagtgaaacaatcaaattggtaattattgataaatccactaagagaaagttgcataatatttaatctcttgtattgagctaattattttatacataccgcatatgtgtatcgttgcaacttattttcccatagtcctccgtaaggataaaactttgtttgtattgcacatttgaataagtggttatacatattgctcctatacgttgatttatttctcatgttcatagtagaacttatgaaataagtaaacgaaagattaaacattgtggtaattttattttcattattttacacattaataaaaatgtggttatgatattggaacatggaagtttcaacggatctcttcttgagggggagcatatatgctaaacattgattatcatacttaagacttggaa

SEQ ID NO: 58244 - DNA, 647 bp, Oryza sativa
tcaccgctgcaagtgcaaggcactatggtttcaagttgaattttcatggcctaacaagatgcatgaaacaaaatataaatacagtgaaatccaaaaccacaagcatagtgtctattcgtcaaataaaaataaacatgcaaacgtgttgatctgtctagttcgtcgattgaaatcgcaagacacatataaccaacgtctgacccctctttccaagcaacataagctgctacttgggcttttggaaaggcccaacaagttggaaaatcacatcggagcccaaagagatcacgtcacatacgccggtaacaacacggacgtcgcataagccgtggtcgtacaaagagtcggacggcggggttgtgtgtatagcattttcggcaggcgatgaatatgcaaataattaataccatcggccaccgtgttggacgaggccggtgtgaccttcgtcaagcagaatgtagcgcttgccaagttcagcgagtgttttaatcatgaccaagcggaccgcaccgccgtgtccgcggacgataccgcgcgccaccgagctcctcgagggggccgggggtcaccttcgttctgggcgaggcggcggcgccggagtacaggttcggcgtgacgttcgaccgccggagaggagtgatggagat

SEQ ID NO: 58245 - DNA, 747 bp, Oryza sativa
attacatttacagtttctactggcaaactatgtaagtgaagtgtaaaagagtagagaacttacaaaatttcttgggcgtttgtttcgattcgaagtcccctcatattgtgtggtgttttccacgatagattcttcataggttaggccactagcatcacaatgatctgtttcagtgtttgaatcacctgttttgtcaggtcagataaatataggcaagataaaacaaatgacatgggtgaagaacaaaatggggtccttcccaagttactccaaaatcaattgagtacacactacacacttatgatgtgatgagacgaggaaacaaaaataacagcttacagtactcactctttattccagggccgtttctgcattctatacaccggcattttgcagtgcatctcaccttgtgttgtaagacaaaaaaacagccatatcatcatatatacctaatgaagaggaatgaaaaataacagaatctagaaataagttatgtgggctgttgccataatgaatccctttttcccccttcgttccagaacaggtatcaccccttcaaaaatcaagaatcttgacttgtatgtcaagtacatttttttggatttcatgaattagaaaatatcattctatcagagttcgaatttctaaactaataaactgaattctttttttttccgtttctggtccttctggtttactagaagactaaaatgttatgtcttttttgtttgcaacaagaacatcagt

SEQ ID NO: 58246 - DNA, 12224 bp, Oryza sativa
cctgttactcgaacattggcacgactcgtccgcctcggtcgcacctgatgccgaaccgggttcgcttcctctgaagttgttggactgggtacagtggaagtagctgcaagtgtaacatccccccctccttgcgaaccggcttgcccccaagccggggcagcaggaaactgattgcgaagcgccgcagcatcctcccatgtagcttcagcagaagtttggccagaccagcacactttcacttgttcaattgtcgctgctccccgtctgaccgcgcggcgtaggtactggactgtcttgctccagagtaggtagcggtcggataggttccccagcagaaggttgagcggccttgcgtagttgcgatatatgcaccaccggatgaatggtacagtcctccggaagcttcaagcgatatgccacatcaccgattttgtccaacacctgaaaggggccaaaatagcgaaaagctaacttgtgattagtgcggacagccagcgaagtctgggcatagggctgcgccttcaagaacacccaatcaccaatgcagaacactctatcagagcgatgtttatcaacttgatctttcattcgttgctgggcatggaggagatgctgacacaacaaactcgtcaccatagcacgttccttgcgccattcttccaaatcagcaacagcgcaggtcactccgtccaacacaccaaaatgacgaggaggatgaccatataataccttaaatggggaagaacccaaggcggaatggtaggcggtattgtaccaaaattcaggaagcgccaaccagcgagaccaacggctgggacaagcatgtacgaagcagcgcaaaaaggtctccaaacattgatttacccgctccgtttgcccatcagtttgagggtggtaggtagaactcatctgaagttgtgtcggccagacaaaagagctcaattccacagtgcactcgtgaaaatacgatcacggtcagaaatgatagccagaggaagtccatgaagcttgtacacattgttcagatagagcaaggccacatcaaaggcagtgaatggatgtgccaaacccagaaaatgggcatatcgactgaatttatccacgacaatcaaattacagtcgaatcccgaagatttgagcagtccttcgatgaaatccaaagacactgtctcccaagcctgatctggcgtgggcaaaggttgaagaagccctgggtaacgcaccctttcagatttagcttgtttacaaacggcgcaatcggtcacaaaagtctgcactgcccgcttgagacctatccaggcaaacagccgtttcacttgactgtatgtgacctgaatgcccgagtgccccccaattgcactagcatgcaaggctgtcagaatgcgatgctataaagctggattagagcccacccagatacgccctttgtagcgaagtactccttgctgcaaagtgtaatggggataccgatctggagatagcagcacttgtgtcagcaattgctcggtagcagggtcagtcttgtatccttcctgcacctcatttaaccaaaggggtaccacaactgatagagcacaaatttgcataggatcagtctgcggacagcgagataactcatcggctgccttattgtccaagcccttcttgtattgtagcttatactgaagtcccaaaagtttggtcatggctttctgttgccatggagtggccagacgctgatcgcctagatgtattagactgcgctgatcagttctgataatgaactctccaaattgcaaataagaacgccaatgatcgacagccaacaaaatagccaagcattctttttcatatgtggacaaacctcaattcttgggacccaaagccttactcaaatatgctaagggataacctgcttgcataagaacagctcccactccacgatctgaagcatcagtctcaatttcaaaagttttggagaaatcgggcaatgccagaacaggagccgatgtcaatgcctttttcaaagtatcaaaggccagctggtgcttggctgtccagaggaacacagcatgtttcttaagcaagtcggtgagagggcgactgagaacaacaaagtggcgcacaaacttccggtagtaccctgccagtccaagaaaacctcgaacctccttcacattgcttggaatagcccactgctgaacagcctgaacattcttaggatctgtagagacgcccgccccactgacaacatgtcccaaataagtaagacttggctgggcaaacgtgcatttggagcatttgaccttcaattgatgtttctgtagaagctgaaaaaacttgtttaagcaatgacacatggtcctccagattactgctataaacaagaatatcatcaatgaagataagaactcctttgcatagcaaggggggtaaaatagtgttcatcaatccttggaaggtggctggggctccggtcaagtcataagacatcacacggaattcatagtggccattgtgagttttaaatgttgtcttatgctcgtcttcgggtctcatacggatttgatgatagcctgcccgcaaatccaagctagagaacagacttgagccagccaattcatcaagaagttcatcaataatgggcaaaggatagcgattcttgactgtaatagtgttaagatgtcggtaatcgatgcagaatcaccaagtaaggtccttcttcagcaccaataagacaggagacgaaaaggggctagaactgggctgaatgacaccctgttttcagcatctcggccacttgtttctcgatctcgtctttttgggcaggattgtatcggtaagggcgcaaattcaccggctgtgctcctggtgtcaaaggaatagcatgatcaaattcacgagctggaggcaaaccagaaggctcatcaaacacagaagcaaaatcctgcaatacttgagcaatgactgatggaacaaccggtcatagagtctcctgttcaataaggcagagttccactgtttgtaataccgagtgatggtgcaataaccccttcacctgagaggccgacattccagcacaatgagagacgtctgagcgaacaccccgaagacacaccctctgctgattatactgaaactgcaaggttttttccctccaatcgacttgcatagggccgtgagattccagccaatccattcccaagatggcgtcataagttccaagaggcagaatcttcaagttggaatgaaaagagattccctgaacccaccaaatgcagtcgaccaattcctgagtgcgttgcaaaagaccaccatcggccactcgtaccttgacagcaacaaacccttgatggcgtcctgacagttgggccgccatatcctcagagatgaaactatgagtactaccagaatccacgagcatgagtacctcatgttgctgcacccatccttgcaaccgcaatgttcccgttgtttccaaacccagcacagcttcccttgagatctgacaaagctcactgtcagcagattgcacaggttcagatgactcagcttcaggttcaatatccgagtccatgatgtgatcatccagcatctcccaaagctcttcaagcacatgcaattgcactgtcggcccacacttatgatcccgactccacttttctccacacgtatggcacagccccttcgctcggcggtaagcacgaagagctgccaatttttcatccactgccggcgtttgcagttcctccatctgccggcgatcatcaacacggggacccggccccgctcctggtcgcggatgaacaggaacactaggtttcgcaccaggacgcccattgctagagaaatccacctggcgtgcctccctccagttggtctccaacacctcctgtaaacaggccaaatcgacagcagtgtccaagtcaacaggacgatggagtaccacggcagatcgaatgtctgctcgcagcccatccaaaaattgagtaacaaaaaactctgaattccatgaagaatgatgagcatggagattatgcatgagttcactgaatttctctgcataggtgctaaccgaccctacttgacgcaaacgattaaactgacggaccaagctctgaaactcttcacgaccaaattttagacaaacagcttccgagaactcctcccaattctctaattcctcatgaaccttagaagactgtaaccaagtaattgcacttcctatgaactgcaaagctgtgactcctacacagaactcggcactaatctgtcagggttgcgggttgggtataccctctacccttcgacatacatcacagatggaaggagtcttactcggacagaactaggtcgtcattgtatcgtgccgggtccgatgtctacgagtcctacttggagaccagccgacttgcgatataaaagggatcccccgggaggacctaaggcatcgaatcttaccgccaacacatccaccacagcctacgaagtcggaccctacaggagccaagtcgtcgggtgatctagtcgaatcaactcgactacgatctcgtcggtatcgtcgagttccgctattccctttgtaatatgtggattagggctattacctatcaaggggcctaaacaagcataatatttgttttctgcctgcttgatgtcgtattacgtagatcgtcgtaccagcgtaccccaataccctctatatccagtctacgggtatcccccgtcgacagtggcgcgccaggtagggggacttggtgctcaagattctactactatgacatccagcttcgtcgacaacagcgtcaacaccaacctcaaccaaggagttcctacttcaacaatgctggtgtggactcaagtcggcaaaatcgtcttcccggtttacaccacggtgccgatcttagctggtccatcaatggccggaaacgagaacgcagtggctactacccagggcgattccatgttgaaggatcctcccgccgaagcggagatcggaacatcgacgacatccgagcctgagaaggatcctagtgcggccaagccttgtcgttccgacaagaatcacgagccgacgaggatgacttccgaggtgacaaggtcctgatgtcctatccacaaaaccagaaaacacaccttgcaagcctgctgggtttttctcaacgtccacgctgaaattagtgcctacaaagagcgtggaattcagcgtacttctccaactcatgatgtctattgtcctattcacaagacaaagaatcacgacctctcaagctgcaaggtcttcctccgcgccatgaagacgccacctcctaaggtccagcagtcacgcgtcgccttcagggatgaggacaaggaacaaggagcgacattgatttcagatcgatttgttggggtaatcgacatcgatccccacgaaccatcagtcttgcacctgctcgaagactatgactcatcgtcaacgagtacgccgcgcgaggtattggctatcgacgagaccggcacgtcagtgcgcgctaatgcggaagcggagaatcaagtgaccacaccggctcagcacatcagggccgtcaacgcaatactgagggaaaccccctacgatcccgttctgaacgacgatctcgcacgatggacagaacggttacgggaatcagtgaccaacctcagcaacgcgttcgaagaggccgctgctgcagcgcacccggaacagccaccaactggtgatgctaatggtgaaaaccctgaacagtgggaatcgcctcatcgagccaccccttcacctcgcggcaccggcgatctccgcgatcacctgaatgaccgccaagaggcgcgacgcacacgagacaacgagaatcgttcccgacatcgcgtctcttcacggggtcacgataacgaagaacgaggaggccgttcgagtgaagaccgagaccgtgataaccgccacaaccgccacgatcacgacgatcgcgaacgacgggtgctgggcgatactggtcgaggacgtcaccctaatgacgacaatgatggagatcggcgccgagacaacaacgggagacgacgacaggattctcgagaacccggccgacgtcctcgtaatcgtacgccggaaccaagcgacacatcgtcatcgtcgtcatcctcctcatcctcatcatcagataggcatccacgaaggacgtacgatcgccgacaacccactgcccccagcgctgggtgtagagctttcggtcgttcacttcgggatgtccgatggcctgaaagattccgaccagcagcaatagagaaatacgatgggagtaccgacccagaaaaattccttcaggtttactccacggtactctacgctgccggagcagacgacaacgcattggcaaattacttgccaaccgcattgaaaggctctgcgcgttcatagctgatgcatcttccccctactcgatttcttcgtgggcggacctgtggcaacagttcgtcgccaacttccaagaaacttacaagcgccacgcaatcaaagacgacctacatgcgttaacacagaacccggttgaatccttgagggattatgttcggcgctttaatgagtgcaggaatacaatccccgagatcaccgacgcttctgtaatccgcgccttcaagtccggtgtcagagatcgctatactacccaggagctggcaacgaggcgtatcacgactactcagagattattcgaaattgtcgatccatgcgctcacgcggacgatgcactgagacgcaagaacaacaaaccgaagaccggaggggagaagaaaccagtcaaggacgcacctgagtcaagcaagaagaaaaatggcaagagtgggaaaaggaaagctcaagcggatgttctcgcaacagaatacgcggaccctcccaagcgcccagacccacaaggcagcgacacgaagaaaatatggtgccctatacacaagtcagacagacactctctagaagattgcctcgtcttcaaaaaatcactcgcaaaacacatggcattggaaaaaggcaagcgagtacgtgtggtcgagaaggacgctgaggcggttacttaggaatcggactcagcatacccagactccgatctccatgtctcgcacatcttcgttggttccacggcatactactcaaaacgagaatacaagaaggtggaacgtgaagtctgttcgacgtggcagggggctgcgcccaagatgaagtggtctgagcagaagatagaattctcagaagaggaccaccccaagactgttgtcatcctagagcaatatccaatcatggtcgaactgtcacgaccggaaataacccaacgggcattccttacgtgcgtgcattattccttgtcccaggaggcaaggtacaccaaaagttgatacaattcagagtttaacaagcggaagcgtaaatagttaatttattacatgggcggcgaaggcccagcacacacaaagacaaacgggaaacagcggaagactagggcgacaaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattacaagacacttagttgctcaaagctattttgtaaacacaattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaataattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtgcatctccatccgtgtacttttgtttataaccagactgagccacaaactaagccttacccactagacatgtggaagtacggtagtgctttgcaacagaggcccgaagaccggtccttatatggccgaggtgctactaacaaaaccatgcatcccgagcccagcctaaaaccattttgaggattttgaatagagggggaggtgtgaatccaattccacaataatcaaaccattccatagtgtccaggtgatatgaatatcccaaagtctagagttgtaaaaccacctaatgttgcctaatcaaccagcgaagcatctacctaaaatcatactagtggtaccatgagtagagtgtccactagttgaggttttgtttattctatggtgaacaaggaaataataacaataacaataataaggtcataacaaaggtaaatagacatggctagataaaatagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgacttcaaatggccaagttatggtcatttgaagtttatatgctctttaaacgaatatttgcgaatttcttcatttaaattttaattttaaaagggtttattgcgtcagccgacgggagggggctcgcggaccgggtccacaggagtggggcccacgcggcagcctcacagtccacggtggaccgggtgcacccgggctcacaccagccggcgccgtgggtcccacgcgtcagccgcacccaagggcgcgggcggctgactgccgggccccacgcggcagcctcacggtccacggtagaccgggtgcacccgggctcacaccggccggcgccgtgggtcccacgcgtcagccgcacccaagggcgcgggcggctgactgccgggccccacgcggcagccactcggcgcgcccgagggcggccaagccggcgtagccggcgggaggcggcgcccgcgcccctatggtcgccggcggcggccataggcacggcggagcggcggccgagagaggggaagggaagggggaaaagaagcggcggtccacggctcaccctaggtcgacggcgacgacgaaaaaggtggccggagcggaggaaggcggcggtgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggccgaccggagctcggcggcgacggcggagagagagagcgacggcgcgagctcgattccggcgaggaggaagggcggcgagaggcggaaacggacggaggaggtgcggggagggtttaaatagagccgggtcgagagagggtggccggggaagggaggaaaccggcgcgagaggtccggctgccatcaatggcgccggcgagatttgcgggggcaaatccgtccgtttgaacgcgagagagagagggaaaaaatggggggaaagggagagggaatcacggggaataattcccccctattgatagcacgcggggacgatgggatgcggtggattcgcaggcggcgccgcgcctacggcgcaggcgaggcgccggcaccggcggggcgaacggcacgacgggtcggccccacccgtcagcgaggatggcgggtgggcccgcccgtcagcggcgcgcgcgcggggagaggccggatgggccgcggggagaggagagggagggggaggaagatgggccgagccggcccaagagggagagggagggaaaggggactttttagagtttttctttttataaactcattttaattttgtttatttcttaataattattatttgtgctctgaagattccactgaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgcgacacgaacccactattcggaatatcaaggtcgcacgagttctgatcgacagcggtagctcaatcaaccttctcttcgccagcaccttggacggtatggggatcccacaaagcgagttgacacccaccgatcaacccttcgatggaatcactcctcagtcatcgttcaaaccattgggcaaaattacgttgcctgtgactttcggccaagcaaataacttccgaacggagaagatcacctttgatgtcgctgaattcgatacagcatacaatgccatcattgggtgaactgcactcgcgaagttcatgaccgcatctcactacgcgtatcaagtgctcaagatgccgggaccgaagggaacaatcactattcaagggaatgctaagctggcagtgcaatgcgacaaacggagccttgacatggtcgagcacacgcccagcccacccgacacagctgagccacccaagaaagtgagcagaacaaacaaaacgccgaaaccggatggcgcaattaagatcgtccactctccagtgccaaccccgacaagaccgtcaagatcggggcatcactaggcgagaaataggaactcgcgctcatcaccttcctccgcgacaatgctgacgtgttcgcttggcagccatccaacatgccgggggtacccagggaggtgattgagcacaaactcttgatgcgacccgatgccaagccagtaaagcaaaaactgcggagatttgcaccagatcgaaaacaagccatacaagaagaactggtttcatcagagaggtactccatccagagtggctagccaacccagtcatggtgtggaaggccaacgggaaatggagaatgtgtgtcgatttcaccgatctcaacaaggcgtcccaaggatcacttccctcttcctcaaatagaccaactggtggactcaacagccggttgtgagttgttgagctttctcgatgcttactccggctaccaccaaatcagcatggcgaaagaggacgaggagaagacagcattcatcacgccgttcggggtattctgctacgttaagatgccgttcggacaaataaccgcaggaaacactttccagcgcacggtccaaggtgcacttagcgaccaactcgaaaacaatgtcgaggcctatgtcgatgacattgttgtcaagaccaagacaagcgactcattcattgacgatctgcgggaaacgttcgacaacctccgacgatatcgcctcatgctcaatccagagaagtacacgttcggagtaccatcgggcaagctgctcggtttcctcgtctctggcagaggaatagaagcaaatcccgagaagatcaaggcaatcgagaacatgaagtcacctacaagactcaaggaagtacagaagttaaccggatgcatggcgacacttagcaggttcattgctaggatgggagatagaggacaacctttcttcgttctgctaaagaagcaagacaaatttgtatggacacaggaagccgaagaggcattcattgtactcaagcgctacctatcaaatccccctgtacttgttaccccccaacctaatgaagaattatttctctatattgccgccacgccatatttcgttagcactgtcattgttgtcgagagagagaaggtgcaacgaccagtctactacgtcagtgaagctctccacgacgcaaag

SEQ ID NO: 58247 - DNA, 6916 bp, Oryza sativa
agacatcaaatttgaaacagtggtgtcattgtttgaagcattatcaagggttattgtcatgaccttatcctctattttcaattcaaccaagcaatcaaaaatagcctgagctatgacaatagcggtgtgaggaggctccacctcaacaaagtttaggacacggcatagcaaaacccaatgaacatctatgtaatgagccaccaaacacatatactgaaggttttgatttaatgtccacatatatctgtagttaaacttatggtctcagcctccctaagacttttcctgagatgttccttttcagattcatacaatttcatgcattcatttttatggccttgcgactagtgaattcatagcgaggattcatccacttcatcaaggcattaaaccctttatgctcaacaattctaaatgggtaatcatgttgaattatcataagggcaatcaaaagtttagtgtgatcatgatcatactcagtaggatgcaaaaccatagaaccatcagctaaaggaaaataaagtgtaccttgagctttagcctttgcaagcttgttcagatatatcgtgcacttatctaagtgacgattcagtgttgtagtggttcccccaaggtgatatgcctagctgtgatgacaaaacctacactttgccttacattccattttccctttctccttcttggagggaacattgatcaccttaaaatatttccaacaactagcacgctttcctcttgttatcttaactttggaaggagacagtgaaatacctacctttggcctttttgcaccttgtttttgagcctttgaagtgtcatgtccatcctctcccttattgccgcttcttgaagaaggtaggctcacggacatcacatcattcaagtcaaaggtgttttcttcatcctcccctccatctgaaaaggccaccatgtccatttcctgcacaaattcaattcatacacacacaaactgattactatcttctagttgccttggtagtaggtatagtgattcattcaaagctaaatgcaaaattcacagtggtacatattcaaagctaaataattttagatcgacttcacaatttcacatgactacatgtctatatcagtacatttgtactgcacaaatacatattcaagataattgaataaaccaaaaaggaaagtgattgtggaatttagatacattccacggtcgtggagacattagctcgtgatgctgatgctggtgacggcgatccaattgccccacttgcgattgcggtccttgccgatcctcgactacagccaacgttggtttcagcaatccgtgcggagcgtgtacgtgccgctgcaccttcacctgtagctgccgacgagattggcctcgcgcttgcgcatttgctctgggattccacgcttggtggttgaggcgcctcctccatggtagtaagaagcggcgtggatggcgagatggcgggtggcggcggcgtggagagtggcggcggtggcggcagaaagtggcggcctgactgcctgagttcctggcagtggcagcgctcacgcggtggcagcttggcgtggtgggtggtggcgccaacggcgatgggggttggcgcaggcggcttggcgcggtgcgcggtggcgctcacgcggcggcagcactgatggcgatgggcgagtgaagagctgtgactacgagcctgcgcggccatcacccgccccgtcagagacctgccgtcgacttgccgtcgccgtgcaagctagaacgccgccgcttgtctgcttcttgctgcgcctgctcgccgccgccgcgtggctgttgctcgtcatcgccgcgtggctgctgctcactgcgcatgccagaacccccccaccttgctgccgccgcacgggcgccgcctggctgccgccttaccggagtgccatcgcacgctcgccaccgcctcgcgcacgcctgcacctccgccgccgcctctaggtctagggtggtctggatgttcataggcacaaccacacttggtggggaggagagggattccacccatatccattcgcttagggtagaatggtaaaattgatatttcataaatctttttttaatttccatttgtatttttttaacacacaaacgtgggacccatcaaacaggcgttacaagtaggggcaaacggctggttcgtttttaaaaagttggggtaaaatttcaaaccctaaaaaatgggggtaaaatagaagttgggattagaagtgggggcatagagcaatggtccctatttaattatacaaataaatatgtaagtatatccaatcatcacccctcacattatttgcacaatattttaacaaatctatctatcatttttataatatttaacatataattattaataagttttacattaaagtgcgggtatcatttgtttgtttcataataagtgttgataaatcttgatgttttattatttttttctttttactcctagcttgattgtcgaaaaaaatatattgagaatcatttagtaattcctgcagcaaagcgttggaaatcaccatacaataaccggttagcatgcagagccggtcatccaactaaataaatttagaaaatagtttgttggtttattaaattgtttgattagcgcaattaatcaagccacgtaatcgggaaatggctttcccaacttcatgattagcgggctacatgcaaaacagaatttcaaacttagtgggaaaggaatatggtgaccgatttattttttcgtctcatccgctatagaacaattcagttattttattgcgaaactcataacatgcaaaacttatgcgttggtactacactttcggtagtaacatacactttcggcagtaacataccgaggaaaatatagtaacgcataacatgcattagtaacggtattgccacagtacttgtgcatagtaaaaattttaaatctcaatcttgtgcaaagtacaagtgctaaaaagtgcatgtgcaggcttttcaaactgctaaacggtgtgttttgtgagaaaactttctatatgtaagttgctctaaaatatcagataaatatatttctcaactttgtaataattaaaacacaattaaatatatgttaataccaccttgtactgcataaaaaacttaatcatcatcttcatctacatgagtttcaaacaccacctaactactagcgatattttttaatcttttacaaaaaatatctctcacaccatatattaaatttgatggtggaaattttagaattctaatcttttaaacgataatatctctcacaccatcaaaatttgaattagttttcgtttttttaattttccgaaaaaattcctttctatactttccatttctgaaaatatatctagaatccgaaaacttttcagaccgttttcatcccatcagtgtgatgtaatcacatattgtatgttttgtatgacctaggagtcgaaatgctccttgttcgtatgattaactagtggaaaaagttcaaaaaggctatcgcatgagcgatcagttctgttttctaccatttttggcctgtggtccgattcctctcttttccttttaggccgtgttggtttccttctgaaattcctatctggcttgttatgtgtttcgtttcttgattgggcttggcattcatttttctggagtgagctgaatctatgtggtatactattgttaacgaccaaatttggtaagccatgaactaggttcaacatcggaatcaaagcggatttggcagggaatcatcttccaaaaacatagtgcgcatcggctacgagggcatcggctgagatggatcggatagaagatagccgatgtagccgatttcattgatatggttgtataatcgtctccgggattgatcaacgtgctacacaaggattgccacgatggagataagctcacgaataggcaattgtatctattattaattaggatattttaaatagtttctttagagatatgtttcggtaagagtctgctgtaaagacttgttcatatcttagagtttgttagagataagagtcgtgtccggcaaggacctgtcatgtatctcgggtataaatatatataacccgatcccatataatttacaacaacagttcaataacactttcggcgcatcgccaccctttttctactttcattgtttcgacgagttcttgcttttgggttgagctgcatcgatttcgatcttcaacaagaggtaaaacttgtcatgacggcttgcgctctcgggattagcgcttctatctttatgacactctaatcttatttatgtaaatcgtcgagttatcatatatgcttcataatctttattagtattataatctaaccctaaatcggccaacatctatcattgaaaggcagccgatagagttagatatagttgttaatctagattatatagcatatccaccatcttttagaggttttcatcaatttgtcaagatcttgtatttattcttatgcttaatgctgcattggttgagttcgatctattaagtaatattcataactgcaatatctagcttgttctatgatcaccaatagagatagcatcggagtttcagccgatcttacctgatttagctactttattctttacatgtccttgttatatgctagatccgcccttcatattaagatcttgttgcattaaagtatattaagcttactgtttaatatattttgtctgttctaatatcttaatatagagtggtatcggagtattagccgatacatgttagatctatttgatcggctatgctatgaatgtatacataatcttcatcttaaagttcttttaagcataagtgatttatactatctcgacttactgttcgatctatcccaatcacttagcttaaatatatttcgggaaaaggattatatatcattaatatctatagctgatcgagtagatttaactttatattgctttattcttcattgccgatctaatgccaataacatcggtttaataattaatgatatgtcatcggcccttagccgatcggctatcgtttatggatttaacctcgttttccttgttttatcttcatgttgattgcaggatgaaatcaactggcacgcctttgaacccaagagcaagatttaggacttgcgctggagttaagtatatctcccaggccagtgtgtattttttcatccacaactatccatgtgcatcgcctagaatcgggtggaaggcggtgttgtggatgatggaatatggatatcggacggagagggtaccgctaaacgattaatcggagtgcggacgattaatcagaatttgacgaaaatttaaagttttggacaaatatatgtacgtaactcataatagcttgttattttttacagataaatgcatataactacatatacacctactattcttaaataaaaataaggataacataacattagctcgatatattgtaaaatataggtctgaacactcatagttgtgcatcaaatagtgatatgtttggttcgtaatgcataaaggaaatatcgaaagcaggaaacactatctaagtgacactaaaacaaggtcctattcgagattcaaacagaagattaaaatgaggacaacaaaatatgggagatggatttgaaagaggattagatgaaaataactaaccctagactcgcaggttgcagcggcaggaatgagcttctaaggttttgggattgcaaacgtcgttttgctacctacttatatggtgctaggttacacaactagtgggatagtatgttatcgtgggctggctgggtagggccttgtcacgtgattaggcccggttattcggccgattagttggtagtgatggtgattgtacgttccgaaacgactaatgtgcaccattttgctaaaacgtgacggagagaggtcggcgccaccgttttaatgtcgatatatatggccgtatcaacctttatccacgacactgcaaaatactactagttattaatggaaggagagagcatgcatataaattatagaggcaaataatgaaaaggacgaaactgttatgaaactattatcttctgccagagataaatatgggctcataccaaatatatggaaacgtatcctaataggactcttcctattatgggtatatataccgagaaagaggtagagagatctgaatgtatccacatatgagaaagtaataaagctgtgatgcctctccctatatccgtgttcattgtttatctattatgtgcttgtatgagagatcgtcgtcgtctactccagatcagcaaataggccactagttattcaacacgttatcagcacgagttcgctcgtcccgctgatccgccgggtaagctttttactagatcaatttgttttcgtactaatcagattgatctactgtgtttatgcattggtctgttgtcagtcgagacgatcgcctccaagcgcagccacgcaccgaggcagcccgtcaggtgacgcgcgtgcaggtcgcacttccacgcgagcagcagccctgctggtcgtccgtactggagcgggagcccgcaaggcgccgacacatgcgcatgcacaagcagtgcagattgaaaccagctgatgaaccaagaaatttcttcgtgcaagcatccgtgtgtgatccaatctacgtccacgcaaggatcgatcaacatgtatgatgcatgtaccaatcgatattcaccaacacccatcggattcttcaacaatcggacatcatcacgctgatacgctatgcgttggcatccgcggatcggcgaactttacatcggataaatgagatgagtgtcggtttcatcaattctaatactttgcaatagcgagagtaatatgctagatcatgcctctagttgttttattttctcgcatgaatagatgtatttgtccggcctttg

SEQ ID NO: 58248 - DNA, 35791 bp, Oryza sativa
  unsure (1)..(35791): unsure at all n locations
cctatatgtatatatatatatatatatatgtgtatatatatgtgtatgtgtatatatgtatgtatgtatatgtatatatatgtatatatatatatatatatatatatgtatatatatatatgtatatgtgtatatatatgtatatgtatatatgtatatatatatatgtatatatatatatatatgtgtatatatatgtgtatgtgtatatatatatgtgtgtgtatatatatatatatgtgtgtgtgtatatatatatatatatgtgtgtatatatatatatatatgtgtgtgtgtgtgtgtgtgtatatatatatatatatatatatatatatatatatatatatatatatatatgtagcattcatgtaagatagcactcttaaaaccatcttctacgagacaaaatcagagtccaatatgcttaaaatcaatatagctagtttgatgacaggatcaaatggcttcatggtctttcaaaagattgtcacctcagctcccaattcatagataagtacactggtactgcctcttggtaccttttaagggtgcatggaaatgtaaaaactataataaaaaattgcaattgtacacagttgttgataacgtcaaactgtgtatagagagagtggtcatattttgacttcactttttttttagcgaaactaatttaaacatcgatcgaccttcgaccatgcataatacgagtcatgtgcaactagcttacatatagtgttatatatatcagctgatttctgagtattgacttgagatattataatagtttatttttacaaaaaaaaatcactaacatgttccagagtatagatctttgtacgtggtatatataatttgtttttttaaaaagaaacacataaaggaagttaattaatgaatatgggcagtagcgtacatatatgtcctacatatatagctggaaattgttggagtcaacacatgcatgatatatatagcaattggatagttttttgagcggtacaaataaaatcatacgtatgtaggagtagaaggctttaatatatgtaacgttctgattcttccaacaaaacgcataagcatcattttttggtttattcctactatatgctatggatactgtataggtatatgcatgtcagctaccgttttgcaacgaatgaggaggtagatatataggtctgacaggagcatagaggcaaaccaggcaaaacctagcatgacaatgtacatggtaccgagattattgttttcttttaaccatgacgaaaattattgttcattattaaactgccattaccccattaatttttttgggactgaactattagtcaatcgtgcagctaggatcaagcatcttaatggttggtggttctccaagttggcaatatttctttcatggatgacagatgataaatctctacgtatctcggttacaatcatgttattcacgcagcatgcgtggatatattttttttcaaaaaaaaaagaacagtcagcttaataagtttcgtagacaaaatagtatgcaatagctgggtagtagtcagtactactatatatattgaactatctactatcaagatgactgctaggcttaatatacttggtatatatataatttaattgtcgcatccctccatttcaatatacatgtacgtgctgaattttaattacaagttgacacatgcatgaacttttcaacactagggcacgtgctcatcattctagttaatcctttaatttcttaggcatagtaatttgtttaaacatccatccttcaattagcaggatttttaaattaataaactgctggttcctgtataggaagaatagtttataataaattgtcctatactcgaatttttttagcccaaattagatattttcttaatgcacccatgctggaatattcgtttaattcagatgcacattacaatgctaaatttcagatttgatttgatttatcatatatttatgccttgaatttaattcatggacattacaatgcgttgaattctcgtggtagtagtagtagtagtagtagtttgggaattgcaattttcgtttaattgtatgtctttgtttcagtttttttcttacaaaatagtgtatatggcatggactggattgttaaacattgttattatttatagatttttaataatatattgttgtgacatgtaactgaattcatacacaataattccaaacagtactttacattcacttttacaggacatcagttatactttcattacagtacatatatccttgttaagaaactcgaataaccaaatttgctatttaaagaacgtgtcggttttgtgaatatgagattcaaattgcgatttgaaatatcgattcatgtttagtgattaataaggccaatagtataaataataatataaaggagggatacataatcatccaccactattagaactctaatagttcactaattaagcgtggaagggtgcacatacgggactcttatacaggtctagggacggcttattgaggataataacaaattatgatttgggaatatgtatgaaaaaaaatatgataccttcaaaattcttatgacaatcctctaattcaaagcgggccttgatggtattgtaatgtgcatactatgcctcggctataatgggatgatttgctactttcagccgcattaaagtttgcaatttttcagtcaccaagaattacacattgtagtgctatataattttgtcactgtacatacgtatatggttttagtctatttttaatctcagtttgcatgtttttacatgtaatttttgtaagttattgtggattgtaaatagtaatttccgttcaaacttttatctaagaaatatggaactttcctccaatatgattgttgtattagatttagctcgttttccaacaatgagagtgttctgcaacagttgacaaaatcttaattaggagaaaattccttccatacctctgaaattttagtcgatcccttctgtacccttgaattttcttcactccctggtatacctttaaattttgatttggatcccttacatactcttatcgtcagttgaccgtttaatatgtgtagaaaagtcaattttacccttcaatatgtgaggaatatgtagaaatatgtggactaaattgttggaagtatagaaatttgttgtgtgactataatattcataagtttgttgtacaaaaaatttaatatattaaaatagtatgtgcagcatttttttaaatgataaacatagttttggaaaacattcctatataatatatacaacagaaaaagatatgttgaactaccataaaaaaatgctacatatactcttttaataagtaaataaatattaatttttatgtcatcatgaaaaaaaactttgccgtgaataatacattgtccaataaaatcatgaatataatagtcttacataacaaaattatacacttccaacaatatagctagtttataatttccatgtttccttcatgtctaagggcaaaatggtccttttcttatgaattaaacattcaactaaccgtcaattaacggaataggtatgaaaggaatcaaatccaacagtagacaaaacttgggggcataaaaaggattggttaaacttttaggggcatagaaggatttttatccttagtccttagatggtgggaaatagaactaatgtaatctaattttattattcaatccaatctaagattgaccatttgcaatccaattggaatacacatgtaaatattcatcgatataaatatagatatgtttattttttgttgtatacatatgctagtagttgttataatcatatggaactaaataatcgaaaagtttcaattgaaaaagcattcaaataaccaccgcagcaggtgacttgctaaaagtgctagccacctatggaaattttggttatcctagatggccggtctaacatggccatgtgcaataaaagtttttttttttgcagatggctcggttaggtacaccgcttggaaaaactattttcctagacgaccgtcctaactaactagcctgtttgtgaaaatcacttatagtaggcggccgagttagactagtcggctatacgaacatcacccccctcccccggtttacagtcaggttgagtgaaaacaacccattttcggacacttgaggacgagccgtgtccagctgcctgagaaaactgatttttgtcaccagtgaaaattgattttgtgataataaacgtgtgctcgtttcttctccacatatgctagcttataggctgctattatatactctctctccatccacaaaagttacacatatttcacatttgagtttttccaaataagttgttcatatttatagtctttatgcattcaagacttaaatgaagagataaattaaatgttttattagaacctaaaaagtcatctaaatactcattggttgcatacttgcattcactccttgattttgtaacattcaaagtgatttaatttctccttggtcttgatgtcaaaagtaatatgcgtaacttttgtgtatggagggagtacttgctttactactcctagctagctagggagtaacagttttagttgcctacaattcaatacaatacaacttcgtctggcgccctcaatcgatctcgctctataaatagcggaccatcctttcttccctacaccacacaccaacacacacaaaccattgcaactgcactacactgcagcacacacaccccgcacccaccaagctaagtaattaatcatcaatggcttccgccgtggtgaagatggccgtcgtctgcctgctcctcctgtccgccggtcatctgatggcctccgccgccgccgcgcgcccggacaccgtcgacgacgcggcggcgctgctgcgcctcaaggaccgcatcgagctgcaggaggaggaggccctggccctcgccgaggagctcgccctcctcgacgacggcgccggcgacgccgtcggagccggctgctcctgcagcaccaccaagtgcaagacgtgcatcgccacctgcgggatcaagtgcttccccaagggaatcaaaggcttccccacctgcttcttcgcctgcgtcttcaccaccagcaagtgcttcgccttcggcgcctaatcgatcaatcgatcacgtcgtcgtctcggctcgtcatcaatcgcgatcgatcggtcgttttcacctaataataatataatcatatgtgtgtgtgcaaagaataacgaattaacctccccaagcttcatgtatgcatacatgcatcgttagtgcatgtgtccctgatcatgggtctctgggggaggatcatgttgtgtcgtgtgtcggctgtgtctcggttatcgtcttatcgatttcgatcatatcggccaattgttgtcgcgctggccacgtatatgtacttgatcgatgaccgagaaactcctaggtcaatctgtgtgttcatatatacatcagtccaataaatcgatcgttaattatattacaaagttttcgcattttaccgatacatgttattatatgtactccctcactgctaaatagcttttgcggtaggcacataatggattttcacagatggacatgtatatgaaccccttattataaccgatcgataacttttatataggaggctgcgcaactacatacataatactttctctgtttcatattataatactttctctgtttcatattataaatcgtttgacttttttcctagttaaactttgctaagtttgattaagtttatagaataatttagtaacatttaaaatatcaaattagtttcattgaatctaacattaaatatattttgataatattttcattttatgttgaaaatacttttttcctataaactttgtcgagtttgaagaagtttaaatagaaaaaagtcaaacgacttataatatgaaacggaggaagtagttgttttgtaggcggcaagttacaccatgcatccacctgtaaaaataatttttggtgctaaagaaaaacctaggtcaaccgctaaattcctcatccaaccctgaaacctggccttgaaaatcatgcatgcaaaactgaccaaaccaaaatagaataaccagctcaatttcacacagattgcaagaaacaaactgtccaacgacatcatctcaatttcatagtaaaaaaccaatcaaatgagctcacctgccaatctgccatagctggttgacgacgagcttgccacagtaattgtcaccgctgccaagtagaatccctcaccgtggttgtcgtccccattgccgagacaacgtgcgccctcgccacggccatcgttgcaatgatttggtggttttgaggcctagctagttgtagctaccgctgagatgaagaccttggcagatccaccacttctaccggcgcatccctaatctgcctatgcagtggcggatctaggccagctagggctcaagccctaggcctgggatccaaagtccatacaaatttcatatatatattttttaaaaaaaatgattgaatttatagaggagaggataggatagcctaggcgtggcttcaagctatttccgccattgtctgcatgggccctctggctataaaaatattttttttctatagtgcctctcacccaacaacaaaatttctttcattatatatcatcaacaactataaaatttgcatcatatgaaaaaacattcaaatacgaacaatgcctcaagtaaccatgttaaattttagttatggcacaatttattttattaggcagtcgtttagttgatggtataattgcacttaatcttgttgcaagctacacttgtgttctatatatgttgtactgtggtcaatcaaacatccccatatacttatttgtttaatgattgctcaaatgttataaatattgataaatgataactatggatatcttatattttggaatagaaggtttacatgccatgttgatgcctagatgagctggtgctcgtactaatctatatgttatctatgtttgtactcaaacgagagtagttatgtccattcagttcttaattaactaatttcttatgcgtgtgattagctagagattgaaccttagctagctcgttcaatctctttgtttatattgccaatgttacacaacatgattattaatcgtcccttttctcaggcccaaataccttacacatgttggcctggcccatgcgagggagctccgcattgaacatttatttacaacagtaaattttactttaggttaccttttattatcactactgacatgcaatctttgccgacggtaaatatcaccgttggtaatcctacaaaactattggaaatgctatgaccgatagtttatggtgggggatcatcggtcgggattgagtgtgtcggggatttgtcaactcgccaacggtgattctatataccgttggcaattacttttccaacggaatattccaaccgtaaacccgtccagatttcatggatttccattaggtcctccgtaacagataccatgattccctacaggatacttcctccgtttcataatgcaagtcattctaacatttctcacgttcatattgatgttaatgaatctagacatatatatctatctagattcattaacatcaatataaatgtgggaaatgctagaatgacttacattgtgaaacggaggaagtaatatattattattattattattattattattattattattattattattattattattattattattattattattattattattattttgttttataccaccctttaacaaattttccactctcaacaagataaatttatcattgttgcattttagaccaccctcaactattttattcatatgcatcaatttgttatatatcaaagcaatagactcaatataattgtgggaattcattgatgagtagaagttggtgtactcaaaatcattcatatgcttgagaagagagtcaggtagtccaaagtgggacaaaggtaagattatccaattcaaaaacattgattaaatggtgatccattggtgataaaaagtggttcaatgtgaaatttactcttgcatatatagccattgcaagacaaaatggatctggaacgaggaaatgaatgttcagtgcacaattaccatctcctgttgtaaggacatggtcaaagataaatgtaggttattgaactcttagataattcccatatatttagggaatattcggtcattccttacaacagtaaagacaaagggtttagccatttaacccaaaatattcgcagtgactaacaacaacataaaattgctcgtaccttgtgaatgccatctcttcaaggaaagataacttcttcaaggtaagagggccctcttcattattatgtcaaacacatcggtaattggtatttcacatgtttggtttatgggataaacgcgcatcttaatgatattgtaatgtgcatactatacatagactatagtatatatatgggatgattttgctactttcaggcgcaagaaaatttcccagtcaccaagaattgcacatggtagtgctatgcaattttgtcgttgtatatggttttagtctatttttaatctaagtttgcatatttttacatgtaatactggtaagttatcgtggattgtaaaattatttcttgtttagataagagtaatttattgttcaaacttttatataagaaattaaggacttcgatttcaattagtaatggtaagagtgatcaccattggattgcaatctaagggataaggggctgtccaggcgctactgactatgatacatggaaagcaacacgaatttcctttcttttgctacttcatccgtccgtaatatgttcatttttagctcattccatttatcataaaataattatttttagagtaattaatcattgcatcagagtttataaaagtagaaaattattgtattgggagtagatagattgagaaatagttgtattgagatttgataaagtaggggtgttctagaattattggttttgtactggtacgtgtgagatgagtaaaaaatgagcttacttgggatggagatagtaaatttaaaaatcaaaccagtgtacatcattcgttccaaacagaatgcaattctaacatttaaattcagtaaaaaaaattatagcacttctgtcatttaatttttccttgttttaagcccaactactttcccacttccaaccactcccttgtttaacaaggggcatccaagtaatttcttctccctactagtttgtcttttgaatgactacagttgcaatttttttatgaagtatgcttcaatatattgaagtatgtgtagtattaaaattacagcatatttaatcttcttatctcttaacccctttagttcctacatatattattctggaatcaagatccggtgcagttgttatagcgactgcaagttaggcagtcacatcccttcacaaccatcggatcaagctgataaaggacagatagctgtgccacgtcataaccaatctgccaacgctacagtacatgctacagggcgctacaggactatatacgcgtgctatagtgttctggccgaatctgagctgtttttctttgatctgacggtcacgcaaggactgctaaagttgcagtccacattacaactgcaggtgatctcgatccattattaagacatgactgccaggttatgcaatttcgttttgcgtatttacggcgggggctagcttggacgaaattgttattaaatttgaaaagatcttgactgggtttgaccaaattctggttgaattaaaaaagttaaaaatttcggacaaaatagttctatgccgggcccgaaatatatatgagtgcacgttcattaagttgtaaattggctctctctccaacgtacatacggaatatatgatacaacttacaggtgcgaagctaaaacaaaatagagagcagtaccacttgcttgctttactctagtttaacgaaatagagagcgataccacttgcttgctttactctagtttagatcaagtttagactgatatgaatgtatgagtttagattgaggagtacatatataatgaaaaaaaaaattcttgaccggatttctgacaccccctctcctacctagctagctccgtccctgtcgacttagagcaagtctaatagtatagccaactactagctccaattcatctatagccaatctagtagctcattcatacaatagttacatactacactattaatacctggtcccacctgtcatacacataatgtgtcttcgagtccgtgctatagctggctacaaatatgtagcccgttgctcttctctcacctcatttatctctttaaaatatgtttacagctggcttatagcctgctattgtacctgctcttaatatttcggccctcaatgtctatgcagtgtcatgtgtgcactctataaatatagcgaaccctacttcctcgtaagccaactagccaagccaatcggtccccacgcttacaagctacaacttcacctcacccctgctgcattctcgcgtcccaagttacaatccatcaatggcggcttccacttccgccgcggttaagatggccgccgccgtcctctgcctgatggtcgccctctccgtcgccgccgggcagctcacgacgacggccgccgccgccacctccacgcgcgtggatgatcacgtcgtcgaggacgacgacgacgcgacgccgacgacgctgcagcagctggagacgcgcctcgccgacgatcaggacctcgccgacctcctcgacggcggcgacggcgccgccaccatctgccccagcaactgccagaagtgcctggtcaagtgcgcgggcacctgcgtcgccgacatcgtcagcccgcccaccttcgtcgcctgcttcctcaagtgcgccgtcgtcaagctctgcttcgccaaggtttgatcatcatcgcgtcggcggccggccggcgatggtcgacggcggcgccggtgccgcttgattgcttgccttgttgtcttgctagctcgtgtctacgtactccctccgtacctatatatttaacaccgttaatttttttaatatatttgacagtttatcttattaaaaaaataaaaaaatatttttttcttattattaaatatgtttttattatatatatagttttacatatttaaaaaaattaaataaaataaacgattaaatatatttaaataaattaacggcgttaaatatttaaaaacggagggagtagtcgaggtcgccatgcgtgcactcctgcatgcatgcatgcgtggtggtggtgtgtggagacgatgatattggtgtcgcgtgtatcatttcagttgccgatcgatttacggctgatggtgtcgttgaccatacaactgtttggtgactgagggaaatatatgtaacgtgtgtccatcggtaaagatgttgttgcacgcacaagctagctagcgtggatttttaattggcaatgcttcgcttgtaaattaagcgtaatgcttctctgaacgtgcaacaatcctacacacgttcacgttaaaaaagattacagtagtggtaagtcaaacatttacaactttaactattaatagccaacaaataaaaaagttcaaacatataaaatggatgttactagatttgtcattaaacaaaaactatcgtaatatacgtaggggtggacgaaaagctcgtggctcattagctcgttcggctcgactcgactcgttgcattttcttaagggactatctatacaacattcgactgaaaattagcctaaaaatctgtcaaatgtaactgtaacataattacaatgtaattttcgtaattacactatatttatactataattacatatgtaattttcataattacactatatttgtactataattacatatgtaacctgcatccgtcatcggccgggttcccgcggcggggagaagagcatcgatggcgtccttgaaggtatccatgaacggcggcggtttgtggtgccgttcggaggcataggggaaattttcggtctgggagaaaaagagggaaaaaaagagaaaagaaagtgagaaagaaaatgtgacattgacatgtgggtcccacgtgctgagtcaaccagttggaccgagtcaaagcgccatgtcagcaaaaccatctctaaaaccgctgaggaagtcaaatttaccggttttaatagttggaggagtcatcctacccggttttctagttaaggggtatgaattagattcggcgtacttttaagggagtcaatgtggactttttcctttacacccataccaagtgaatccaaattgaaaactaatccattagacccattccaatccaacccattggcaggcttaactaggccacaatgaagtccacgttttttctctaaggctcaaaacgctccaaagtccaaagcccataatattccaaccctagtgtccctggattgaatcaagagtaaatttcacaaaactacacgttttgtagtccaagttacagaaaaccacacacactttgacacttggcacttaagtatatatattttggtagtgtagttttacagaaccacactatcaatgaatggattgcccgcgagatgacgtgattgtttcattaggatgaggacatgtcatcctattaccagccatcgcacgaaattaataggatgccacgtgttcatcctagatgaaacgaccacgtcatctcacgagtaaatccattcatcgatagtgtggttttgtgaaactaaactaccaaaatatatgtacttaagtaccaagtatcaaaatatttatggttttctgcaacttgaatcataaaacatgtagttctgttaaatttactcttgaatcaatccatcgatccccaatcccattgcgcctccgtcatcgccattgtgaatcgcaccgctaccgcagcctcggcacctcgcctccttcgtcggcagccgcatcctcgcgcttccgccctccctccttcctagccttcactccgtcgttgcaccatcttgtgctcccaggtccgagcaccgcagcacggtgttacagcctcgattgttcgtcgatctcgttgctcactgaggacgatgacttcaccacagcccacatgttagcaatcgccgttgccgtcgttcttctgctcaggtgtgcctttgtagtttcagacttccagcacttctcaataaatctcacccgatttattttgctacttctggtggtgtgtgtgcaccatgcagctgttggtcatccaaaccgtttcaccgttgcgctcgccatggaggaggaaagcgaccttcgtcagcatgtgccagcttgcgagctaaacgagctgagtcgagcttacagccgagctgagttgagctggctcgagcttacagccgagctgagtcgagcttacagccgagctgagttgagctggctcgagcttacagccgagctgagctggggtttttagctcgttaggttaacgaaccgagccgggctagctcgttatcctaacgagctagaccgaacccgagctgagccagctcgacatccacccttaaatatgcaactctttttatttaaagcatttcaactttatagatattgttggtcaaaatagtatcccaaaaactatgtcgaattctaaaaatgattatattttgagacggagggagtaactgaaatgaaataatatgtggggctaggggtgtgaggcccacctttcagctacagctactgaacagcggtaaccgcggacaatctccgtcgaacatgaatcgaagtgatgatgattggcgttcttttcttctaaagatgaagatgaagattaaggttttttttacgtaaaacgtattaatgtatgattgattgaattttaattattataaacttaaaaaatcgattaatatgatattttagagtaatttttatatagaaagttttcgtatgaaacgcaccgtttagcggtttaaaaacatgccacgaaaatcttaatcttcattcaatttttattggagaaaagaacagaccttaagtccaacagtgaactacggacgcatgtcctctgcagactgcagttactctgtgcaattcccgtcggtgaacgagactttacggatccgttcccaactcatgctacagatcattctgtgcacccaattccaagagttggcaatgagaataatagctaaggtgatgtttggattcagtgatttaactctagtctgtatatttagtcattaatttagtgtattaaatatagactacttacgaaactaattacataaataaaagctaattcgtgagataaattttttaagcttaattaatccataattagataatgtttactgtagcatcatataggctaatcatgaattaattaggcttaagagattcgtctcgcgaattagttcaagattatggatgggttttattaatagtctatgtttaatatttataattagtgtccaaacatccgatgtgataggcacttaaaagttttaatcccatctaaacaggtcgaagtgcattcctttcttcagtgattttttctggctccaaacggaggattcggagctagagagctccaaaaccacttgtttcatcaagctatttgaaaatgttgctctttcgtgtcaactagttttcttgacaagttgcaacagtgcagtacattcataatgtaactgctgcacagtgcataaatatgttggaagaaactaaaagttaaacttttgtcccagaagggaaaaattgttgcataaatacagtagttacactgtttcagctctgaaaacttagcttttaagaaaaatctactcatctggaaataaagtacatgttggtaaaagaacaaccttatgttccatgaatatattaaaaatgctccattgcaaaattctacggagtacttctcaacagcctacctcatgaaaacaacaatatatgttttacaaagttgaaccctggatccaaaagaaggggtgtaaattctgaacttattcattgtagattttttttttcaaattttcctgaagttcacaaaaatgtaaatgcaagaacgattgtcttttctttttcctttaacattctatctcgcattaattctctatgcacacaacgatcatcgttttcgcttcagcatcctacaataatccaatcgattctatgaactacagcactatcaagtagcaaaaaaataaaaataatattgccatctatgatctatctactctaaaatcttcgaacaatcaccagaagaaaaagaaatcaagagagagagcgaacaaaaaagaaaaaacaatggacaaatgtacagttcagccgctttcatcatctttcttcaattccactcctctctcttcccggtgcaaggggagcccctggctccgcatggtgtgggtgctcgacgtcgtcgtcgtcatggcgttggacgcggccgacgtggtggcgtgcgacgcggtggtggacgtcgacggcgagctggtcccggacgtggacccgacggagaagtgggagccgccgccgccgccgcgcgtgccgtacgacctccgccggtaccgcgacccggggacgcccggccgcgtcggctcctccagcgtgctctgcttcttggacaggatgatcaccacccgcttcatgtccggcctcatccgcgggtcggcctgcacgcacagcagcccgatccgcaccagcagctccacctgctccgtcgccgccgccgacttcaccgccgggtcgagcagctcgatgctcctccccttcttgtacagcctccacgcctgcccacacgaagcaaatccatcgccatgaatgagagatcgaagagaagttgatgagtactccctccgtctgttttaaatttaacgataaatatagtaatatttataatactaaattaattttatcaaattaataattgaatatattttcttaataaatttgtcttaggttaaaaatattactacttttttctataaatttgatcagacttaaaacagattaactttaagagagaaattaagatgatcgatggagaaattaagatgatggatggagaggacgtacgtgatcgaggaggttgtcggcgtcggagtcggggggagggacgaaggaggagttcttgtggccggagacgatctcgaggacgacgacgccgaagctgaagacgtcggccttggcggagagggcgccgtgcatgaggtactcgggggccatgtagccgttggtgccggcgacgcgggtctggacgtgggagcggccgtcgccggcctccgggaagaggcgggccatgccgaagtcggcgatcttggggacccagcggtcgtcgaggaggatgttgctggccttgatgtcgcggtggatgatgggcgtgtgggggtcntngggcaggnacagnagnnngngngnacgcccaccaccacctcgtgccgccgcgcccacgtcagctcctcccgccgccgccgcctctcgccgtcgctgctgctgcccgctgatccaccacgcatccaccaaagccaaaactctcgttattactccatacaaatgcagtagtagtagtacatggaatgcaacgatcatgaaccctttcttggcatgatgccaagattcagaaaccgcagttctcgcaacaacgaagcaaaacagggaaaacatatgggccgttatgggcccaatgcaggacaggacaattaaagatcgggaaaaaggtttactttaggtccctaatataaatcaaattttatttacatccatcaactgatcaaccccaaaactctttctacattctaagatttgttcacgccattacgaatgaaaaattttactcgcagatttactcaaatttattcggagtaaaatttttactcataataatgtaaacgaatcttaaactatccatttttcgatctaatggtagtttttctaagtcttcaatacataaggagatttgcagcacataatttcccctttttctggtacacttccgtcacactattattgctcacgtcgtttgcgcaccgtgagaacacacgtgtgcacgtgcagccttttcagctgttgacccacggatccagccgccaggcagcccgcccaccgtatgcagccctgaaaaaccagcgtccgtttgttcccctctcgcccccagtccgcacggcagcaagtttggcgccacatgcgtgtccacgtactcgtatttcctaccgacgcgctctactgctatcggcttctcacagatattcagacggcgacgcctctgcgtcacccaggaccaaacgaaccactaggagagcagacagcagaggcgtgtttgcgagtactttgggctttggctagttggccccccggtccggccgtgcacacgagtcaagcacgttagagcagatactatagcagactataaacaagctataaagatattttaaaaagataaaggaagatacagtggcatactatataagtcagctataaagatattttaaagaaataaaagaagagagagaagagtagcaggctacatatctacagtcagctgcaacacagactccaagacgtaatatgtgtataacaggtgggactatgtattaatagtatagtaagcaagtattatatgaattgactattatattggctatacataatttagagcaagtttaatagtatagcctactattagctcaaatcatctatagccaatgtaatagctaattcatacactagttaattactatactattaatataaggttccgcatgtcatatacacattacgtcttggagtctgtgctgtagctggctacagatatgtagcccactgctcttctctcttcctttatctctttaaaatatgtttatagttggcttatagcctgcttttatacctgctcttatcctatggctaggtcgctggtagcccggtacacctacttgttgttgtaggtagtactagtagtactactagcttgtggagaccccaaatgacccaactaatcctaataggaaaaccaccaggagggaaaggaaaacgaaagagtaggtgtgtggtgttgggcatgcaacggagaagacttttttgacccagagatgagggttgacttggtcaaaccaatgaacttttaataataataataataactgaagatgatgtgcatgggtgttgagaagctggttcacactgtatgtgcatccaggacccacagggagaattcttatgatttttcatgtgaattaactcaaattatcgtataaattatacaaaattactttgtttcaaaggaggcacaagaatatattttgcagtgtgcaaaatcgtcaaaaccactacggggatatggtgaaaacacacaccgcctttgagaaagaggaagcaatcagacagaagaaagaacaaagcgtgagaagaatgatttggtttctgaattctgaccaatcagtcgaacataatttctcttctgagggccccacggtttgttagtccgtcgaatcttatattccctgaacgaactcactctgaccagaaaggcacaccaccacgcatgatgaaaatcgcccttttagcgaaaaggcaaagcagagcagcatttgcaggatcgatttctcatgcatccatacgcaatcatgtgtgtgtgtgtgtgtctcatctgcagcagcagaatgccgcttctagaaatgcacgagaaatcaaaagcaagaagaaatggataaacgcgacctgaattctcatctcaactaatactagaggtttggtcagagaaagaaattagcgcatgcgaccaaaaccaggcgaatcataacaagatcgctactgcaaccttattataaaagatcaattacttggagcaggagagtttgttacgtgcagtacattctgaggactgaggttagagccggcaccggcagccagctggcttcctaaaatcgcacgcgtgcctaataggaaaacagccgagaagccctgcctttgcaattttgcaaaatagactatttgattaggtgattgaattttgcaaagtactagagactttgattatgtgattgatcagaagccttggccaaagttcatagatgaagtcctgcctttgcgattttgcaaaatagacttttgattatgtgattgaattttgcaaagtagagactttgatcgtgtgattgatcagaagccttggccaaagttcatagatgtggttgctgatgatagatcgatcttggactcggtactgctactagtacgacacggcttctgtgactgctgcgtcttcttccaaaatcccaacagggtagcgatgtggagacgacgcgtcgctgtacttgtcaacgactctggtcatccacaaccatcactgtgccatagttattgaatgtctaatgcaccaagctatccgtggcctatttggtttattactaatgtaataatgcaagttatccccaaattttcataaactatgcttttgttgttgttaagattttggaagtgtgtgagctttagttggctttgcctaacaaaaactttgggaggcgtttggcaaatgggcttggaaaaagaatatattacccatcaaaggatagtttttatcctaaccatacaattcttctcatctcattccatcctaaaccttcactcatttttctatcacagtcccattccttgtaaccaaatggtggtttgctgggaatgctgggttttattcaacaaaccaaatgggttgatggttccttgagtttctatttttctttttggtaagccaaacaaccactaatatccagagagatgcttccaattttaatttgggaggaatttcatttaagagaatttgggaggaatcttgaaacgtacaagaacagttaagcatactagttttgaatgaatggaagagtttttccaggttcctatggaagctactactatctcataaacagggaaaacaaacagttgggaaatgcaagacacaattttttcaagaacgaacaaatgaacatatgccctatcttgtagtaacaaatctgcctcaaattttccatgcctgattaatccgattttatctctaagactccagataatgcaagtatgcaactcaaaactataattgtgccacagtgtgcaaatgcagtgagctagtagtaattgttaagagaagagctttgtcagcaacagcaaagcatctagtagcagccgtattttaatttgttagatagatagatcgatgcatcggtgatgaccacccgctgacgcaagcaatgagctgtcctagcaacaagaaacagtgcacgcgacttttccaagcattgaactgataatccgatccccaaaaaaaaaaaaaaaacgacgcgtccatcggatgattaaactggttccgttcacgcggtgaaaattttgcggaaggcaatggcgaaggaagaagaaattggagtactcacagtggaagtttcggggcggcggcggaggggaggagaagaggatcttgtcgaggctctcgttggggacgtactcgtagacgaggagcttgtcgtcggggccgtgggcgcagtagccgatgaggttgacgacgttgcggtgctggacgcgggagaggagggtggcctcgttgcggaactcgcgggcgccctggcgggacccggcgccgaggcgcttgacggcgacctcccggccgtcggcgaggcggccgcggtagacggggccgaacccgccctgcccgagcttctgccgctcggagaacccccgcgtcgcggcgctcagggcctcgtaccggaacgcgcgctgctccctcgccgcgatcgcctccaggtccgcctcctcctcctcccgccgccgccgctccgcgcccccgccgcggcgggaggacgacgagctgaacggccgtgcgatgcgctccaggagctcgcggggcttcatgccctgctgcccccctgcctcccccgccgtggctctacttgctgctgctgctggcgcgggcgcggcggcggtggtggtgtttggttgggttggggattggtgggtggggtggggttttgggttgccgtggtcgaggagaaatgtttcagagatgtcgccgtcggcgtcggctggggggcgcgtcgcgtggcatcacgggctcacggcactccacggcgaagcgcagcgccggggaggagagaaagtcagggagactgcgcgttgacaaaatgggcacaccggcgtgtatgcggctggaacaggtcgggggtggaggggttgaagacgactcgaaagcaaatggaagaagactccaacccgggagagcttagcaggataaaggctcagtttagggtgtgttcagttcgcgaaaaaaaaatttgagtgtcacgtcagatatttgaccgaatgtcgaaaggggttttcggacacgaatggaaaaattaatttcataactcggccggagttcgtgagacgaaaagttttggtgtgtcacatcggatatacggacacacatttaaagtattaaacatagattgataacaaaacaaattacagattccgcctagaaactgcgatacgaatttattaaacctaattaatccgtcattagcaaatttttactgtaccaccacattatcaaatcatggatcaattaggcttaaaagattcgtctcgcaatttacacacaatctatgtaattagtttttttctatatttaatactccatgcatgtgtccaaactttcgatatgacagggtgaaagtttttttgcatgagaagtaacagggcataagttgtttattttcttttacggacacgtaaaaagaattacacggcaatataatagaagaagagagcagagtttgattacatatacatagaagataagctactaagaaagaaaaaaaaactcttatcgcaagggagggtggagtagggggttccactacactccggcatacgtcgtttagatatttttctaaaacaaacttgtctagttttaatcaaatttgtaggaactatcaaaatagatattataaatgttgttgtattttctataaacttgatcaaatttttaaaatgtttgatttaaaaaagtcaatgagacttatgatatggaacggtgggggcgaattttttttcttttttgcaatacaatctactactacatccgttccgttataagtcgttttgattttttttaaaacttttttttagtttgatcaagttagcaacatctacaatattaaattaatttcattaaatataacagtgaatatattttgatagtttgtttgttttgtgttaaaaaattgttatatttttatatagacttcatcaaacttaaaaaattttgactaagaaaaaaatatttttaatatgaaatggagggagagtattttgtatatagtacaacttgtaccatagaagatttattgtatttttatggcatgttcgaagttagacgatacgtgtttatttaaagactatatacatattcttctaatagattaaaaaaaatttaactagaaataaaaatagttttattacaattctttcttcacctaatggagcaaagtttttattttataaaggctaagggtattatttgagttgttaactatttgtctcttttcttctctctattctacatcaatagatattcctaattagcaatgcaaggctgagtttggttcttcactttcccaactcatctctctcgtttttcacacgcacgcttttcaaactaattaaacgacaaaaattttctatacgaattcatattaatcaaattttcaaaaaaataactaatactaaattaatcatgcgctaatgagttgcgctgttttgcgtgcatggagtgtaagttcccaactcaagaaaccgaacatagcagctgtgttcggtaaaggggagttgcgaacttttcctccgaacatgcaaaacaatatagtccattagagcaagtataataatgataagctataaggctactataagcttaggtggagaagagaggtagtgaaaaattaaggatgttggctctcatacaagaactagcttatcacaagctccaagacaaatgcattaaatgtataagtgagagatagagagataagaagaaaattgtagccaatcgtataactaatctataatatatgttggctttaaaatgaactaatagtaggaagtgagctctattattatcattgctcttagcacgtgattaatttagtattacctaatgtttttaaaaagattatcaatattacttttaaagtaacacatatatatatatatatatatatatacagtttaaccgtttagaaagcgtgcgcgtaaaaaaacgagggatatccctccaaccaaacacaccctaacagaagcactcagccagctcctgtaaataacctcgcaattacagttgtatgtatatttgtactggtactatcttcagtaggaaatctatgcctttaattaactcaataaaaaaactgaaaacgtgaatattaatcgaagtgactaaaatttattctcccggacaaattagtgagatacggaagcataaaacctctacttttactatggcgctgctgtacatgtacgttgtctagtaaaaatggagaggagtgaagctcgctgcacctcgcattgtcaggccaggtgtttacgcacgtaaacaacattcacaatggggaaacacaaaaggtgatctgcccatatctataggctctctaccagagatacatgtcagcatatttttttatttggaagagattaaatgaagagagagagcaaagctatctactaacctgaagatagtctattaagaaaaacgaggcaatacattatagagctatagatacctatgtagacatactattgaggtggtttactattaatctaatctattgctaagatgtacatgttttatagagagcaccttactttactataggtgctctaataattaatctccgttcagcttatcagaaactgcgacgaaatggcggccggtgggccggcggctttatgttcctgatatgattagggaaagaaaagacgatttcagaaaaaaaactgagtcgtcaggattgaccccatgttttcctctgcacaaaacacatgtgcctgaaactcttcaattccgtgacagcccacagcacggcaacacttaatctgatgtcaggtggctgacctgtggcacataatgttaagaatctgccctagaatattaaggaacaaagctctaaatgctggtactactttattactacatattaatttcgagtagtagtagtatgtataggaagtataaacaatttctttattctatggcggtaaggcatagttttttttttctcgactcgaaaattcaactttctctttttcatttgcatactttttaaaatattaaacattgtgtttttataaaaagttttttagaaattgtttaaaagaaatcaaataaatctattttttttaatttttatggtaattaatatttaattaatcatgtccaataatttgtttctcattttacgtgagctaaatttatgtctgccaattgagagaacgaaaggagcctaagatatactccctttaaaatatagtagagtatcataatttaaaatcaagagtgcatcgttaagaggctaaggagttgtgtagttcctaagtatactttatcactatttatagtgtcatagttggttaagttgagaaaaatcaaattcttcaccacatcttaatcatcattaggaaattttgccacacttttttcgtcgtctagaatgtcacaacagtggatacaaccaaataactaccaagcaattaaatttatctaaccttaaacgtggtaaattatgataaagtgtaaccgacaaccaaacactttataagcgacgcgtctatcaattgcatacttgagccaaggtttcaaagggatttattaggattcttttaatagaaattcggattcgagatacatatgctagcacacgtaaccatcagccagttaggagggcatttatactaccattagtcaggttagattgataaagatgtgccagaatttattagataaagcagaagagatgatgccttaaaataacggggcttttaactatttgccattattacggatgttgtttaatgatttaccactagcctcatatatcatagacacatgagggctcacatgtcattgatagggtgtggcaaatcgttaattgccatgtcacatgagtgacaaatagttaaatttccctaaaataacatcagggaagacttggaagtttgacctcacatggatcgagcgagcttggtcgttggcaacttggctggatggatgacaattgccatggtcgatgcctgatggcttgcttcagtagcagccaccggttgcctcgcctacaggtttggtgattatattgttcagtgctctcgccatctcttgccatgatgatgatgggacaccatttgatcaatattccttgtttaatcatgcaacccagaaatcttagacagaaaattttattttaagttaatttcattttgggccatgtttcattaccaaccacctttcttttattttttagcaggctccttaatattatcccggtttgtagaacccccttatcttaacatcaactacaggttgagttgaacttaaggaggacttactctttgcgtgcaatcagcacctaaccagaagatgtgaatcatccaagacacattagtatggcgtactcctcctgcttgaatcggagtttgaaaccaaacaaacttctcctcaagaggatagatgggggcgattcaggtgatatcttatgtagatataagtaaagaaagaatggtagatgataatgtgaaagggcgctgcgtttaggcgggtgggccccgaccggctggcccgccccctttctttgcccactggccgcctagctgttattctttgagatttggatagagtcttgcttcgatcctgctcctcaacataagggagtgacaggggaaaggggccggaagttttactttggaccaccctttgttaaatcttttcactttggactaataaatttatctttgttgcacaatagagtaccataaaccacatcttttgcacttcaatgacttcgagcaaatcgttaacagtgtgtcggtgaactttcatatctgtacgtatgccatacctttgttgaaggagacactgacatggttagcaaagagagttaggatgatccattatgcaacaaacgtaaatttacctaattcaaagaaaaaagattaagtatagggtgatccaaagtaaaactttgacaataaaacattggtccaaagtataattcactctttcttttttcatgcatgtttatgtttacggaatggactaattattttgcttgtcagcacgacgtcagaaaagggaacaaatgctttcttcagcctctcaacactaaggaaatgtcctggttttcactactccctccataaaaaaaaaacccctggatttctatatccaacgtttgacctcttatttaaaaaaattatgaaaaaaattaaaaagataagccacgcataaagtattaactatattttatcatctaacaacaatgaaaatactaattataaaaaaattttatataagacggacagtcaaatgttggacgcggaaatccagggtttgtcttttttttttttacgtggggagtagaaatcaacagcaggaaaacgtcactgaattcttctgatcaggacagagaggaacgtcatatgacgttcggttcaatgaacatgtttgagtcactacacgtgtctcgatcagagccgtgggatctccatcgggcggtttatctgcgacgagtgtgttttatccacgaaatcacgatccatatcttttgggtgggggcttaaggcgttaagcgtaatactaaattcttaagaggattctcgtgcacaagtttcagactaatgaagtcgatctggaccgtccgatctcgatcggacggcccagagagagccccaagtaacacgggaacgacacgcgccgtggggcccacacggcagcgggatggtcgccttcactgaggcgactcttcttctcctcctcctcctccgctcgcgccgccgccgacgaggtcgccggactccgccgccgccgccgcaccaccgcccgcgacatgctcctcccccctctggtggtcggctcgaccatggcgtcgctggcgtccctctcgctcccggtctccaccgcctcgcagggccgcgcgcgcggcgcgggacccgtcacggcggcgccgcggcggcggagggtgagcgtcgtgcgggcgaaggtgcgggagatcttcatgccggcgctgagctcgacgatgacggaggggaggatcgtctcctggacggcggcggagggggaccgcgtcgccaagggggaccccgtggtggtggtggagtccgacaaggcggacatggacgtggagaccttctacgacgggatcgtcgccgtcgtcctcgtcccggccggtgagtccgcccccgtcggcgcccccatcgccctcctggcggagtccgaggaggaggtcgccgtcgcgcaggcgcgtgcacaggctctcccgagaggcccgggccaagaaccccctcctccccacgttcccaaggctgcgccgccgccgccgccgccaccaccaccacatgcccctcctggaccgccgccgacgaagggcgtcgccacgccgcacgccaagaagctagcgaagcagcacagggtggacatctccatggtcgtcggcaccgggccacacggccgcgtcaccggagccgacgtcgaggcggccgctggcatcaagccaaagctaaagggcccaaagggcgctccacctccgcctccgcctccacctccatcgccacacagacaccccgctgctcaccctccgcctccgcctcaccaccccgctcctcgccctccgccgccgatggcggcggcaccccggcaaccagcagcgctgccaccggtgcctggcgcgacggtggtgccgttcacgacgatgcaagccgcggtgagcaggaacatgatggagagcctgtcagtgccaacattcagagtcggctacgccgtgtgcactgacaagctcgacgcactatgcgagaaggtgtcatttctatgaatcccctgcaaaattggtgaaattcatagctgctagagttacagtttagttatagtttgactgaaatgaattgagtaggttaaatcgaaaggggtcacaaagacattgttgctggtgaaggccgcggccatggcgctcacgcagcacccggttgtgaatgccagctgcagggatgggaagagcttcagttacaacagtagtatcaacattgctgtggctgtcgcgatcgagggcggccttcttacgcctgtcttggaggatgttgataaggtacatgcttattgcggtagctgcgttctgttaagaaatgtagcattgttgcgaattagcgtctagtgaatgatctaacattttctgaaaaaaactaacattgcagttggatgtataccttcttgcacaaaagtggagaggcctgctcaagaaggcacgcatgaagcagctccaaccagacgaatacagttcaggtacagaatatgttgtattgtgattggcacttggttttttatggaaaccacgcttacctgaagtttgatgatttgtagggacttttacgctgtctaatttgggtatgtttggtgtggatagattcgatgcaatccttccacctggtcaggtaggttttttcattgactgcccagtcagtatgaaattttgacagaattgtatttgagcaatatgagaactaagaacaactgtttgtcgatggctcgctcaatgcagggggctattatggctgttggaggatcgagacctactttggtggccaacaaagatggtttctttagcatcaagaacgaaatgctggttagtttgtttttcacactttacggcctgtatgcctcaaagctctgctcatgctcagtgactgaccattgatagtaatttggcatatgcaattatgcattcaactctaaaaatcaatgagtaagatttccttgcaaatatggaactaagtatattttgtcatcttgtaattggatcggcaagtggaataatttatatgcacctgattgaacgtaataagtgcatagtgtagacctgttattttcagcttcatgcttgtgtcattattgttaaaacctagaggtgccaactggatgtttggcttctctgagttggttcctgtaatgagttcataccagtctgttgttctttcagtcaatcactgacttagtttagtttaaaaaaagttttttgtgacttatatctatacttattatctatcgattctgtgtggacagttcccagcagcgtgtcacagcacatcttacctttcaacatttcactggttgcaataaatttttctttcagagatacttctctgaagcttctgaactatgtttctcccaaccttttcaggtcaatgttactgctgaccacaggattatatatggtgctgatttggcagcattcctgcagacatttgcgaagatcattgaggatcctgagagcctaacattgtagggaaaatgtccctcacaagtgctccctaagtatctgcagtttgtttgattcgaattggaagaataattccaccgagcatttgtagccattaattgtaaatagttttgttattgttttaatgttattgccatatgatcaatattttttcttatacccgccacggaataagtgaaatgctcatttccagtttccatacattttttttacttgaagatagatactctgagtccctaattctcccaggtaatgagtaattgaaaactacttatctcgcaacaggttctcgcatacaggtaagtttccagaatctcaccaattgccaaggaattttgattactttgtgaagcaagtatcacatgtttggtactaatagattttgcacaagaaaaatctgattatattcctttctttttcatctctatgtgctatgctcatattagcattggtcctggctgcctgattcttgatgagtgtactagtagtactattgaaatggaggccttgattttcatggacaatacatcacagtttgtgaacatgttgaaatgcaaaatattacatggctcctaaaaagtcaattttgtcctgtccaaacttcaaaatgagaaaattaaatctgttttccatttgctaaatttcacatttagcattcataccttgggaagttttatctaacacccaagcaaaacaagcctacacatcactcctgactccaaaagaaaggcataatcgatattaccgattaagctctggtaaatcatttgatgataaacgctaacacaacgttgtcaaaagaagaagaaactcaaaattattattatttttgggttagctggaagaaaatttcagaacctaacacaaactgtgtctgtatgagtacatggacagttcaggcaaaggcctcagctctaagccgcgtggccgccgccgccgccgccgccatagtaaccgacgaacggcggcggcggcgcggcctccctgacctcgaggatctcgacgcggcggttggtccgcttcctgatcttgatcgccacgtcctgcgggctgaaggccccgaacacgctcaccctgccgtgcttcctgtcgatcaggtggctctccagctctgcaaaccaagcaagcgcacacacagcagcagcagcatcagtcaccggcgtcgccatggcagaaaaaaaaacaaaagcttcgtttcaccggccggcgtcgccatggccagccagaccggctaccttcctactccctccgtttttgtaaaatatgtaaaactatatgtatacataaaaacatatttaacaatgaatcaaatgatagaaaaagaaattaataattacttaaatttttttaataagatggatagccagatatgtttaaaatggcgttgaatatttagggacggagcgataccttgcatctggagcagcgccctcctgatcttgtggtagcacccgttgcagtcgatgttcatcctgagcgtcatgtagtagagctgcaacacagcaaccaagcacagtgattgagcatcatatgatcatcatcccattgctacttctctcaagcttcgacacactcatggccatggctgttaccctgtagtccatggagaaggagctcttcctcggcgacggcgaagacgacgatgacgaaactgaactatggttcagactactactacttcttcagagttcagagcttcagaaaaggtagtggaaaaaaagcatggagttggccggattcttgctctgctttggttagtgcttaagcaagcgtgcctctttaatcccctttttatggctgctcagtgactcggttcattccattccttttgtgtgggatcgatgcgtgtcttcagaatcggattctgtggcagcctggcttccatgcacagccccttttagctgcttctcatctcaccttttctcatgagctctccgtttcatttctctgtatcttcagcctgaagtctgaacccatggattcagtaaaagaacttgacagtgagatgcagatatgtttctccatcgactttgagactttgtttttttagaaagtgcagacttttacgatgtatgtaacaatttgctggctcctcttttttatttttttttcaggatttggttcgtgatggatgttccatctggggtttgagacttgaatgcaagaaagtgataagttggacaggtggtacgattttcaacgtttcaagaaaacattggcatttgaaaagaataaaaaaaatgatgtacttcatggatagatttgtcatcagcatacctgtaaaaaaggtgcgttttttttcgtagctagatgcaaaatatatttcatcatgtcctagcttctttcttgacagtattagcagttcaacaataacagcaactataaagttgcaattaatcagatgaactcactttaaccctgccagttttaccaagggagcatgatcattgatcagattcttcagtcctgtactggtaaaattctgcttcagctgaaccaaaagcctcttcgcaacttcctttgcttcttttttcatttactgctctagaaacaaatttgctggcttgtgacattaacttcacaagtatcaattcaggggtaaaagactgcaaactccatttcatttcaaattggataagatgacaaggggatgataaaaatggtctaaactacaaccaagacattcacgaaagatatttgaagttttttatggagctgatataaccaaatggactgcattacacacaagactgtgacatcagaagtccaagactcagttcaggtggttgacataataacctaggagatgaaccaaagtcacaccaaagatgcataattcataaaaaaaaaaaaggagaagatgcatagttcagaaagaaaaagagaagatatatcatccttgataattcatatcctgcaagttctttcaactgatgaacagctagctgggcaatgattctccactgatcgtgcatacttcaaggagcagtggtagcattagccatggatacatcaaggagcagagcccctgaggagatcctggtgaattcagtgcatagctggtattgcagagtttgaaccacctttgtttgtttgaaggccttccatttgcctcattacttcttctcttgtaggaacttcttgtgcagtaatgacttattctgagatcttcccggtgagcaaaagccttccatttgctatcgatccactcgagtgaatgcctcagttgatccctatggaataacaccatcttcttctcccctgcaaattcagacaatggaaagaactccgttgacatggcaacaagctaaagacaagcaagaatttgcatcatggactgttaaatttgaatccactaaggaggtaatcaactgacaattcacctggtaagtaagctagcagcctccttgcatcactcaccttcagcaaaattccctcccaccaaccatcatacaaccatccgtcaatgacagtgccaacaccgatcgtagaggggttctccctctccgacatattgtggggacgaattcttgttcttccagagaggcgtatgcacagagggtcaggattagcggttcttgtcacaagcaaccattcctgcaggagaacaaccagttcgtgtcagccttctcaactcaaagtgagcttcatggacatgagcgggagcttgccatctggttactataaaagaaagaattttattttactatataactctaagttactactttagttctaccatattatcaacagtagaagttactattgtatctctaacgatagtgctctactatcaatattatcaaccgtacaagtcatctgagctgttaatttatgacttctactatcagtagaggaaaatattctactatagtagtataaatcgatatggtccaattaataagaaagaacaaaaggtgtagattcattctactacccatagaggccaccgtaaatttgtcaagaacgaactgcattttcagaagtggtactgaaattaggcgacatacctctaggtttgctcttggtgtttcaggatcttggaggtgttggtacctcaccttgatgcgatctccgcgcctcctgatcactgaaccaatgaaccaacatcccctaatgccactttcctggctcaggcattcaacaaggcaaccaggagagaagtactactcgagatactgctccagggcagagttcatcagagcagatgcaggctctgttggtgcagcattgcgtgcagtgacattgattgttgcggcctgaacatggtctcatcacctgcagtggggttctccacagtttgatgatgatgatgacctctatctgatgatcttgtgtgttcttgttgccttcggatgcgtcgggttgcatgttcacgggaggtgttcctaagattgttctaaatatctcctgttctgaatacccttgcaactgtgcaatgtcaaaggtcttgacattgctatcatcgtcgatatgccgaatgcataggtagggctgccagtcgatgttgttggcaattgcttgaaacttctcaaagtgttatttgttcaggactcaagccaatccgtctatgcattcaactctgatgtcttgcaaattgtcggagaggaggatctctctatcattaacacctggagaaagctgaataccagaggagttgagtgtgtgaaaccatcgtatctgaaccatgttgtttgcatggttatccttgtagagttcttccacataagcaacaagtttgttgccatgttggaccaagatgtaaacaaaatcgtgaacctaaaaagtgtcatgaacacaattggtgtaagcctaagattcagtcctctaagattttttttaaaaatgcgctgatgattgataagcgtaccatgaatgtaaatccccttcgccagaaggatttgtagctcttccctttttttggaatgcgattcaggacctaaccatttgaagccacttgaatcatttccagcagccgatgatgaagagtcctgaatgaataaaatgaaatttccttattaacttcaatatatagtgctttatcggaagcatttctcatgaaaaataaaaatgatcagaaattagcttaatgtacctttgttgtggagatattagcaagcttagcattttcaccatcattgttacaaattgcaacttcatcagatgtaacatctatcatggatgatacactattaggactggcaaaaaccgaaaaaacaaatatatgcatgccaattttcacagtggtgattagctgacgagtccaaagattagtgcagatcgtaaaaattgtaaatattaatatacgatgaacaaaaagaaaatcaaactgaacatgtcctaaaacagatgctaatatggggtaacaaggaacattatctcattgaggtattgactgcacaatgatgaggcccattcattttgctaatgaaacaaaaggaagaaagaatagaagaaggcatatatgtccatgtcgctaatgctagaaaagtgcatatctcttgattaattcaattcacagctttgttcaagagttgggaaattagaataaaaaagatatttgacttgttaaagaacaaaactttacaaccatttaagtgaagttctatgactcattgggtttaataaccatgataagtctgaaatacacatacagatctgacaagtcttcatctaaattgcaatagcttaaatcaagccaacccagagaagtatatgcaaggtcaagtccatactaatagcaaatggaaacaatatactaaaaagaaggtaagtttttagatcattgaactctatatgcatatctctgctatgtataggaaaattttgctcactaatatatactacaagcacgtgcacattacaaagatatcatccattgtgtgactggcaaatggagacaaggccctatagcggtgtactagtacataggggttaggacccacaagttagcagctcaaatatgtttatagataaattgacaacgggaaaggcatcaaaggaaatgtctaccgaagtaagacccttcttaggctgcgttcttttcaggctattactcctcgttttccgttagcacgcttttcaaactactaaacggtgcatttttttgtaaaaagtttctatacgaaagttacttaaaaaaatcatattagtccatttttttaaaaaaaatagcagatacttaattaatcatgtgctaatgg

SEQ ID NO: 58249 - DNA, 28070 bp, Oryza sativa
catactctgttgcaaaaaatcacccacatattttggaaaccttctattaagggaatccgttttattctttgttccacaaaaaatatttcacctagtgtacttacaatatattgttatgtatatatctaatgttatgaattgaaacattcttttgcaacaaatcatccacatattatggaaaccctttattaagggatattatggaaaccctctattaagagaattcatttcactttttgttccacaaaaaatgtttcacctagtgtacttataatgtttcactatgtatagatcaaatattaaatgaactgaaacattctttcgctatttgctgaaatattgtttttatataaggtgaaacatcgcctgatttaaacgattgaagcattttcgatctacttagtgaaacaattacgatatacttggtggaacatcgtacaatatttaaaaataattcaataataagctaaaaaaattttcgtcggaatatatccatgtgtagtcttgtttcaaagatttaattgcaacgaatttaatggtgcaatcggatcatgatttggataaataatttaaaagaaaaaataatttaaagtagtttttgcatgctgacgtcagcatgacatgggcgtccgattttcccaccttggatcgggcgcctgacgtgtagttgcctccttttttttttagctttctttggtccattttaatacaatataacactacctatttggtgattcttgcatacacaactaactctggaaattacatttgtgtcgcattgatgctttccttttactttgattttattaattgggagatgaatgtatatttaagacgataaaagctccaacaataatgcatcaaaaccatttctagtccaataaatgcttccttcctactacattaatcaatctatgcaagtccaggacaataaattatgctataaggtgtgccatggatggataattaatgtaaatcctgctaattaatgtagcacttcattgaaagaaaatctgccagatatatatgagatatgatattattcaaggtaggcacgcaccaattctttgaagcaacattaaagccaactcttctactacttatatgagttcccaggatcaacatgttgcttgaaccagccgtcagtgaaatggaagtacacaactattcttgcaaaatgctgcaagatttgtgccttatgctgtctatatttgtgggctttttaaatcatttagctctatcatcatcctattacgcgtacccagatgttggcccaattagaggccaagcttcaacaaaaggattgaaagaaatctcatatgtaagttcactttatctcaatccatatcatgcttttcaacctcatttcttcccttatcgtagtgaagcatatgaatgttatggatcagttgcatgttcttgtatacatattcttgggtcacttctttttttatcttttctctctaaacatgatgtttctgtttaattaccaaagcgtacagtttcttatgacaatgaaatataattgattttttttcttaaattatgagtgttgataaataataattgttaaactgatatgagttgatatgacgatggaaaggttgaattttgagtcggtgatgaggggacgtttttagttaaaagttgggaagttgagttttatctttttaatatattgttcctattcaaactcgtgaatttgcagctgaactggaaaagggaatgaaaaatccatatgtactttttaaattacagagatgatttacatctcctgcctctatcattaggcacacaaccatgcattgggaggatccattcatatttattctttatgttaagatgtctatatgttcaagtagtgaaaatgccactagaataacatatatatgtatattattttttcctagcacgcgttacatcgttcaacagatgcccctgaaaatggatatagcggcgccatggcaactctggatgtttataattttccatatttgaagaaaatggaagtaagtgctgctattgttagagtttcaaattaccaagacgaagccactaaagctggtctcaatgatatacaggccggatgggtggtaagtgaacaactaaccttaattgtctatgttaacatttggaggatgtgtagtacaatcaacatcagctatgatatatatatctcatctcaaatgctattttccctacatatatagattgatccaaccacctatggtgacagcaaaacccacttctttgtatcttggacggtatgtgtccacttatattcattgtttgtgcacttgaaatacattgcttaattaccatgcatatgtctttaattacaaggttttgatatggatgcatgacatacaggctgattattacaataaaaccggatgctttaacttggactgtgacggttttgtaccagtaaacggtgccccggtgactcctggagatacattagaacaagctaataaccaaactaaaatatcattcaagatatttaaggtaatgtaactaataattatttgatcctagactgtatttagtgtgtacatacgtatgctacacaacacatgctgatcttttttccgtaatatagtaaataaaagtacattttcatgaactgattatttccctaaactttcatatgcccgggtatgtagcttgtagatgggatctcttgagctgaaggctgaaaatttccctgttatcttaaagaaaatgtaccttgtatttatagtaggaaaatatctaagtgtacagcctttactttctcgaatagtaactcttccgaatattcttgcgcgatgatatttttccatatatgtacacaggacaaaaatgatggagattggtggctttactttggatatgacatcaacaatctcaatcgagttggattttggccaaagaatatttttaatcgtatggtagatcatgctactcgtataaggtgggctggctatgctcaatcctacaaagggagctccagtcccccaatgggcaatgggcaatttccaggaaaaatgtcagcatcctttcagaatgttatgtatgttgataccgatggccagccctatcctcctcctgtttggcctgctggtctcgaagtttatgcaagcaatacgaaatgctaccaagctagcatttttgaggataacatgttttactatgtggggccaggtagttgtactagttaaaattagaatctcttgaaaatattaatggcgagggccatctcttttcccaaaaggaagaggccctcgcgtcgccctcccccaggcggctcgggaggcgatgtgcgcgccgccgctttcctcctcccccgcctcctcctccacctcgccgccgccagagcgggtgccggcaatgccgcgcagccgcaaggacggcggcggcggggtctcgcctagccaaccctacgctcggcggcggggggggagctgcccggggcggcggtggtggcggccagatccgcgccgtatccagccggatctagaggggggatggccagcggcggggactgacggtgatggtggcgacgacggcggcggaccacggcggctgaaggcgacgtcggcggcggaccatggcgactgaaggcgacgtcggcggcggaccgcggcgcgtccaggacgccacggctgggacctccgccgcatcgtcatggtcgtctcgctccaaccgggcgccgagcggcgcgttccgtcccccggatccgcgccatcctggccgaatctggacaggcggcggctggtggcggcaaccggtgatggtggcagctggcggcggcggctggcgacggtggcgtggggacgatcggcggaccacagtggctgacggcggcggccgtggtggcgatggctggcgagggcgcatgtgcggtagtcggcgcgtcgacgtcagcggcaacatttgaagacgaggaaggagttgggcggcggggaaggaggagaccgggagcgggcgtagcgtgggcggcggctgcgtgtggcggcgttgcacggctcgggagggctccgacgagctcggcggtagcgcggagtcgaggcggactccggcagggttgctcgctagcggcgagcctcctgctcgcgatgtgtggatgtggatgcgatggcgtgtttggttacgtcgaggtatgactgcttgtgagacgtcatggactattcagtggtcgtcgatgtggggtgcttgtgtgtgtgatgtgaagacgttggcgaaagccttgccgtgcctttggccggttcgacgatgacgatgcccacgggcgccgttaaccttcttggaggcgtcgtgatggcgttccttcatattccccacaaatctccaggtgaaaaccttgttccgatttcggatgagcggcggcgacgttatgcatcgtgtcctccttgggggtgtcgcttcggagaagctcctatgtatcgacgaccgtggatggtctttttcggttctaaagccttcataccttggcgttcggcgaggccttcgcctccttaggtccgcttcgttcttgtggtgggtgacacgctcttcagttgcttctgctgatgaagtcggagcggctcgctgatgacgtgcggcgatgcttggcaacgatgacaagttgcagtctcttccaaggagttgttgttggccgtgtgaaggaagtggctctttggtggcttggctgatgtccattgttggatatcggagctgcttttcgctctagcgactttcacggcttcagtgtcgatgcggttgtaaagtcggcgctgctgggttgcttgggcggctagctcgacaacgataacacctcttctgtgatgttggagctgtttcggtcgcttttgtgtattagcttggcaatgatgtcctatatttgggctccgccgtcgttgcgagttgtgtagctaggtcccttgctttcttctgtgtggtgagttttagccggttttccataattaaccgtgcaattgtatggttttcgggcccggttttccttataaactgggtcaattctcttcttctaaatataaaagtggaacaaagttccgccttaggtttaaaaaaaatgttaatggcttaatcagttgaataaacaatttattgctaattggcgcttggtttcttccaccccgtagcctgcctacagcctgtggctgcttcatgctataataggcaccctggctgccttgtagtgctgcactaggaagccaaatggtgactatggggtgtttagatccaggggtgtaaagttttggcgtgtcacattggatattatatagggtgtcatatagtgtgttcggggactaataaaaaaactaattacagaattcgtcagtaaaccatgagacgaattttaaggctaattaatttgtcattagcaaatgtttactgtagcaccacattatcaaatcatggagcaattaagcttaaaagattcgtctcgcagattagtcgcaatttgtataattagtttttttagcctatatttaatactccatgccggtgttcaaatgttcgatgtgacatggtgtaaaattttgaggtgggatctaaacaggccctattatcaagctatgtgcagtaaaaaagattggtttactagaagatcacttgctagtcaggaacgataaccgctctgttccttgggcttctttcgtcgctctccttcatgctcgctttatgagtgcaaccaagttcaataaactattcatactaatttataaactataatggtttctatctaagagccatgtacgtgagatgcttccttctcatacacacatctgaagcaacatttcaacatttcaacatttcagcaactgaattagaatgacgtgtgtgtttatcaaccggccgattagttcccatctcgtcatctttcttttgctatatacctgtagccagccatatattaggtccacattacacctttttttctacaaaaaggcagtcataattaatttagggggcaatggccaattacaatcaacatgtcctccaggctcctgtgatgcactcactacttgaggtgcactcgttgttcttcaccttatcccatagtttatttttttaacagttctatctgctcaaaatcattcatgttattaatttgcaaatgaagtttaattatgagggcaataacaccaccaatttggttgtttgcattgtattgactttcgtgttagaacctggttaagggggtttaatttgtatttactttgacgtgcatgacatgcatcttcgcagttgtgcaaaatgtctcaaactaggataacgatgtctagattcagcctagggtgggaaacaaggatcatgagttcattactctaataatccagattcattatactagaaagaggtcatatatattcctttttagattggctttttttttacaaagaaagcacaggtatctaagaagagaggtatcaaaacaaatgttaatattgggtgtaacagccctaaaattcactaagttttaaaaccatttttctttcttgttggatatatatattaattgggtgcttttccatattttcccagcgctgctatttgccgggagtgcataggttctggatgattatgatggtacagggctttgcttggtcagtcgaaaaccccagaaaaaaaaacacatgtaaaccacattattgcttaatttatataaaaagcatggccgcgctcaggggcagattcaacgtgggtgcggggggcttaagtccccctgcacccacaagacccatggataccccatgagcacccttttgattttttcaccatgaataaaaaactaaaggtccgttaaagaaactgcataattgagccccctcccatttttttttcctggatctgtccctggccctgctctagacttcctttctttaaaaaaaaatacaacgcatgtcttgttatttcttttacaaatactcacagaaaattttgtttttctccctttgcaaagaaagcagagacgcctatgataactttgtcatgctagcataatctttaggatgtactcatagggacaggatatgctatatgcgcgtgtatatttagtaaaagtgaagcgcatgcattatgagcatgtctgcgttttaatcgtgttttaaagaaaaaaaaatggaaaactaaattcattcttcaagccgcgcacttacgtacgtgacgtaggcagttcctactcgcttcgccaatcagaaagcgaggcagtacggttctgatatcgtgactttccgttccaacatcggaatcgtcgatctcgctcgcctcggccgcctgggagtagctcgctcgctgtcatctcgttgcgatcaatatatcccggccgccgccgatcaagcagggctagctgcttccgttgcatcatcctcgccggtgatcacccagggctttggttttcgatcgtttgctaaaaagtttggctgctcactaccgaggtcatgttctgtatatgcagtggaagagagcattatttttttctttttgaaattgctaaaaaattgtcacaagttttttgggcaaaaaaaaactttcaaatgtaattgtagtatagttctaatgtaactacaatgtaattacactatagttacattgtattctctatataagttacatatattattttaatacttatatacaagttatattacaatatagttatagtggaattatattacagttatatttgaaaattattccctatatttgaaaaacttgcgacagttcctatattttttaaacatggtcaccacataaacacttaggtgggccaaggttatcttgtggttagtactccctccgtttcaggttatcagatgttttgaccttagtcaaagtcaaactactccaaatttgactaattttgtaaaaaaaagtataatatcatttacgaatttggtagtcctattttctttccgcttcccactcgagtaagttctcgatcgactgcaggcatgcagccaattgtgcttaattccatgatttcaacctatactccatttttccatttagggcgcattctttggctaccttctcgatttttgttagcatattttttaaaccgttagccgttaaaaggtatgttttgtagagataaagtttagaaatggcacgtttatgcatgctgcatgttttttcatgaacaattaatttttattttataaaaatatttaaattaaacccaaaattatgaaatttcaatttttatatttgaaatatccagtctagctattggctctaagcatttcttttgtttatgcaacttgatacaattatttctctcattattttttgtagatggattatagttatgacggcaatagctctgagaatgtgattacttttatcttgccatttctcatggtagcagcggcggtaggagtggtcggatacctactctaccgtctatgcagcatgcaccagcgacaatcgtgactgcaggatatgcctacaggaataggaggtcggcgacactattgccagtctactctacggacaccggtttcaccacaggtgtgtcaccaaatgattcttcaaaagaaccaacggttgccctctgtgtcgcgttgctgtctagtactgtagctctatgggatatatacgtgcgagttatctttttactgactatgtatgtgagtttaggatattttattgtgagttatcattttatgtactgagtactttatatattgtactactagtattactagtattgtattaagtagaacatatacactaagtatttactactactttatattgtatttactatcatttttgttttagacaatgtgcaccccctaataaaaatacatccgatgtctttagtatgaagactagttaatactttatcgagttacagttgcacacactaaactttggagctttcctcgtcgacattgagattgaactttcagaagcagaggcggagctagaaattataagactgtagctaagataggactctactaatgaagtattcatttcctataaaatttacatgatgaattaacaaaatttaaataagtttttggagttaggcctagggcttaagggccctagctaccctaggcctacctccgccctttcagaaaggataccttagctaactaagcaaacttgacatcaaaatcgtacatgcatttgccaaaattcacctgagtttctagcttctcgaaataaatttgtcctaacatagcaaaccaaacctccagctgctcaaaatacaatggtctgcctgccactgctgcacaccttctagttccaccttctttcctctgatatggcaatacataacatatgaaaagtttcagcacacaaagaatctgaaaaaaatattcttctttcgaagaatcatatatgtaatatggatcaactaggaaactatgtataaacagcatgttgtatattgtagggagagatatactgttgtattgaacctcactttttttaaaacggaaaatcaatcatatcctaataccaaaaacacatgaccactcgacagaagagcaagatagatgtacaggatggatccaggatgaactagtagaaggacagaataaattatacaaagctataacctctcttctagtggataaatgtatggcaaaatattttaatgatggttaaatggaggctcatcccatagttacaatatcttagggggcacaggacccctctgtcctcatgatagatctgtcacacagagtccttgtatattggcataggacagcaaaatctccaccgcctcaccatcatgcctcgctgcgctaattgagtcgctggatcaaggaatagcctcgagtacgtgcttggcccgttaaagttgggccagaacgtacgggaaagcaatgaaggtgcgacccatcaggaactgggcaatggctgacgtaaggcccattagtgttgggccagaggcgtatatgaggcctgttgtgtttgtcgccgggccgatgtgaggcccattatagttaggcacaagttactgctgctgctgctgtgattctccacagcccgaactgttttctctttgttttgcacactgcggcccatatgcaagaggtggctggcaaaccgaagcagggacatgtttagtaccataccgcttgttttggacaagatgagctagttgttccgctacttatatagtcaggaagctactagttgaaaactcaagcagctgcgtggtgagcacaaaagcgaactattcttataccttttactaaagaataccgtgtacgcgccacaaatagcagcatacttttatttttggagggtgttttctcttggaaaaaattatctctttagattagactcaatttccaaagctaaatttgttagttttgtttgacactactgtacgcacagttttggagggtgttttctctcgtaggaatacaaatcaaagttcaagatctatcttttaaaattcaagctcaaagttaagtttgctagttttgtttgacagatgatgtggttggcctgctaatcatgctagttagggatggcaaaaatgagctactcaatgtaagtcattctaacatttctcacatttatattgatattaatgaatctagacatatatatctatttagatttattaatatcaatataaatgtggaaaatgctataatgatttacattgtgaaacggaggaagtagttagtgtgaactaaaacaacattttcaaattacatagttacattagtatttttagtatgccacagtagagcagagtatggtcaagaaagcgttgcgtttgccttcaaaactactacataaaagcttggcttagttgaaactaacttgtgtattgtcgcttgcatttccctttcaggacaaaccattgtcaactgcagtaagttcaccataaaaaacaataggaaatgcacatgatttcagtaatcctctatcgagcacaagttacaagtacaggatcatatcaagatattgccgctattatttttctgagaaaaaaactgcaaatatatgtgctgtattgctgcagaggaaaatataactgatccagcaatgcaaaagaaatgtccaccccaattcattcacctcagaccatggagcagcttgtctctctccaagacttcatttttattatctttatagctacttagttctagggacagcctcatgttgttctggtcgaactaagataaacaataagacaatgtttggctaatgagatagcgaaatgattttccacccaccaaaagacatctttaaatcctaactatttattatctatcttctatttaatcataacccttcattcatttcacaatctcaatcccactccccatttcacattatctaaacacaccctaagtataaacatagaaagatgatacacaatgaaaccctctctcaccccagcccatttaagatctttggcatttgtctggtttacgcacagatcgtatctcgccgaataaaagtaataatagttgcattcaacaccgtaatttcgagtatgattcaagcttgacatgaccacctagattcgattatgcattgtaaaaaaaaaaaatcttttctgggacaacatccatggcattagatctctcgcagttgtagttttcttaaatgggccaagtacgttccggaagaggaataagttcatatgaggtcccttaacttgtcaacgaattcgattttcgtccctcaaccagaaaaccagacacaacaggtacttcaactatcaaaaccggtgcagattaagtccctcggcggttttgagggcggttttggatgatgtgacgcctacgtggctaatttgactcgtcttcatctgacgtggcattgacgtggcgcttacgtggcaattcatccagaaaaataataatacccgtgggacccacatgtcagtctcacacagaaaataataaaaaatggtgggcccacgtgggccccacatgtcagtccaacccacccctcctctctctccccatctcccctctcttcagttcagaagagcggtgtggccggctctcgatcttggtcaggctgatgtcccgaaacgcgaaggccgacagcaccgaacagcaccgacgtcccctccctgtcgtgcgcgaacacgatgctcgtcttgaagggccggtccgttcgcgggatgatgggctcccgcgccagcatcacgaaccgcgtcacgttcccggcgtcgtcctggatgccgtcggcgagcacctggagcccgtacaggtcggcggcgcgagaggatgcgatggcggcggtgtcccggagccccgcggcgacgacgtgctcggcggcggccgcggtgtcgtcgaaggcctcgcgggcgacgttgaggcccatggcgttgagggtgagctccccgagggatgctcgacgggcacgacggcgcgggagttctcgacggggaagacggcgcggtcggcaatccagagctccacggcctgaaaggccacctcgaactggtcgcaggggatggcgtcgcagaatgggtaggccttggccgccgccgcctcgctgtaggcacccgggagccgggacaccctggtaggcgacgcgcagctgccttccgtgcatgggcgccggggagagatcggtgatggtcacctgatatacgttttgcaaatctcagcaccctaacatcagaaaccagaggtgccatagtaagacaatcatgcaatgaaagtaaccgagtgcctgaatattcagtaatgctcattgttcaggtttcagagaatgacaataactgtaacaacaagagggtgatgttgaattggtgatgaaaaaaaaaaaaaagaaaccggggtgtcacctacaacgtggcgtccgtctcgtcgtcgggcgcttcccaggcgattatcatgtcgtaggtgagcgagtggaactcgctgtcgctgaggtagtcatggcgcttggtctcgacgcacagggcaatgtaggagcagtactccacgacgctcctggcgtacaccagcggctggtcccccttctccggctcaaaccgccggagcagctgctccacctccacgccggcgatcctgcagccacgatcgatcggggaatcaaatcaattggacactggtgaggatgaagggagatcataccgggcgcatcggtggacgacggaggaggcggtgggggagaggggagggatggcgtagtcgggcgccgccatgccctcatcgtcgccgccgccgccgtcgacgcgcggggcgaagaggaggtcctcaacctcaaggagacccatctggagtggcgacggagcaccaggagggacgcatcgttcgttcattcgtcggcagtgtccccgtcgcgcggcgaggtttccatcctccagaggcgaggggtcggtggcgggaaagggcggcgtcgcgcggcggttttgagggtggtttccctggcctaccagcgagcgcgcccgcaagagagagatggccggtggccgctcttctctatttccgccgccatcgtcgtcgccggccgcatctggtgcccatccccagcgcaagagagaaacgaagaaaggggagatggggagagagagagagaggaggaagaagaggaggggtgagttggactgacacgtaaggcccactattttttattattttctgtgtgaggctgacatgtgggtcccactagatttattattttttcagatcgaattgtcacgtaagcgccacgtcaatgccacgtcagatgaatactgagtcaagttagtcacgtaggcgtcacgtcagccaaaaccgccctcaaaaccgtcgagggatttaatctgtaccggttttgacagttgagggatccgttgtatttggttttctggttgagggacgaaaatcggattcgttgacaagttaagggatctcagatgaacttattccttccggaagaatgcaacacatgtggttggcccattttcgttgggccaaattgtacgggaccgcaacgtacatgaggcccatacggaacgggcctgtcgtgacgtgtggcccgttatagttgggccggaatgggacttctgttgtgggctgtggctagcgtcaggaaaggcccaacagtgctgcttctataggcccatgcaggagattggtgcaaagcagagaagagacaccagagccgccgggggagcagaatatttttagtaccataccgcttgttttggtggaggtgagttagccattcggctatttaaagggcggtagctgctcggcgaaaactcaagcagctgcgtggtgagcacaaagcgaactattctttcgccttttactaaagagtaccgtgtgcgcgccacaaatagccgcatactcttatttttggagggtgttttctacaaattaaggttaaatattgataatatttatttttggagttcaaatattgataatatttattcttggagggtgttttctcttagaggaaacactctaagttcaaatagtaataatattgatctaactgaataaatataaatagaatatggatcgaattaaaactcaaaatttatctcttgatagtcaaatttcaaagatgaatttgtcgtttttgtttgtatttgacagatgatgcatatataaacatattaccagtaggttataggccctgtttagattttaacttttttcttcaaactttcaatgcagcgtgtgccatatgttgaccatataggttagatttcaactttttttcttcaaacttttaaatttttcgtcacatcgaatttttctacacacaaattttcaacttttttatcacatcgttccaatttattcaagctttcaattttaacgtgcaactaaacacaactataagcaacctaccagagcatgccaagatttctgacggacaggcgacagcatggaacagagcatatgtttatcataataatttgtcttcaaatagaaactagtcaactttttctttttcatatatgtactcttgcatacagcttgcaggttcctttcattttttgagagatattaggtgcagagtacaggctcgtttctgcaaacaaaatcctgtttaataatgtgaaatctgctattatgcaagttttcatcaacagatcaagagggaaatgggcaagtattttaagtataccacaaaagagtagagtagtactatatataaatttagtcaagaataccttgcgtttgccttcaaaattacataaaagcttggcctagttgaaaccaactactgtatgtatgtactgtcgcttgcatttccctttcaggaccaccattgtcaactgaagtaagttcaccatacaaaacaatataggaaaatgcacaaaatttcagtactccaccatcaaccacaagtacaggatcatatgatcatatcaagatcttaaagatttttttttctgtgacaaaagctagcaaatatccgagctgtactgctggaaatgaaaatcaaactgatccagaagagcaaggaaatgtccatttcattcacctcagaccaaggagcagcatgtctcaatccaaagatctctttttctcttcttgatatatattagctagctctaggtacagccttatggccaactgctgagagtgacaggtaaaatggccatatctgaacttctgaaggcatgaaggtgaagtggggaaaggtgtggacgatgatcttgtcaagctttgatgatggcttaaatcggttggagcaacggctaatgtagtaccactgtaccaactaagccttcaatgctgaacagttgcagacaagagcaaaagatgaggacaagcattgcaagtatgtgtatatgttcagcatcaatgtacattttttagggggccaagaagaatgacatgtaaccatgaattccaggctttgaaatggacattccaatgccttgagcttctgatgaaagttcaggtccctattgaatatatatagcaagtggattaaaggggtactgatgttgaaaaaggcgcaagcacagtgcccatcagataatcagatggcattgttcacttgaagtacaaaacaagttttatttatttttaccctgaaggttagaaatcatgatcaaatgatgtggggaaagagatagcgcaaaaatattaaaaaaaaaactttattgacaacataaaccttccccttttttttgcgagaaggtgccgatagtaggatggtataagtcctccagttgtgagatttttatgggttcagagatggtctgtgacagtggagttttcgtacgggtaagagctatcttttggagcattttgtcgaccttaaatgtaatcatttcgggatgtctctcccctgtatttgtcaagttcttctttaagtcaatgtttcgacatttcttccacaccactgataagcttctccagctgcagaacacggccatgaaatcaatgtgcaaccaactccatcttgacgcatgcatatatcgcgacctgaaactaactgatgagatgggccaacatgactgtccaaagttggcgccttctcagagctttttttttttttccatcggcgtgcatgcatacctgaacatatctgcacatgtcatgcatcatcaaccatgcatgtgaactgataagttctgataagttcagtgctcatgtggcaccctgaggaattaattaacaagatgatgctgattactctaaatcatagcagaagtgaagaacagcatgcatacctgaacatatcatgcatcatcaaccatgcatgtgaactgataagttcagtgctcatgtggcaccctgatccttggttcaaatatcaggaatcaattaacaagatgatgctgattactctaaatcatagcagaagggaagaacagcatggagtttaagccagagaatatgcatgggtgcaatttgcaggagtgaccactttcagatttgttcagaatttatagttctctagtcgacaagtgaccaagcacaatgatgagatattcgtagagttgtcctgaaggaagaactgcacgtttaatcctgaactgttattgtaccaacttatgtgatggccccggcactgtttacacaactaactggagacattttaggcagtattatgggacagtattagttgcaatgtgaagaaacattgatcagcactgaccagaaatccgagggtacactggtacaccaaacaaacgaaataaatgacgatcaagtacaattatgtgctacttgcaaaatgaagaagttagctcttaacactgcaaatgacagtgctaaagatggcacatgtgatccattgattgagaggatagtagaaaatattgagaaataaaaagagggactgctagaagattttttttttaaaaaaagaaagaaaccttcaagtgcagtcagataatgagatctgacaaatatagatgtatcagaaattcagagataaaaccaagaagtgaagagcactccatcagctaaaaattccacagaagatttattaacaataaatggtagatggaaatgaaaggtgaaaaaacgtagacctgaactttgccatcacaattttctagttacttaattcatcaattttaggtcatggtgatgaaacgatgagataatctgtgatagctatcttgctcatttgaagagccgttacgtgaccgaaggtgtatagtgattaccagtactgtgacttatatatattgccgtataatagtctcctcattacctgtcaactcatcagtgattgccaaaatgagttatactcttatattgaggaaatcttctcctttttttttgacttgaaaggaaagcttctcttttgtcagtttatatagaacatgtgcgattcggtggagataaacacacgagtatttacgttggaaaaaatgtctgttttctaacaataaaattttatgaaaaatatataaaaaatcaaccataaactcaaagccagaagctaatcaatcatgcatggacaattgaacttgcctcagtttaattataccaaaatttatgtatgtcccaaacactctacagtacactcgataatttcttatagactatattaactttttacgtgaacgcgtaaaaaaattacacattaatttgcagactatattaacatatggttccaaccttgctcggtaacaccaagtcagtgacatatcaccaattcaccaaaagctcactctagacgttgaaaaatcaagttttgattattcgtgatcgaatagcttctgatttcgatgttcaggactataaattctgcctcctttataatattgaataaaatcttctagatagaagtaggtacaaataggtatgctgatgcaagtaaagtcgtatcgatttgaaatacgatggttcatgagagatatgataagttttttgcacttatatacgaattttaaatatgcattattacatttttgaatataatatatacacacgtctctatatatcatctgtacacgcgagcaattgtgacgtattaattgttgtattttccatacgagaagatgcatatgcttacagatgaaggaagaaatcaacaccttcttgtaagtttctttagaaataccttttttttgtaagtgtatgaacggattgaagatgcattgtgtgatcaacaaaattcgaactcccgtcatgctttcaaagtgtccacaatacacgtaatacatacaccatgagaaaatttacccccaaacaattaaatatgatcatgcatcgcatatagatacctcaatatctcataccatcaatatcggtttggaagcgaactgagttcagttgtagtttgactctccgactcatcatgggcgctagcatttacaaataattattctctccatctatttttgatagtcatatttcatcttagcacacatactaaggataagtaattttacttatcatctatttaaacatgctactagttattcctcgtaaacaagcgattcattaatatttatatttctcaatgtccatttagccaatcttgtgtggaagaatagagagtcacgcattaaatccgagaaagtcattaagatgataggttgttggattgaaatgtgcctatcaaaaataagttttttcagatttggaaatataactatcaaaagtagatggagggagtaatatttatcaacaatgaagactcataggtgcttatgggggtaggataagggtaagatgcacgtgcttatacatgagtgtgtatttgtattgtttgtgtttcttaaaaatatatatacacttttttttcgaaatacgatacactatattatacatattggtttgggaaaaaaaatgcagatcacgagaagatatcaacctgtcgtgcattgatgatggccacacttgtacctggttttcgatcttgatcattaatcttgccaccttctcattcacacagaagaacatctgtttcagaagaaaagtagttcagggcaaacaccacattcagagaaacataaggtgtgtttaattatttttattgacgtacaaagcttgctggacttcatgtgaagtcgacggggcctttccatatgagatccatataagcatgtgattattataccacacatcgttccatctcaatcttccaaaaatcaaacggtgaaaggataccctaagtcgttccctactttagtaggtactagatagctagcaatcttactttattagcttcattacccccttaatcatgccatctgcaaagttggagtgccagttaatcaaaacaataccatttttttttgccagaaacacaatactatttattatgatggttgaaaatttttgctccgcttgaaaaaatagaaacacctagtctacgaaaattcctagtagtgtattcaacttgatgaagcttcaaccatctacgcgttaatggattcacctaattaaatcaggctaaaggactcctttaggatgcggaaattttcacattacaagcattgtacaatttttacaagagtcaactcgattccgtggagaccagaaaaaaaatcccgtgttctagaggagtatgcgtgtgttcttttatgttgcatagctgaatgatttatgataagtgttcaagggtacaaatgaatgaattaactattataatattagaaaattatttaaaatagtattttaagaaatccatatatataaagcttatgtaaaaattgtaccatttagaaactcgaaagcgtgcaatatttatctatgcatatttatgacaatttatatatatgagtgcatgtgtatcttttgtgctgaatgattatttatcataattaagtgtagaaataaacaaaataactattcacatatagatttttttttagaaaattgcaccatttagtaacttagaaaacacgcatatttatccattcatgcaaatcattcattggaactcaggaagtgaatttcggctatctattaagtgactgattattttcttatctatcaatcactttttaaacactaatcaatatcaacaattggtcttatgtttttctttcttgtgtgaagcatgttctaacctaaaagttaaaacttaaaaggatatactacctccattttaaaatgtataacattgttgacttttcgtataacgtttgaccattcgttttatttagaaatttggtgtaaatatgcaaagttataagttaagactataatttatttaatgataaaacaagtcacaacaaaataaattatgtttatttaatttttattaagacggatgatcaaacgttatgcaaaaagtcagcagcgtcatacattttaaaatggaggaattatatgttttgatgtaacttcttgcccatatgtaactagaaattgctatttatataagtaaataatacatccagattaatccaaaaaaaataaaaacaaaccaaactaaaagttccgctttctttttactgaagttacaatttgcaagtttagttgactaaaaaaatcgaccctgataaatagagctgaatttctttttcttcagcaaaattcctaaaagaaaattcagcaaaatcaagagcagccttggtcggttggccacacaaaccgctttctttcttctgttttttttttcttctccgaggtggactctgcagcgcacgtaggtacacagacacaaggctgccgcatgtatgcgtcatgtggcagccagagggagaggaacaaggcaccaaaccaaccatggaatggaagcaaaacactcctaacaatttggcgccctctctgtctctctctctctctctccccccttctttttgtgagaagcctcctcccacgttttcccgtctccttaactgcttctctccttcctctcctacacaactgtggtggttgcagcaagaaagagagagagggtctgaaggcagcaagaattcagtagcattccagctgccgtgggagagagggcaagagagcaggagaaagaattccagcggcggcggcggcggcggcggtcgtcggagaggtggagagatggatgtggagggtggtggtggtggtggtggtggcgcgccgcccagggggaggaattcttgggtaatcaattaagctttggttcttggtttggttctttggtctttcagttttgtgtttgatttggttggtttggtgcattttgtttgcaagtaattttgcagtgttactgcggattctgggatgagttactttgggtgcgggcgctatctcaagttcctcagggttaaattttgtagattttctgcattttgttctgaaaaaaactgaactttttcgaagtctatggcgctacaatttcgcttgaatctacttctgtctgactaggtgtttctgtgtatgcatgagacagagaatgctctgaagctaaggttgtagcggcgcacttcttttcagttctgaatttaggtggtaaagttggttgttttcagttaattaattttgcatcagtccagctcattagttgcagtcttgcagagtgatatgttatgctttctgaatctgataaggggaatccatgagttcaggaatcaatagattccatagacgagatggtatcacgaaatctttgtaatgcactgtaattttcctctttggtaaacgggtccattttcttacatatacacgatttttaaacgtagccatcaggtcacttttgatggtcagattggacatttcctttcaacttagtactagttactactacttcagagtttgagattttttctgtttactttgaatactatcttgttgcctatttcaagttactctttctagatcatcaattttggccagcagtaaaattcaaagtagtcaagtcgatactactgattagtaattacgtcatcaaatggtcacggacacgaaagcatgacacggtctgtgtttgctagggatggcagaaaggaacacttctactggcatatcagagcttcggagttgtgtatggcgatctctgcatctcacccgtgtacgtgtacaagaacaccttctccggaaaattgcgtcttcatgaggaggatgaagagatccttggggtattatctctggtcttctggagccttactcttatacctctcctcaagtacatcatccttgttctaggagcagatgacaatggagaaggtgatttcaaaaatccgcgtgtttttcgccgtattaataatttcaatgtgcatttagttaaatatatgccatttttgtcttgcaaatgtgccatgtatgtttgcaggtggcacatttgctctgtactcattgctgtgcaggaattccaagatgggacttctgaacaacatgcgtgcaaaccatggttctctgtcggcatacaacaaggaggaaccttgtaaggagtcgaggaacagcatgctcatcaaggccttcttcgagaagcattactcgcttcgtgttgtgctgctgctgttcgttctgatgggtactagcatggtaattggggatggtgtcttgaccccaacaatgtcaggtactgaactctgaaagactgaaactgaagatttgtggaagttgtatgctcaaggcacaaattttgctgcttgatcatttttttagaaattttagataatggaagtgttttataaaccaaaaatatatatgagcatattttgtatacaattgacaaacgtatatgatagagtaaggaactttgttttttaatttcttttttttaaaaaaaaaacagagagtaaggaattcttggggaacatttaaattgctttaacatcatcatgttttgtttgtgactgaagagggtggcatgttcttttctgcagtgttggcggcagtttctgggctcagaattaagtttccagaactacatgaaagtaagcagctgatatattggcttgtctcataaaggtttactggtcactcctcttagcagcacacatttaaattactcttattctcaattctttttcttcttaatgtctacttgcaccagaaaatacagctgatctgctcctgttacacttctctgcagattacactgtgctccttgcttgtgtcattttaattgggctttttgcattgcaacactatggaacacgccgtgtcggattcctattcgcaccaatcttgatttcctggctcacttgcattggtgggattggcatatataacatcataaagtggaaccctagtgtcatccgtgctctgtccccgtattacatatacaacttcttcaggaaggctggcaaggatggctggagctcactaggagggattgttctttgccttacaggttcacatatttttatccttttagttttggtttatcacttgttttcgttgtaacatgcttaattatagccgtagattttcaggtgctgaagccatgtttgctgatctggggcatttctcaaagctttcactgagggtaatatgattttcagtggtgaattggtgatagtttcagtcttggtagctgaaagagtacacttttttttttttgctaagaattagggaaagaaatctttacacttatttttttgttttgccatgacagcttggattcacaattgttgtatatccttgcttagttctggcttacatgggtgaggctgcatacctgtccaaacatagggaggatctccaaagtagcttttacaaagctcttccaggtgagatgttaattctcttgccagattgcttcaggttttccgctgctttttttttctcatcatcttttccaacagagagtacattgattcttgtaatattatatttatcaatcccttcagagtttagtatatataatatcagtagaatttgtgcatggcccatgtaaagcttaacacaagatcagggaaaatctggcccggcccagttatgccccaaaggtgttatgggccatgttcgggcagtattaagcacaaattcagccctaaacaaattcttctaatttcacggtacaaattcagtgtgtggtcaggactgaaacagaaggcctgagaaacttgggccaggaattttggcctgattccaatttccgtccatcgtttcgtctgttaatgaagtgcacatcattcttgtataactcactttcccttgtggatctgtggttttctattacttatattaccaaaaagaaatagtgtataaaggaagtagaaggatgtgaatttgtttgtgaaaggttaatgggcctttcaaggtcttagtgtatggaataactcaggaaactacaaatcggatgtccgattctcttaaaaaaaattgggtggttaaatatttcagttgaccaccagtgaaacattaagttatgcgtgatgaaaaaaacagccattgattttttttttgtgtgtgaaacatagtgaaaacacacgtttaaacatgtcgttatcgtgtatgaaacattgagttttaacagttcgaaacatatgttttctttcatcagaatataatctttgtgatatcttactgtgtgatcggatcataagtcagacaagtaatttaggagaaaaaaatatgttgaaaatcacaaaatacatacatgtatggatgaagtgaagagaacaactagtagactccaacattaagaatttattttcttggcaaatttatttaagtttgaaagctaacataaattcaaagagaattggtttaaagctaagcatcatttttgtcgagtataaacatgcaatatttatatcacctttcattaagaaaaatattcaaaaccatgactcgctatgagcagtagattttaatatttagattgaataattagcatgaaaactggtatgtgtgctaaaaggcaacaactttcgtgctagtgcacttaatccgttgcttttcagaagaacccgcaaatgtaactgaaatataagacctaaatactaaaccaactgaaccacaaatatgcactatattggatgatagccctagccgccgactccgacagttgagaagtgacaaacctttcgattgataatcagattatctgatgaaggtgtgagcataacaactcactcatgaagattactacttggagagataggcaagccttcagctaattgaatactcaacagtcaaaatgctattcgagtaaaaggaatttgttgaagacaccctaaggccttaatggtccctcatctgcctcgagcacataaggtagggaccagaaagttatacacgtagtccacaggttatttgtaaacctaatactatttaacgtaggaaaatatctatattaccctcaagtcataggccattgttgaggggatgttgtatgtaatttcttttgtaccctatctagattaattagaaaaccaccttagtgacaatgtaaagggggactatctttagaggaaaaaagttgtaacaagcttgtggtaccacacttactccccatcgaaggttaggggccttcaactcttgggccccttactctagaactcggaagtagacaggagacacacatattgtatatagtagtcctataatatttttcaagaaaaactagcggtacaacagttgtagtgaacgtatatatgtttaactagatgaataccccgtctcgttgctacgggaaattaaattgtataatatgtacaaataagatgcaatatattttctaaaccaaaacaaaatgacttcctatatatgttttatctaatctacacatggttgcaatataatgcaaggtgaacatattttatgtaattgatacttataaattttgagcctaaaaaaaattgatattgtatggtttcatgggtgaagaaaaaataaactatttgtaccatagatctatcatgctagggctaaaaataattgagatgatgtggcttaatgagagaagagaggaataacattaacaatacttattaacggggatgaactatataagtacataggattacatttccttctaatgcagcaattgaagttattcgacaccttctagttattttccagctagtgttttacatatctgtgtatgtttccttttgctacatatatatgcagaccgtgtgttttggccagtgttgttcattgcaacgttagccacagctgttgggagccaagcgatcatctcagctacattttccatcataagccagtgtagggctcttggttgtttcccgcgaataaaggtggtgcacacatcaagccatgtccatggtcagatctacatcccagaggtgaactgggtgctcatgtccctctgcttggccgtcacgattggattccgagacaccgagatgattggcaacgcctatggtaactagcacatcatttgcttcttcttttaaaccagactcttacacttgaggtaggatttggttaaacttttaaaactttgattaacaatactttcttagatgtttagtttataaagacaaaaatggtatacacaaattttccttgagaaaaacactatatactaatatcgtaaccttgttatattttataacttattccaatataaaatttatagtcaaatatttaattaaaagttgatcgaatcttgtcctttaaggctacaaagagtaaatttaggtgactgataaatagtaacaaccagtatatcaacacccattaattacttgtgttaagataaattttatggtccgtaagatatatcaagagataaattttgataccttctgataccggatatatcaagaggtaataaattttgcattagaaaatatgaccatacctccagataccttttcaataaccgtaaaatcactcagttatcttgtgttaaaatttgcaggacttgcagtgatcttggtgatgtgcgcaacgacatgcctgatgttcctggtgatcaccaccgtgtggaaccggtgggtggtgtgggcggcggccttcaccgtcgtcttcggctccgtcgagctcctctacctatcggcgtgcctcgccaaggtcccccatggcggctggctcccgctcctcctctccctcaccacgctgctggtgatgtccacgtggcactacggcaccgccatgaagcagcagcacgaggtccagaacaaggtctgcctggaccacttcctcggcctcagctccggcatcggcctcgtccgcgtccccggcgtcggcttcgtctactccagcaccaccaatggcgtcccccccatgttcgcccacttcgtcaccaacttcccggccttccaccgggtcctcatcttcgtctcgctgcagacgctcgccgtgcccaaggtctcgccggaggagaggttcttggtcggcaggatcggctcgccggcgaaccgcctgttccggtgcatcgtccggtatgggtacaaggagggcaggtgggaccacttcaacttcgagaaccaactgctgatgaaggtcgtcgagttcctccgccaccaggacggcagcggcggaggcggcggcgatcggatgtccgccgccgcctccggcgaggacgaggccatgtcggtcatccccgccacgtcgtcctccggcggaagcaatcagcacgcctttgacgccgggacgacgacgagctcgtgcgagatcgacgccaccgcaggcggcggcggcaggaggaaggtacggttcgacaacgacggcggcggcggcggcgaggaggaggaggaggcggcggaggtgaaggagctgatggaggagaaggaggccggcgtgtcgtacatgatcgggcacacgtgcgtgttcgcgcacgagtcatcgtcggcggtgaag

SEQ ID NO: 58250 - DNA, 3490 bp, Oryza sativa
aagttcaattgttgctgcctctggagctcctggacgtgttgggcaagcattcataatgtaacaggagagccctggagctcaggtacttccccccaaatttttcattgctaatttcaatagagtcaactgtcgaggcaagctgttcccataatttgccggtttcaatgaggattaaatgtcttttattgacattaaagtttcgtaaaaattgaaccctattattagaaattcatatgcaacttaaattgacattgagcacaaaaattctagtcttcaatgcaacctcttttatgaacagaacaccttgggaaaaacactctcattggatgcttttaaagggaagaaaactccacacaaataattgttcacttaggtgcctaaaaattttgtcccctgagtgcttttaccattttatgttagtttggtccaagtgcaaaatttgttccttaaagtatccttgttgtactgcaaacatttattctactacttaaatttgaggttcttttctctttgaaggcttttgtaacaattaattggaatgaacgtttggagcgttgattgcaggtcgtagaacgtttggaacactgtaacatggaatgaagaagctatgatgttttagaaaacatatgagaagagtaagtatccatcctataattcacctcattcttacacctacaatactcattcatcaaatccaacgactcataatcatcgaatccaacggatcacatcatcccacgtttcccctcatcctcaccttggacccgcacgctccccctcccctaatctctctcgcacaccagacaccaccatcgccgcatcgcatcgccgcacaccagacgttgccgccatcgcctcgcatcgccgaacctccatcgctccccctccctcccactccatcgccggatcggattccctgcccctcaccgatttcattcaaaatgctgacgctggatcggcgggaatccgcccgcgccctctctgccaccggaatgccatcaccacgcctcgccgctctcctccgacaacgtgacgccgctgccgcctcaagcacctccgccagtgatccatactcgcgctgccgatgccggatcggcgggaatcgtgcacgcatgggctaggggaggtgctcgtgtgcgcacgggccgtctccatcgatcgatcgatcaacctgcccgcttgctcaaccaatttgattaacaccaattctgaatctctgatcatgcaagcgcaggctgggatggtggagcagcctccacagatccgttctgtcaggcatcttggcttacgggtgaactacacagcgatggtccacatgttgccccgccagatagagcagatcctgaagagtttcccacgtttaaaatcactgaaaatcctggtaataccaatgaacagccaatcttatccaaatccaatcaattgttgcataattctgaatttgctgcttattaattgctttgcactgatatgtctgaattctgatttttctggttgagtcgtggtctgaattctgaattcgctgtcaattcctctgcacaaaagtgtgtgcattttgattttctgactgagttgtggtctgaattctgaatttgctgctaattagtgatacttctggattctgattattctgattgagttgtggtctgaattctaaatttgctgtcaattgctctgcactaatttgtactatgcattttgattttctgattgagttgtgttgtgccctatttcagagatgcgatgacgttacaggtatgcaaatgaaatcgattgcccgcttgctcaaccaatttgattaacaccaattctgaatctctgatcatgcaacggcagatccgttctgtcaggcatcttggcttacgggtgaactacacagcgatggcatcaatttgcagttgacgtgaacaatcggataagtatatattcttgtgctttctaaattatgaaatggaatatattgttcttttgtgaaatttgatttatctcataaaaaatgtctgtcctcagatatggattggctatttactattgggcaagaagtgtttggtgctttgcatccaacagccatatgaggctcagtctcttggtatgaattcatcagataactcttctcttcgtaatattcatctttcaaaatatcatttcaggatcacgtcaattttttcaccattgatcttggcatagtatgaactggacagactttggtccattcccctggatgtatgcaatatttattccatttcaggaatgtacataagtgcatcatactttgtatttaacagacattgtggctaatggatgatgatataaacacctttgtatgcattttaacgaaaaaccatcctttgaaagctttttaatggaagttctaaaaggttttaattcttgtttattgtttattgatggagagaacaatttctatcttcttaagtagatggctcaggacttggtttccaatgttacttgaaaatgatactgcaagctaatcggatcaagttttgttatattgcaggaggctagcattatccaatctgctgctttgactgcatggcgtgctttatacgacaactgcaggtgaacgcgattcgacttgtacccctgattttgtctggcatcttgttccaccagatcggctgcaatgcctcccgtcaaggagttgaggaagagccacagcaacaccccctaagccggttgccctgattgtgtcccgtccctgcaaagtgctgggtacccattttgctgcttcttttagaagaaaatcgttgtttggtttatagtgtgtcccctttgttcccctttatttcttattgatgaatggaactcattggatttagtttggatgcaactgcttgtcgataatgaggtagcaaactctcctgcatcaatacattggctctctatgtggacctaatgaggtagcaaactctcctgcatcaatacattggctctctatgtggaccgtgcatttgttttacttagtacttacgagatatatgttgttttcttttttaagttgatcttcccattctattacagtaaagtccaagttcttaatttcaaatgagatgtgaccttctgctctgttttatggttgcatgtatttcaactttgtaccaatgcatgctactaaatttttatgctttttctagcagaataaaatcctataaactggtaaataatttatgggcttcttctgcattataatggaatgcctaggctgtaaggaaattaagcactttccagtatttaggcacacatatacggatttttagattaatatatcaatcttccgtgtatctcttatttattaacttctgcacatctctacccaaagatatatcatatatctcatacattgactaatgtgatcattggtgtgtaatgtgatcatttttgtctacttaaaggaagtccaggttcattattccaaattcattctagaactacagaccaatgtttctgaaagtagtttcaaatttaagcttct

SEQ ID NO: 58251 - DNA, 9790 bp, Oryza sativa
aaccaccatgtacttgtacttaactatagagctcaaataaacatcaaattagtactactgtccaatggatgattatataattgttgcaatgctattgaaactgttacatgaactaattagagtgtttttgtcatcaattcttgaacagggtagtacaacaagcttgtgttggagtattatcctcagcaaactgcatggaaaactgatggatggtgtaccagaatcaacaacaaactccattggaactttccattctagcattatagaatatgaaattgagaacaatgggatcataactgcttatactcatagtactcagaaacactctgtactgaagagatactctagtagttactgcttactcatcgtactgagacactccgtactcatcctactcattgtcaggagatacactaataggaacattactgcctactcatcctactcggaaacactctatcctcagtaggtacgctaataggagcggtactacttactcatcttactcagaaatacttacacatagatgatgcaaaaggtcatggggctgtatggggcataacaatttgctcgtcgccacgaacactcaagtcaaatgatggaaaagggcgtcatgggaatgggagtaagatgttggcaaacagtaggttcaggatgactgatgcgaagtcatcgaggagaccctgccgcgccctcaccgaacgaagtcggtccccgatgtggtcagcaagtcggttgagccggagcacgaaggcggcgaagatgtcgacggatggccccccgatctcgccagcgagctcgatgatggtagcgccgcgtccacgaaggagagccacggcctgggcatcgcgcacgtctgacctgatccttggcaagttcacctctgcgatgcggttgacgatgacgtacaggtcggcgagggcacgcagcctggtgaagttggcgacgcgccactggtaggcctcggtcatgtgcctcagtatggccgccatggcgacggcgtcgccgaaggtgcacgaggagacgatgacgttgatctgggaccggtgaggccccgccgatctccttcaccagcacctcgagctgtggcaaactggtgacctcgaaggcggtggtcgccattgcgatggcggaggagggatgggtttagggttttagcagatcggaagagggaggagggggggaggggggggattgcgtgcggattgcggcggtttggaaagggggggtgttatagcgaggggcggaaggggagcgagcgccaaattcaaaatttccgaaggcgcggtctccatataccaaaatggatttgtgccgaggcttgcgggagacgagcagctcggctgggcccgagagaggaggagaaaggaattagagcaaggttaatacagcatatttgttggctataagtcttttttttagctttttttacccacacatacaataattagctattacaattaatatagagcctacttgtctctctcacagaattttttggttcttttgttcaagccggttgtaagtttacatcccgtttctcctctctctctctctcttctcttctctctttcaccttagggtccctttgaatcgtaggaatgaaaaaacagaggaataggaaaaacacaggattctgacaggaatacaattgtaaaacagaggattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggcccttagcatttagtcgacttacagcctactattatactttctcttataggggtgtgtttggcgcctctttcccatcccttttcctcgttttccgtgcgcacgcttttcaaattgttaaacgatgcgtttttttttaaaaaaaaatatgaaagttgcttaaaaaatcaaattaatctattttcgaaaaaaaatagctaatacttaattaatcacgtgctaatggaccgctctattttccgtgagtacttttttcgaatgggaacatcaaatggcgaacacatgtgttctttcatatgtttcccaacccctctcgctcatgttccgtgtgcacgcttttcaaactgctaaacggtgcgtttttttacaaaaactttctatacgaaagttgcttaaaaaatcataatgatctatttttgaaaaaaaagctaatacttaattaatcacacgttaatgaaccgctccgttttcgaggatttggttcctagctcaggagaacaaacgcaatctaagtccactttgaatccctcaatatatgtccaaattttattcgcggagaggaagggcggtggccggccggcagaacagccggtgaatccatccttccctccatttctttgctagcttccgccattgtttcttggatttttcccccttttcatttctgcagctcacacccgctcaaattcttcacaatccgtaaagtgtgtgtgaattcttgcatattagatgctgaattgctactaatagcctgcgtcgactcgtaaatttatgttttttttttggaacagatgggccgtggccgcagtacagctatgggatggtcatcctgctgcaggccaaccacattctacgttaacaaggtgccaaccacccatcttatataggggtggccatttggtctaaccgaaaattttggttttgatcttcgtttttttccatttcggtctttgaaaagtgaaactgaatttcaacaaaaaatgtcagcaccgacaaattcggtctcggtctaggtcctgaccgaaatacagcaacattttcataaatgcaaagaaataatggaaattttcaacacgaaaatcacaaaaaaaatcataagcacgtatgagtaaatactcttattagttgtatgtctaaaagaagtaggatgtgaaaattagagtttaatcctattgaacttagtatattgtaggttgcatttagatttttttttaattcggtcttttcggttaaccgaggagactaaccgaattgaccgaacaaaattcaatctttcactgcctacgactgaattaatgaccgaatttatcagtcttagtcttttcggttcggtctttttctgcccaccctagatcttatctttagaattggatattgggatgtggtcattttctcccaattttctagcttcttgctgcaagattggcataccaatttggttgtgtaattagggtgtgtttagttcacgtcaaaattgaaagtttgattgaaattaaaacgatgtgacggaaaatttggaagtttgtgtgtggccggtgtagttcccaactttttcttcaaacttcaacttttccatcacatcaaaattttcctacacacataaacttccaacttttccgtcacatcgttccagttttaattttagagtgaattaaacacacccatgtagaaaagttttgatgtgataaaaaagttaaaagtttgaaaaaaatattaggaactaaaccatgctttatctggttttaccttgtgacagatctcgagattgaagacgatactcgagagtactggccgtccttgtactgcggctctttctcgacctgctttggtgggaaaagatctgttgagatggacgctctgttccaaaacctgctcctcctccctcaaatttagggtgtgtttagttcacgctaaaattaaaagtttggttgaaattggaacgatatggtggaaaagttggaagtttgtgtgtgtagaaaaattttgatgtgatggaaaagttgaaagtttgaagaaaatgtttagaactaaactaggccttacacaattacacctacccctcaaattccaaatccggttgagaacagccggcaaaacttggaggagggggcaaggtggcagaccccaagggcgacctcgccgccaccgacaaggaccgggcctcctctgagaagaaccgccgccgtcatcaccgtgtcgtctccttcgcccccgctggtaaccgcaatgcagaccctctttgacaccagcagggaggtcttccaggattcattgccgggcttcgtgccgccgccctaaaccgttgcgctactcgctgcccttctccttctacgcgcgcacttgccggccagcgagggagatcgaggaggaaggaaggatggctggcaggccgagggagatccaatgcagttatactagagactgcaacttaagcagttggaattatttttcatcgtcggatcgaaatgatcaacggttgtaatctgtgccacgtcagttctaaacagtaatgctacagtgctcgctacaggagacatccagctacagtgttttgccaaatagtgcctaggaaaatcttgacggctactttccaatccaacgatgcctatgtgaccgcttaatatagccactgcaggtgatctcaattccaggccgggaccggagagagagaagaggaggcgccgacgcaccgtggtggagatagagagcagggtaggacccactgatatgtgggtcccactattttttagttttatatgactgacatgtgggcccacattcttttaatttatatattttatttcaagtgccacatcaccgccacgtagaatgatgaccaagtcaaaccagccatgtagacgtcacgtctaccaaaaccgctatccaaactaccatgtatttcttttgcaccagttttgatagttgaaggacccattgtatctggtattgcggttcaaagataaaaattgaatttgctgtcaagttaagggatctcaaatgaacttatttcaaccgcaataccacatatcccgacccctcaactaataaaaccgatacaattgaactccttaaatggtgagattggttttcgtaaacgtggcacgttgacttggtcaatctatgctagtcaccaaaataaaagtgagccccgtatagctaggtgtgtttagttcccgaaaaaagttgaaagtttaaagaaagttgggagtttggaaaaaaaagttgaaagtctatgtgtataggaaaatttttgatgtgatatgatgtgatggaaagttgggaacagatgaaaaactaaacatggccctaagtgactagggaaaaacgtaaagcccacttgtcagtccccttctctcctctctatttttttccctaacaactccacgctcggcgcaactcacgtctcacctcgttggccttgcactggcattgccgcagccggagaagagggagggtctgttgcagcactggacgacgtagttggcgggcaaaaaaccgaatgctatagcaacgacacgaagcagaagagcggacgcgtccgcgcgtgcaaggaggcgtgaggtgggcaattggtcattgggggccgatcgtcttgccatggcaggcgaacatggccgctgctgccatgtgagggagtgcactgtggagagaaaatggaggtaccgagtatgaggatgatatatgggacctgctttagttttgttgccacgtaaacgcttagttagtatgagtgaatcagattaactttgctatgtcagtgaaactaatcacctatactatcggagaacctaatttaacctagctttgtatatgttggggagttaaagatttgtagtatacggtttagagatgtattttaaactcgacgtcaacactagtgatctaaattgtagtactactagtacttatcactagtgatcccatcggtttatgcagcatcgcgcttctgccgctgcccgaccctattacccaagcccatcatagcccaaaaaacccagaacaacatctcctggacggcccatgcccgactggcttagggtttggtacttgtgtcctgcctccacatcagcttcagagaccgcgccggcgccgggatgtattcctcacctcccaagggtttaaagcggcgcagtcgatttctcgctcgttcgatccgagcggggtatcgtcgtggttatggggaagctgctggacctgaagcggctcatgtccgtgccgaaggagcggaatcgtcgtcggcggcagcggcaaatccgagcccgcagtaaggcctccctcagtcgttctgcctctctagtctggcatctgtaatttgtttagaatatcactgctccttccattgtcttgtgccgttgcacagcactcggcatcgctattttgcaattgggatgcttttcagcaattttttagtgttgtttacagtttatttttcggcatacagattattttggatttaactaaaccaatgagctggatacattaatgttcatttcgattgtcagcatccactaaaaacatagacttcggtatccaaagataacatggaagcccatgcatagtttcggcagtataggggtaaatatcgggtaaacgagtgcaaatgtgcaatgtctcaactgggtagaacatatgaagtgcccatatgtacataccctaaatcttaagaaaatttggtcggccgcttctttggtcagcccagccaaaaagaaaaaaaaaagaaaaagaaggaagaagtagtgcgtgcccataaaactatattgcttccaatataagcaggacccctctaacctatcgtctaaagaggtgtaaaacaaaatatggtagacttgcagtattttcctgttgcaaaaggagatcactccctgctttgaaagcaaataaggttttcggcatagaagcaactactgggaacaccggcttacatagagagctcaaacaacgttctcaccctagccaatggacagcagtccaaaaacaaagaggaaaataactaaaatggtaaactaaaagacaagtgagctgaaaagcaagtttagatcttggttatgaactcatccattttagttatctcctctggtctgaacaacacccaccagaactacacgaagaaaagatttatcaactacgggactgtctggaagcactatctgctgaggcgccgtggccgcgctttgctgcagcaacagcggctgcagaagccaatagaaagcacgctgttcccacaatagattatttttttagggaatacgctagaagcatatctttgtattaagaggaataaaaattatttacaagaaagattgaaggggacggggtactggaatgcaacaaggacttaggctacaatctcacaaccaaattgaacgacctagggaccctagaaactagagaccaagcgccggaatcgccgcctttgccaggcaccacagctctgcctccgcggccatagctcttgcaatttccgcccagggctgccgctggagattgaacaccaggttattcctctctttccagatcatccatgctaccaaggtcgcaatggtgtcgaatccccgacaccgatccttcacgactttcttcctgctaaggcagagccactgatggaaggaggcctcttgcaggggtaggcaatccagttgattgattgccgagagtgcccaccaccagagttgacgggattcagagcagccaaccaagatgtgatctatacaatagattattttatacagcagaaattcaacgttgcagccgaacggctgtgcagttcagctgcagcccaaaccgctgcagtttaggtcttccaacggtcaatatgtcagctgaggaagttattagcaatttctaataagccaagaaagctgtaaacagtacaggatcaaagaatataatgatccacacccccagttcaaccaagaagctaagaattcagaaatatttgtaggaatattcaattttgtgccatggtaacgcctctttcaaacagcaccaagagcaacgagcaatgtgacattgaaagaaaacatggtacacactttctacgcaattgcattggatgcaattaacatcccctttccaattttttttcttcagctgtagatctatcttgataaagaagccaaacggagatttttacttcgagaggaatttcgcatttccacaatctgcacatcctccaactgatgacaccccagagaatgatcctatcatataaagacaaggcttagttattttcagattatttacctgattgttgaaacggattatttgccccacgcttcgaaaaatacattttctcgaaaaactttcttctcttgtattgcttcgaccacttttttaaagttatttgttaagtttatttatcagaatatttaatttatccctataatcaagtagataatcctcatcaataatctgtttcaaaatgaccttagtggtgtagacttgctctttttttttcataataagaaccaatgctcaagggaagtttttttaatggagacaaattggatttaaagtcactagagttttttttttcaaaaaaatcagacaaaaggtaaccaaattgatttgtggtgtgcacttgtgtgcttgatttaattgtttgcttgtatttgtgtctgtacataaccatgcatgatctattgtagatggttcaattgattcagtggctaaaagaaagggatcactctgccaacaagttgcaaattctgatggcgagagaagaacaagatattcagggcctaaccttccagaggtatgacaccaaatgctgataatgaagctcttatattagagtaaggtatctacgagtctatgactgctataagtagcctctaactgcgcactctcgtggtcctatggtacctatatcaaattgtatgaacaggtctttagtgctgcaattttctacagttctgcatgaatagcttttctctattctagctgttacaacttaaccactcccatagaaaattgtctgtgatgggtcttagatccccttgatccttgttgaagcagttgaatttttagagcttccctcccttataatctggttccggtacttgtttttctgtgtattctgtggtctaagatccagtttttcgtcatcatccatcaagtgcatgcctacctggttgagtttaaccaacttccgaagctactagctagtcaaatacgctggtatctatgaaggggccttctattgcttttcaggtcaatatgcattccattattatttgttcactcttgctactcccatattctgagtgctcatgtctactgataatgtggttactgtttccgtttcatccaactccttctcatcttcaaagaaaattatatagtaaatatagttaatcttaacctgttaaccgtaatctaaactgtttgtaccatcaattcataaaccacggagatatgtgaatgtgatgttgaataacctttgcagatagagtagaccaatacagtagcagctccatcatagtttcactccaatcagtaactgtattttttttctcaagcataagaattctgagatcatctttggctccaatgcatgataagctttactttaaccactattaggtcacttgcaagcacttgccttcatactggcccttgcttcctatgaaggtacaatctaataatattagttggtttgtaggttagctataatccaaacctggcaaggcaccaaacaagttctattttcctttattttcgaacaacgcaggagagctgcatgccattccattaagtagaaggaaagaaatacaaagttaggacaagccaacgtagcaagtcccattaagtccattttcctcaaagtaacagctttactcaacttcttat

SEQ ID NO: 58252 - DNA, 6293 bp, Oryza sativa
  unsure (1)..(6293): unsure at all n locations
agttgtatcctccttccctctcggtgaagtagtgagaaacaaagatgttatcggccgcattgtgaaatgggtagtcgagctaagccaatttgannnnnnnnnnnnnnnnnnnnnnnnnnncaagaccaggtacttgccgacatcgtagccgattggactatacctgataacaggtcagacaaccaaatcgacaccgaaacgtggataatggcgttcgacggcgcactcaacagccaaggagcggggccaggattcatcttgacatcaccttcgggagatcaattcaagcatgcaattcacctcaacttcaaggcaaccaataacacagccgagtacgaaggactactcgccgggataagagctacagctgcactcagagttaggcgactgattgtgaaaggggattccgaactagtcgcgaaccaggtgcataaagattacaagtaatctagccccgagttatccaagtatctcgcaaaagtcaggaagccggaaaaaaggttcgatgggatcgaggtccgacatgtataccgcaaagacaacatcgaaccggatgatctagcacggcgtgcgtccagacgagagccacttgaacctggcacctttctggacgtcctgaccaggccatcagtgaaagaggcaagcggcgaagatagcccgatcgcccccaacatcagctcgggggctatagaggtagagcgcgccgttgccgatatcgagaccacagacgactggcgcaccccactcattaaattcataggcagcgaagagttgcccgaggacgacgcagaagccgagaaaatatcccgtaaagcaaaagtctattgtatgatcggcaacgatctatacaagaaggcaccaaacggggtactcctaaaatgcgtctcgtccgacgacggcagacacctcctcctcgacatacatgaagggatctatgggtcacatgccgccggtcggagattagtcggaaaagcttttcgacaagagttcttctggccaaccgcccttaaagatgcatgcgacatggttcagcggtgtgaagcctgtcaattccacagtaaacacataaggctaccagcgcaagcactccagactatccctctcacttggccgttctcgtgctgggggctagatatactcgggccattcccacgaggacagggcggctacaggttcctattcatggcaatcgacaaattcactaagtggattgaagtgacacccacgggggaaatcaaggctgacaacgccatcaaattcatcaaagggatattctacagattcggattgccccaccgtatcataacggacaacggctcccagttcatcagtgccaatttccaggattactacatcaggctgggagtcaagatctgcttcgcctcggtttctcacccttagagcaatggacaagtcaagagggcaaacgacatagtacaataaggaatcaagaccagcgtctacgacaggctcatatcacatgacaagaagtgggtcgaagaacttccatcagtactatgggccgtgcgtaccacaccgacaacgtccaacaaggagacaccattcttcctcgtgtacggctcagaggccatgctccccaccgagctacgacatcaaagtacacgagtacaggagtattccgatgaggatcaggagaagcagcgaaacaacgatgtgaatctactcgaggaacatcgcgaacgagttgccgttcgagcagccagctaccaacaggcccttcaccgttaccacgagaagcgcacccgagcacgcacgctttcgatcggcgactacgtcctccgacgggttcaaagccaagcagggcgaaacaagctctcacccaaatgggaaggaccgtacacgatcacacaagttctgcggccatgcgcattcaaaattgcagacggcgacggtcgcgagttggcaaattcctggaacattgatcaattacttaaattctatgtataagtcaatagtatccatacttgtaagacatcttacagcttcaataaagcgtattttcaggtccagaccacaatcaaagtgttccttcccgatgatcccttacccagatgacatctagcgttgaaacctatcctcatgtccctttacgccgtcttgacaaggcctccgaggaacctaagggaacttcggctggggacgcccagagccgataaggccttgtcggatcctgtagagacgaaagaccatgtaagatctggtcgtgtaagagttctcgccgtgcgtattaaccaagccgtgtaattggaaataaactttccaacttcacggttgggggctaggatcagtgcttgttcaatcgaggcaggtcaaaggtccaagagccttatcttccgagaagaattctctgataacaaggctgggggctaggaagagtgtataactcaaacgactgattgaagtcgcgaagtgagaagacactcatacacgctacatccagagtaagaaagcttagttagatagatttcttttctatttcacaagtactttttacaattccataaaaatccaaaattatattacacattttccctaatatatttgtcacaggacacagagactaccaggaaggccaacgccagtccatggactggaagaccttctccgccagcggcgccatcgacttcgccaggccatctatctccgtaggagttctccgagaacgacaaaacccttcgcggaggaactcgaggtgcagcagcggacgatgatcttgaatgcaagccaacacatgccccccggcatatcggcttgatcgacgacactcctgcttcaaggcctcgtcgatacgttgaccgatgccttcgagctgggcgcaggccccattcagccacgagatgtatccggccgtcgattcctcgggatccccacggggtactcggagctctctacagactcttgacatggacgtgcatcaactcttcagatacgagttgaaccacacctcacgacctcggagtgtctctacggcctggtccttcttcacttccaacatagtcctctcgagttccgcgacctcaaacttcgtcctccaatactgaatgcgacgatcctggttagcaagcgcactctcgatgtctgctcagcatggaaacgattaagtcaagctgctcttctctcccgagaatatagcaaatcaagtcaatccagacggaagggtaaaggaaatgataacaaagacaaccaacctaagggagtcgttgccatgctcgtttccacaggcgaactttgatctacatggccccccggcacatgtggctcgaacgcaagtgccggaacgatcactggcaactcaggctgtccgcgctgctggacatcctcgacaccaacatatctacaaacaacaacaaagtactcaagatcacaatgctaaagaaagctaaggtgatgaccacacacacaaaggcagttggaaccaatgagagttttacaaagcatgactaaagagtacaagagagctaagatcctactcttcaaaaagtgggaggacggactcccccagatcaccaacctcctccatcacatccttgcgcgcatcgctagctgccccctgatccaagatcttccgtagatcgagttcagggtgcgccagcctcacacacgcaaggacatggcatgccccggtatagatcccgttggacgtctcctctccgatcctggccgcgtgcttggagggaatcgcctccatcgctgtcgccagttccgcaagcgaagacgtcagcgagaactcgtcgggattcgccgagatggtggccttgacgccgcactccccggcgagctggtgcagaccggtgtaggtgacccgccgtgagccacggatctccgacaagtggttctcaaactccgacatacaatactcgagcccttgccgttgtcgctcattgccagccaccagctcccgcatcttctggaggtcctcgcgaacctccaccaaatcgcgcgccagccggtcggtgcgctcattcgccgacgatgccgccgccgccctcgccttcacgatctcgcggctaatgccgcaagcaccagcctcgaggaggcgccccatctcgacctggagctcctcccaggtgaggatggcagccgacggaccccgaccagccgcgagatcgctggctgggccgctaggtgtcgcctcgcggctcctgggcatgaccacgacgtccgtcgaggccacaacaggagacacgctggaggtccctccagacccgtcttgcaccgccttcgcccgcgccgccctacgaaaagctgcaactgagacaggctgcaacagtttgacaaagtgacgaaacctcaaagtcatccacttacttctcgccaagtgtcacaagccgctgccgtcgcggaggcgggggagacgcgtccgaggcctggagtataacggatatgatgtgaggtggaagttttccggactacatgatgaaagaacaggagaacttaccgagggggtgggtgtcttccgatgatgtccgaccacagaggagaatttcctcccctttttcggaacgttgccgccactcgttttggcagcagcggcaacaacgtcagacgcctccttggcgactttctccttcagcgacgccgccacctggtggtccacgagcggcccgatgatatcagtcagagggagagcctacgcttcatgaagttataatgcgatcccggaagaaaaatgcagaagggccgctgggtacacttacattgatggcagcttcacgttcggctacccctttctcacaaagggggacggggacgttgctcgccgttgtcgggccactgattatcaattggccgacgcggcgctccacggtcgcgctgtccaagcctataaatcgagatcagaatccaataagtcgggaggaacacgcacataatggagtcaatttaactacaaagaaaaataccccgaggagaaacccaggtcacgtcctccggcccagaataatcaaaggctggatgggctcgagcctagagtggctggatccgcctaccaatgaagtcggcagcgacttcataccccgacaatccccttcttcgtcatcgagaggctctacgaagccgtcgccggcgtgcagggcaccaggcagtccctcctcaaccttctcgccgtcatgtatatcggcgacgaggagccaatcaagtggccttccggcgactgggacgtccaccaccttctccatctgtactacgagtgcttcgttcccaactgatcaacgccgccgccgcggggccgtcggagcgcgcgttccggccgacgggcggcgaccaccacccgggcaccccgggcgataccgtgcgccaccgagatgagacacgtggggctaaagttcgtcgcaaggcggagtcggccagccccagccgacgccggggagacgacgacgtacgacgtggtgttcgacgaccgcgggggcgtgatggagatccccgccatcctgatcgacgacgcgagacggccgctgctggcgaacctgatcgcgttcgagcagagccagggcggcgaggtggccaggctcctgagcagctacgtggcgctgatgagccagctcatcatgacggcgcgcgatgtcgagctgctccggcggcgcggcgtggtggagaacctgttggacaacgacgaggaggcggcgcggttcttcaaccgcctgggcgacatcgacccggtggactacgacacgcaggcgttcgcggggctgtacgaggacgtgacgcgctactgcgggacgtggcgcaacaggcacatggcggggctccgccgcaactattttgccagcacgtgatcggccatctccgtcgtcgtcgccgccttcgtcgtcgtgctcgctgctacgcagacctacttcaccgtgtttccatccaacaagtgatgcagaatcccggccgggacctgcatttccgttcgatacttcgatcctgttaattttcactcaacattacggaatccttccgtgtatcgagctggtgtgtgtgggagaatctggataactctctgtccatattcgttgtactaggaggggttgtctttttctttgggatagagggagtataaaggtatatcagactatcaatgtaggtttttaattcggcaaattttgctacatgacactgcttatgtgtgtttttagccctatgacactgcccaaactcactttcgtggaaaaacactccataaacgtggtaatttgtcagtggacaccgcgccaattaaaataataattttcagttgaagagaagagagaatttgcgtgaaatgtcaaaaatacccttgacccacatgt

SEQ ID NO: 58253 - DNA, 680 bp, Oryza sativa
atgtatcagtagtagcagcaacaaccatggatggatcttcctagctgcaaacatagtttcttctatggatcaacatttcgacatctaaaatttagaggtcagatgataggcagagaaatctagatttcaaaaaattaaatatgttaataaaaaatagcaatcaaattaaaatgtacgttgatggttgtattcattgttttatatcatacaatgatgaataaattcctcaaactggcgacctccaatgctttcatactgtcacacccagaaattcactaacccaaatttcaagcagaatgtgtattaaaatctctgtccaggactagccagagtacacagacgataattgaaaaaatagatctacatcttacaaaaataataaaataattcttacaaatgcagcagaaaaataaataaactagacttaatcttcacgaccaaaagcatagcttcctccataaaccacaggcatcctcaacgttcagaacaaactcaatcctcatagaactcaccatctaaaccaatctctgcctcttgtggggaggaataaagcaagactgagtaccaatcatcgtactcaacaagtcatactaacgggaaggtatgatgcaagaatggcttattggatatttgcaataaaagtagcatttataaatcatattttgaataagttaaataat

SEQ ID NO: 58254 - DNA, 621 bp, Oryza sativa
acggaaaaatacattcgcccttttccctcacacccacttcaaatttttcacactctctctctccactcttttccctctcacccacttccaattttcacacaatctctctcccttttcttttaattctctcccacacgcctctttcctctcctcccctctctcatgttctctttctgccactttcctctcctcacatccccctctcctctctctttatgcctcccactgagcgcacgggcgtcatgacgacggcgatgacgagtggcggcgcgatgatgagcggcagcgcgacgacgacggcgcgaggacgacgactgctggcggaggcggagcgatcggccagcctttttcttcttttcgtcatggttttgcaaactttgtgttgcgtcgcacagtggatcggctggttgccgtttctttgctcgagaaatggtagctttgggattaggatcgagaaaggctagctatgcgctcaggtacggctgcctgtgcggggttggacactggactaaagagagacgacggcgatccgatcggattttttcgattttattttttttgtccgttttttttccatgcgggtggtataacttaaccgtacgggataatcgacttaatatg

SEQ ID NO: 58255 - DNA, 4634 bp, Oryza sativa
cgtcggtatcgtggtggccttcttcctggcctccaccttgccatcatcgaacaacttgccctcgacgatggcctcctccaccttggcacggagctcagccaacgccttcctctcgccgtccttgagattatccaggaagttgctctcctccctgaacgacacgttcttggacacaacggtagccagcgtcaccgcctcatccaccgacgccttcgccctcacctcctttgtctctggcgccaccacctccgctgcggcggctgtcgcaccctcagacaacgacagtggtgcgacggcggcagagcccgggcggtggcgaaggtcgggctgtagcggtgcgccggcggcggatcttgcagatgggctggacgatgacgaagacgacgggagcgtggcgttatcctctagagagaagatagagagagaagataagagagataagaaagctgacatgtgggcccaaacgcatttttgacatttcacacgatttctctctcctcttcgaccggaaattattattttaatcggcacgatgttcactggcaaattaccacgtttatggatcgttttccctcaaaagtgagtttgggcagtgttctagggctaaaaccacacataagcagtgtcctgtagcaaaatttgccttttaattttagcgtcgtgtgaaagtcgggaagtggttatatgtgccagtttttaagaaaccaacatctataagacagttcctgtcattggaagatatcacataagctacaaatatttcaaagcatgaattgcaaaacagaaaagatttacacgttccaataaaaaataatttgtagtcatcagaaaattcaatgaacagcgttgtctgcgactgggggagcgcaggttgtataatgccatagaaaattgcacattgacacagcttccctctaagaaaaaaaggtaataaatccatggtgccgcttttcattcactgttcattattgtcaacaggaaacatcccaagcaagaagctaggctctccggccttgtttagttccaaactttttctttaaatttttaacttttctattacatcaaaacttttctacacacataaacttctaactttttcgtcacatcgtttcaatttcaaccaaacttttaattttgacatgaactaaacacacccttcgtcatatagttgctgaagttctattcacccagttcattttccgtgtgcaataataattgtggtcatagaagtatgaacaattactaccagaaccgtattcacgaagctaattacaaggggccaacaatgggtgccaaacaggacctgaagcacgaacctaggctcttcctggtggtgccagagttaatttggttctcgatgtttgtcgtaactctgtttgtgttaacaacacgcgttgcttgtgtagctggactacggcttgtaggtacattggcccctggtcttgcaataggagggacaaaaatcatgcctccacggtatttgtgtccttgttttagcctcatgctagatatagcccccgtcgtcgttgtccaaccaatggaatgctgttccttcggacgaaacggctgttcaaggtgataggtataatactagttagttgtgtaaataaaaaggggcttttacaaatttaccactagtttttcaattttgcaaggatgccactcgaatgacagttcttgtgataatcttgcaataatgattcaaagcagtggtaaatttgcaattgccccaaataaaaatgcgcaaccccctgtgggacagcgggagtgtttcgatgataggaaaactgtatgaacaaactggaccaacttgagtgaattgtactagtattacgggaggttcaggtcctgtcgatatgagtcaacccaattgggcatttaggcttgaaaatatcaaccgggacatgaactcataaataatattaatcggatgaatattatttatcagttgatgtggcacatatatataaacgatagacaccaagaatgaaaacagtacctccaaacctctgtgcattgcagcagtgtctattacaagcgaagcctcggggaatgcctgccctgacatttcctgtgctttcacatttccagggtcgtattccaatacctgttttgattgtaagattttagttgctcattgatgtgtgtaggaggctagcgtttactaacagtagcgaactatgcaaaagaacaaccaatgaatcaatgccatttgcaccatgtaaacatttggaaaaggtgtagcactatgaagcaaacacaactcatgctctatttctcttgttaagaaaagcacctcacggtagcgatggtatgcttgttcgaagcgttgaagctgagttgcgcattctgcagctttgaaggcaaaggaaatcaacatttgtttaatttctccatctatgtcctcctcgtcgaaagcacgagagtatgatctgtctggccttcaaacaagttaaacagatttttcagattcagtctgtacatttgtcggatgcatataatacatacttgggacaaaacaggctatacttttttcctagaaaaaaaacactatgacctcctttttgcaccattaaattatctattaacttattgaaggaatagaaaaaagagcatccacatttgctctcacagtctagaaattcccacattaatcgaagaaaaagaaaaatatagagtccatatagaaatacaatttaaaaatagtttaaattcggaattagaaaataaggaatattggaagaggagactagagttcatatatgaatacaatttagaaataatagaaattcgaaattaaagataaggaatattgaaagataagtttagagtccatatagaaaaacatataaaatttagatctaattgaaattcggaattgaaaaataaaaaaataaaagtagaatttagaatccatatagaaatacaacttagaaaaaactaaaattcaaagtttaaaaataacaaatattataaaaataatctagagcccagataaaataaaacttagaagaagctaaaattcgaaattgaaaaaagtaagaaatattagaaaaagagtctaaagtccatatatgaatacaatttggaaataactgaaattcgaattttttttaaaaaaaagaaatattgaaagatgagttagagtccatataaaaaatacaatttataaataagagaaattaggaattaaaaataagaaatattggaaaaggaatctagagattatatagaaatacaatttagaaataactgaaattcgagattttaaaataaggaatatggaaagaaggatttagagtccatattagaataaatttgtaaataacatgacttcggaaaatataagaaatattagaagatgagtttatagtctatataggaatacaatttataattaagtaaagttagaattctaaaataattaataaatatcacgtatataaaatacaatatgaatattacacatcagttagtttggtcaagttagtacaaaattaaaaattatgttatcattttaatatattttaataacaaaatataaaaatatatatgctattatttaaaaagatataacgatactagccacgcaatatacgcgggccaccatgctagtttagtaccttgtaatatctcctataagctctcaaatatttgcttgagccgaatagtttgtcaccctccttttccttctcaactgcagcctcaacgctctctgcttgactcatgagccagggatgcttgtcctaaatttaattcagatccagtatgtcaagtagagtttccaaaatatagtttcaaattgttcacatcatggcaactaattcaagctgcatacacacatttacaacagagacaagctcaatttcataggtgacggaagaaccaggagggacaaccacgtgttgatcctgcaaacactggggtggaatggtgaacaaggagacctctccctcccacattgtcagaacagcttcctctaggccatcactaacctgctctgcaatttcaaaagaatagctgaaatttatgagaaacaaacaagttttattttgtaaagatgtagaaaatacaaccttcgtcaaccacaaactcaaatggctcatctccttggtgacccctctgatcaaaaacagccccatcatgcagtttaccaatcagccgaactgccaatgcaagtgaacattaggcatgttgatatccaagcaggaggtaatgagctatatatgttcagaattccatattaggagctaacttgaaggtacctccaaccactgcttgattctcggtgtgctgtccttccaagtttcctctgcgaagggtttttttaaggattgtcccgttctgtccaatgtgtctcactgttttccatgacatcaattgaaggtacacataaagagttgcatcaggtggcacagcagcttcatcccctatggacggtctaccccgttcaccaaaaccatctagggatcaagagaaagagagcaccaattaacatatattaactagaagattaactacaagaaatacctgcaagagaagggtttcttccaatcgaaacatgagggaggttcacaattctggaaaaacttgcacacaatcaaaagttggatccaaagaaattgtgcatggaa

SEQ ID NO: 58256 - DNA, 3764 bp, Oryza sativa
ttggtctgatgtttggctagagtcttgtcccctaaaatcagattcccactcatctaccaaatctctaaccaacaatacatcctagttagtgaggtagcagaatgggaagagttggaacaaattatgactggtattaatctgatagaggaaacagatactatcctttggcctgtggttcaatctaattgcttctctactaaatatttatacagaatactcatattccatggggagaaaaacttgagagatgcagacatttggggagctcccatacccctgaaggtgaaacacttcatctggcttgcatgtagggatagaatacaatccacaacccaactggtgaagaaaaactgggaagggtctgatctgtgtattttctgtaatgatctagaagatgctgatcatatcattttcagatgccctgttgcaaagttcctttggtgtgtgattagagatgctctgacctggaatgcagcccctaattcttttgatcatttcttttctgagatagtaggccgacctagctccaaacggagcagagggctgataatgctgctgggggctgctgcctgggtgttgtggttgaatagaaatgatatgattttcaggaagcagattttatccactcctctaactgttgcttttagtgtgatgttttatctaagacagtggtctaactgatgaaggaaaatgaagaagcagaagctgagttgatggcaggcaagatcttagaagctgtgcaacttctatctcctcaaggacctcaacacaggagtacaggactggcgtgggatgaaaaaagcaagtagtcatagatattgccttttgctcactggttttcttctcctgtttggctctttagatactgtgtaaggccattttttggctagaatgcttcttgtaaaagctggttctcccagctgttgaactgatgccgtaatcattatctagctttctataaaagctgggccttctggcctcttatcccaaaagaaaaatgacacacagaaagacaagcttgtaaatattcctgacatgtgcatgcataatcggaaggaagatttgagatgccgattggtgatttagttgccactatctgctttgattattgaatttattacgaggtataaggtgcatgagaagaattggtgtttattttactcaactagaaggttacatccaaggaggggagcttacattctagtttaacaatgagaacaacttcctctccttctgtcatagtctccacagcacgtgcaaaggcaggacaaaagaagcctagattttacaattatattagaccggcatagtaaaatggtacttctacaattaagtgcattcaatcatggtaaagggaacttattcttaccttctgcaaggttgaactcaacaccttcagacatggacactgacatcccatcctccaggcaagcattgtagttcactacaaaaaaaaaatgtaaaagtattagctcaataaacacacaagcactgttgagctattgcagaaataaatgaaaaaaatattggtacaattaatttctcaaattcaaaactaaagaaaacagagagatgaagggaggaactaatgtactatttcataccaagcacttcatccaaatcacaaggtttatcattccccactccacgcttcatagtctttttcaatatgccttcattgtcgaggatgtcagttatggtgataagagagatgagctcaacatcaaactgtagtgcttggttaggaggaaggttcgctgggatatcagcaggacaccgagacttggtgcctgctaattctggagggatggtgaatacagctttctcccctgcttgcattgagctaacagccatactgaagccttgcattacattctctataagcagtatttagttttatttcatcgaagtgtaactcatttttgagaaaagtatggttacagtggtacaaacacccaatgagccaggttttttaaacacacacacacatgaaagatgagccatgtaatcttgttatctacattctagtagaatctttaatggcttgaaacaaaaatgtcagaccccaaatcactaaagtcactttttcattaaaagattcagtccttaacacttgatagaaatcccactgcatcatataggtctgttgaagtttacgcaatgcagaaatcaacaacgccatatatataaacacttaatagatgagtggatgatctggaagatcagtaaaactacatacatgagaacttcatgatgcattaagaaaatgataaataagttaggtgaaacgatttgaatattgcacaaaataaaggggaacaattatgcttggtccacgtgctactaatgcattttctgtattacctttttgggagtaactgtttgagtaaactactgaaaatcatttggtttagtggtgatgggtgtagaaaccctgggatccatggttaatggcatgatcacaaggtttccaaccattacaatatctaagaagatttaacaacagaggttggttaaacagtaagtaccataaacattggagagttcttaactcatatcacttggtaacctccctgtaaattttctttggttctgatcaagtggtgtgcattatggatttattgactcggtaagaactaaaaagtaatttcagggtattgactattgagtatggtacagttataccttgtcctaatataaaagtcagaggcacgccatcttctatggtggatgtaaacaaagtaccatcaagtctttttcctgtaaagtggactggaagcaaccaaacatactcatgattcatcaaaggagcagtagaaaggaagatcaatagcatgactgtgtactggaaaataaaccaggggcttatacagtacaaaccatcaacagagttatctgcagggataactgctacaaacaatacgaataacattggtgaaatcttccccgactaggattaactagctatatctcgttcaacatcagcgagcttagaattgcacattttcaaaatttctattgtactgcttcggaaatgagaaccatcctacaggattagagtggaaatctggaatgctgaaattttccatacctatgccggatttcaaccatttcctaggagccggtcaggtgtcaggacggagattatgagacgcattggagaggtttcgcagcaaccgagagacgtactaagcgagtttagggtttgaccttggaggcacgagtatgcgtcgccggctcgctccccgcccgggattcgacctccacggccggatctactccgctgcctccttcgattcgctctctgcattgcctccgcaaagtccggacgccgctgagagccgcctgcgcctgctgcaggactgtcactgatgatcggtgccgccgccgtggttgcaaggggcagagattgtcggaaaaaaattctctgcggcagcagtgccgcaccacgcctcctgtacaacaccgcgtacacacctgacgcgtgtcccatcacattagtgcagccaagcgttttccttgagccaagccgatgtcttcctcagctcgcgcgttggaacggacaccaagccgcagttagcgactgcacatggagttgagccgttgtttcattagaagacagaacagatagtaaatctgccgctaaccaagaacagatgaataatatatactccctccgtccctacatatttaacgccgttaacttttttaaatatatttgaccgttcgtcttattaaaaaacttttgagaaacatgcaaaact

SEQ ID NO: 58257 - DNA, 1088 bp, Oryza sativa
tgtaaatatgatacaatatatgtcatacttaaaaaaggctatttatataatttttctgaatccaacaaatagtaaaataccatgtaaaatgtcgaacacttttatacgttaaaaacgaagcaattacttctaatagctactcgcctactgcaacttcctcacgtaaaaaattagtcagtccaataggtataatgtataattgattggtagatatataatccagagattaaaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacatagaatgtttactgttagaggttgtttggatggtgactatactttcccataactttggtaagctattttgaccatcttagtgtgtttgcttggttgccacatttttatcatgtcacactttttgattttatgatcccacttattatagacacatatctttaccaacactttagctatagaactttgataaactgaagcaagcatccaaacagcccctaacaccaacatatttctgactataatatgtcttttcttctattccttttattttttgtaacttattttcttgggtataagatagaatctcttagctctgttttggctttgcatgcaatccaaacgccggtaacgtttctgctcatcccatgtcgatgtcgcggctgttcccggaagccacggaaaatgctgcgcgcctgacgtccgacgtcagagaaaaaatcggacgcctcggctccggcgcctcggacgtcaaagaaaaaatcggacgcctcggctcccgcgcctcctgcagctctagttttaaaacgatttctctcttaaactaattatccaatctacgatccaatcacaccgttatattcattgcaattaaatcttttcaacaagaccacacatattatttttcagacaaaaaaaattttaccctctctattgatatttttttatggtgcaaatgatgatcaaa

SEQ ID NO: 58258 - DNA, 23056 bp, Oryza sativa
acatgcaaaactatatgtatacataaaagtatatttaacaatgaatcaaatgatatgaaaggaattaataattatttattttttttaataagaagaacggtcaaacatgtttaaaaacgtcaatggcatcaaacatttagggacggaggaagtagattgtaaaacgcaaccgtatggctacaaccagggttagaaattccggaatgaattttagtcatttcagacccttgatacaatattatttcggccgaatttttttaatttttttattcttttgtgaatttggtaatattttgtttaaatttaaccaatatttgatcaaaattttgaaaatttcggactgaaattttggtatatcaacgacgtctgatagaatcggccaaaccgaaaaattaaacccggtctacaacaccatgttcataagtcacaacaaacaccatgttattgaagcatataaatccgtttatattttgcagaagcaaaaagataaccaaaactcttgaggagtagtacaagctaattagcaatgtcggccatatccccaaaccatcaagtttcaagactttaagaagggtcgcaatgcaataggttcctatctaaagttgtgaactggacaaattaaaccataaatctctccagcaatcagctttatgtactcctgaacagcggctcccaaatcccaatcggctttagtatttcggcacagcggctcggctctaaagaaacggctgcttggctacagcgggagatggacacgcgtcaggtgtctacgcagtgttgcacaggaggcgtggtgcggcactgccgcagagaatttttttccgacattgtcgtgcggtcatgcccccgacatccaccattaaaatgaatccaacgtcctgaatttttctgtgtcactctcgtccctctttatccccctcattttctatatcaatactaataccaatactctcaccgtttggtattataagtcttttaattttcttaagtcaaatttttttaagcttgatcaaatttttagaaaaatacataacatttttaatagaaaaataaacatattatcaaatatattcaacgttagacttaattaaactaatctagtgttgtagatgttgctaatttttttctatgaatttagtcaaacttaaataactttaactaaaaaaaatttcaaacgacttataatataaaatggagggaggacttcaatattattatgcgttcgactaagtaagaaagagagaaaatttccattgttcttgttttcttaaaagaactaggtgattccccgcgctttgctgcgggaattactaagtaatttcttatatatatatatatatatatatatatatatatatatatatatatttcaacaatcgagcatagggtaagtatgatgttaattattaacaacaaataaaactgatttgtcaatccatatttgaagagaaacaaatttaatagactttgtagaggattatagataatatttatgttgttgaccaagatttgtatcacaataagcggaagagaaggaaaaaagaaataaaaagctaggatttattagtagtaagcatgaaacaaactaaataatatctttgctttgatatggaatatatgaatgaatatacgttgagtattataaaaaatgatggatatatttgttgaaatattatggaaatgatgagagaggttgattggatctatttgcattttgatttgtaggattaaataaattatgtatgatgcatgtttgcatgagctatttgataagtagttattgctagtggatgatgaggtagcatgtttgcatgttgagttttagacttaagtaggatttaacttcatagaaagcatagatagaaaagttgctttaaaaagcatattagtccatttttaatttaaaataactaataattaattaattaatacactaatggcttactgcgttttgcgtatcactcttcttcttcacttttctcttctacttaaacacactctaaaagctgcttagtaagctacacgttcatgacacaacaatacaaagcttagaagcatgggcggatctagcatgagtgttcctatggaaaagaggagagatgggaggggaaagaaggaataagagtagagggagccaaaagatgaagaaaaagatgagcacttctagtttgatgctacgttcctccctgtttagaagcatgtagttttaggtgatttcaaaattaaaaatttttagatgaatgaaatgtagcaaataattaataatgtctatgtttccaaacttctgatgttggttagttcaatgtcaaatagagaaaaaacagagggagaaataaggtagaaacaaatgaatctatatataaggacggaacgtaattttaagcggttgtagaccgagctgatttttgcagttgtgtacctttttactcttttcaactatacgcaccttgtgcctcgcagcagtagaaccccttcatttccagccaatcaaaccgttccccaggcgcctcttgaacggtccacttcgcaaagccaggagagccacgaccacgaccacggccatgctcgctcccaaaactctctaatcgactggtatctcctctccacacgaacaagtcctcgtcaggcttgcctaggtctgacaacttcatggcgccgaagtccttctttcttctccgtcgacggcaacggagactcctctccatcggcaggaaattaacgtggcacgctagctgctaacaccctaaaggctaagtaagggaagaaaaattaaggggccgggtatctgcgctgttatatcgatcggctattaaacagagggactgtttagttcacaccaaacttcctcccaactcccaacttcacgccatggtaacgctgttttgttgcacgaaacttgcgatgaaattgcgggcaagtgaatgatatgataatgatatccacccaaacatcaacgcgttggtggtcgtgcttttctgctcgatcgaccacataacgtatgaaaacaaccatatatgtcaaacgacgatgacgcgacttcgatgaccacatgcatttcggtttttgcaagtttgcagatgcacgtcgatctggggaaactattttgccacgcacgtctggggaaactattttttgcgacttcgactccctgcacgtctgcgcgctttctttaattcgtgccaccactatttcgctagatttgccaacccgtggcggtggcgtcgttggaagcttcggtggaggcaacgttggacgccatcagcggagatcaatggcgggcgcggctgcagccgttcaccatcttccgcgtccccgcctacgtccgcgacggcaaccgcaccgcgtacgagccgcgcctggtatccatcggcccctaccaccacggcggcgccgcgctccgcgccatggaggaccacaagtggcgctacctccacgacctgctatcccgccgcgctggcgacggcgccgctgccgtggtcaccgcgtccgccttggtcgcggaaatgcggaccctcgagccccgggcgcgcgcgtgctacagcgagcgccccgtgggcatggactcctccgacgacttcgtccggatgctcctcctcgacggcttcttcatcctcgagttcttcttcaagtggcacaccaaggaggccgactcgctctgcgacgtcggctggggcctcacgctcgtcgccgccgacctgctcttgatggagaaccagatcccgttcttcgtcctcgagaggctctacgaagccgtcgccggcatgcagcccgacaaggagtccctcttcaacctcctcatcgagtacatcagcgacgaggagcccatcaggcggccgtccggtgactgggacgtccaccacctcctccacctgtactacgagtgcttcgttcccaagcggccacggccgcggctgcccgagtcggcccggaaggcaccggcggcgccgacgcggacgattctgcgtgccagcgaactgcgggaggcgggtgtcaccctcgtgcggcggagcgcggcgcgggacaggttcgacgtgacgttcgaccgccgcaggggcgtcatggagatcccggccatagagagatcgacgacatgaagcgaccgctcctcgtcaacctcatggcgttcgagcagacgcaggcgggcgaggagccgcgcctcctcaccagctacgtggcgctgatgggccagctcatcgtgacggcgcgcgacgtcgagctgctccgccggcgcggcgtcctggagagcctgctggccgacgacgaggaggcggcccggttcttcagccgcctcggcgagggcgccgccatggacttcagccgccaggctttcgccgggctgtacgaggacgtgcgcgggtactgtggctcgtggtggcaccgcaacagggcggcgctccggcgtgactacttcggcagcccgtggtcggccatctccgtcgtagtcgcggcgatcgtcgtcttcctcgccgccacgcagacttacttcaccgtgtttcccgccaaataacgagagcgtaatcttcaagtgtaatgacttcgtaatccaatccttcactacttgggatagactattgatcagtcgactaaaaaaaaaatacaaatcgttagtccatcttgtgcaaaatccgatccccagccgaaaggccaggaatgatgcagaaacagagcaaacatctatcttccttagcctgtggacctatgatccatgttaacggattttggatctgcattttttggaccggtctgtatgtgttccttttgaaagtttcttttgggctattatttattgatttgggctaagtttgttctgtacatttttgggctgttcgtgcgggcctctgccttctgtagagccatggccacatccaaatgaaaggggattttagattaaacaagcaccatgcacggatgaaccaattttcgaaaagggattagctatacatttatgtaaatattagtacaatcatcatgcaattatattgtaacttataagtaactatagtgtaacttgcacgtaactttcaaaattctcttggtgacatactaattctgtgaaaatggaggtaatagtaccgaatttcctcacatgtgcatgggctatgattttttttctacctcccttgcataaattaaatcaaaccgtacggttcaaaattgcattatagttacatggtagtacatacaaattacaatgtaattatattacgattgtactatattttcatttgtcaaattttagaaaaaaaaattattgacaaatatatagcaaaatcgtttggaaaattgtaaaaaccatatcataagtgacttaaagtttggcattcctccccataaatcactctgttatgtgacaggtataaaattttaaggtggggatctaaacaacccctaagagtccatgcgattttgtatggatatgatgaatatccagatatattaattagcgcttgacaaagtccatatataaagtccattgttgtccctcgtgtttttgcccagggagccaggcgggtgtcaaactgtcaatgattcaatggtcattgctcgtgtattgacatataatggcagctggtcatgtatattatattcacgtatagactgctaatggcaggagagtctacatatataccgatgtcggctgccatggctgcacgcagccgagctcaaattaacgtgtctgaccgtacttggaggcggtcaaaaacctgccgctggctgcttatactccacgttattccggctaccggcactccagtcgttagcacttctttaatatcgaagctgacttaaatcatggtgtatactccctcttgtttgatactagcacttattgttttgaacaagagcactactatacgtgagagcatgatctccaaaaactaactttaaccattattttttattataatatgtataaaagtattaataaatatatgaatttattaaaatactttttaaaactaatcaatacatgcatgtagtcactatatttaaaagacaaatgttttaaaaatgattcataatgaaagattcaaaagtttgagctcaactttatctaaaacgacaagtattatcaatccggagggagtataagcgatctatagaagtcaccgtattagatttatgtttagatggagcaagaaaatataagagaagaaaaaacggactatacatttataagtcaactacaacattaattttaataaattatatgagagagaggtagtattaatggattagtatatatctataactaactaactattgcatgtcagaactattagattagtgatacataaatgatggggacatatccattgaaaaccatcgtgagaacccataaaaaccgggactatatgttttgtaaattcacgaaaacatttatatgtatgaaataattctcaccaaatttgaagttcaaactcaattttaattatttgggagttaaaaaagtatttcgggtgaatagtaaccataactattcacttctctgtcaattgaagtttgagtttagacttaacatctagtgcgaatatatcttatgcctatacttatctctagaattttttttactgaatttagagagcttatatgtatattttttatgggtttacacttatttgacgttttcactagttttcacttgagatttgatgtgaatattaaaaagaaaaaagacaagtgatatgtcagtatttagtgagtcctagtagttagggcctgtttagttcacaaattttttttcctaaaaacatcacctcgaatgtttaaacatatgcatggagtattaaatatggacaaaaagaaaaactaattgcacagtccgactataaatcgcgagacgaatcttttgagcctaattagtccatgattagctataagtgctatagtaacccacatgttctaatgatggattaattaggcttaaaagattcgtctcgtggtttccaggcgatttataaagttagttttcttattcgtgtccgaaaaccccttccgacatccggtcaaatgtccgatatgacacccaaaaatttttttatccccaactaaacatgcccttagctataccattgaccttcctcatggctctcacacatgcacacatattaattgccatcagatgacaaatcacgcgctaagatttattgagccccaaaatgggtaataataacaagaagggacaaattttacgatggtcttaagttaattctactcctacttataagtggaattaatttgtatcttttattttgctcttattcagcaaatcatttttatctatactagttatcatctcaactacgggtagtatgatatttcttttattagaactcataagccatgcataatgttatcgatatatgtaatatatagtactaatagagagcctataaaaatactccctccatccaacaatataacaaatatgagcatgttcatattcataatagagagcaataatgtttttttagttataaatgtccaagttttgtgattaaattgatattaaacctttagttttgtgataactttgtttctaaatctgtagttttgtgatattttatcttaaatatatagttctatgataaaattagtgttaaatctatatttttgtgatacatcatgttaaatctataattttctaataatttaactaaaatatatgtagttttgtgaaatttacttaaaataaaaatgtttggcatggtgactagcagcccacacactgccactgcataggttacgagttcgagtactcagcctttttacatgcatgcgattttttttctctgacttgtgcctacacgaatcttgaggatatgggacagtcacgaatttataagtttgggtgtgggggttagagggggagggggagaaaactgtcgaaagacttttaagagttctatatgagaagggagtagctatatttatgggggttatattttttattaacaaatagttaaattatttttacactataattatattcacttatacattgtaattacacagtacttacttatgtaactttgatatatttacattgtaattttcaaatcttacatgtaaattttaaattttacattgtaatttttctcatctctagatctaaaccataatcacattgggcaaaacgcatagtcgagtcacatctgcacgggcaaaacaagctagcactaatctcaagcagatcaaacaccctagaaatcttttttttttgttggaacttaacaccctagaaatctgactgcaatccagaagaaaatgcgtcgacacaattttagcagttccggtataattaagttgtcctcggcggattgacaggtggaaaaggctgacttcaagtttttgaaaagaaaaatcgtatgcagtttgaattttgccaggaaatggtcggaagaaataataaaaactagtgttggttccacgcctctaccactctataaatacacgagctgatcacggacacagcagaaaacatcaccaagcacctggcaatcactcaacaaacaacaaatccaagtgtacgtacgtacgtacaccgtgcacggtgcacattagagcgcttaattaattagcttcaccgatggagaagagcagcgagctatggttgctatgggcggttttctccgcctctctcgtcttcctctacctcaccatccgacgacgctccggtgccggcgccggcggcaaaccacccttgccgccggggccaacgcctctcccgctcatcggcaacctgctcgacctccgcggcggcgtcatccacgacaagctcgccgccctcgcgcgcgtctacgggccggtcatgatgatcaagctgggcctcaacgacgccgtgatcatctcctccagggacgccgcgagggaggcgttcacgcggtacgaccgccacctcgcggcgcgcgccatcccggacacgttccgcgccaacggcttccacgagcggtccgcggtgttcctcccgagctccgacgagcggtggaaggcgctgcgcggcatccagggcacgcacatcttcaccccgcgcggcctcgccgcggtgcgccccgtccgcgagcggaaggtgcgcgacatcatcgcctacttccgcgaccacgccggcgaggagctcgtcatccgccaggccatccacaccggcgtgctcaacctcgtgtccagctccttcttctccatggacatcgccggcatgggctccgagaccgcgcgcgagctccgggagcacgtcgacgagatcatgacggtgttcgcgcagcccaacgtctccgactacttcccgttcctccgccgcctcgacctccagggcctgcgccgctcgaccaagcggcgcttcgatcggatcttctccatcctggacgacatcgtcgagcgccgcctggtggatcgcggcgaacgaggaggagaaggcggagccagctcgaacagcagcaagagcaagcaccagtacgacggcggcgacttcctcgacgcgctcctcgagctcatggtcaccggcaagatggagcgggacgacgtgacggcgatgctgttcgaggcgttcgtggccggcggcgacacggtggccttcaccctggagtgggtgatggccgacctgctccgcaacccgcccgtgatggccaagctccgcgcggagctcgacgacgtcctcggcggcaaggaccaatccgccatcgaggagcacgacgcggggaggctcccctacctgcaggcggtgctcaaggagtcgatgcggctgcactcggtggggcccctgctgcaccacttcgcggcggaggacggcgtggtggtgggcgggtacgcggtgccccggggcgccaccgtgctgttcaacacgcgcgccatcatgcgcgacccggcggcgtgggagaggcccgaggagttcgcgccggagaggttcctggcgagggaggggaaggcgccggtggacttccgcgggaaggaggccgacttcatcccgttcgggtccgggcggaggctgtgccccgggattccgctggcggagcgcgtcatgccctacatactggcgctgatgctgcgcgagttcgagtggcggctccccgacggcgtgtcgccggaggagctggacgtcagcgagaagttcatgtccgtcaacgtgctcgccgtccctctcaaggccgtgcctgtcaaggtgatcaactgagactagggctagttgagctagttgtgttgctcgatctgttatgtgtattggattatatagtttgtgcgtgtgccacgtatagtagctacagtattattcctagttggtttcgtgtaataagctacttaaatcaggactctcacagtcctagatatttgttattccattattcatatagtcaccacagccccataggccataatatacgtctagcatgcatctatgatatgattattttttcgagggcctatctgttgatcctacgatagatttatagtttcaaatcttataaaattacctgttgattattcattcgaaagacattttggttgtcttttcctctgatactccaacttgtaaacatcatatagccggtcagttaatctttttgcaacagtgcggagtttttctttttttcctttttcgagcaaaatggaaaactgtcacacgtacgccaatctcaattctcagactctgacatgcaatcaccgagcaaagcccaatatataatacgttgggaatatacatacggaccatatagtatatatgttgattgttgagcatgagagaccctctatctcgtcccatacgtctctgaccgccgtacccagccgtcgcttgcacgcgtccacgtactttgtcaacaaatcgaggagtatggctgaaaatctagcccggtttgacgccatgaagagatccatacatggaaaagtaggttggcatacgtacgtacgtacgaccgatggatggatcagcaatgctgtgaagagaaaaacggccaaaaagctatttgcacgtgcagtacccgccttttaacagaaaaactactggtcgatatcgatgcgagctctctaaaaaaaaatgggctcccgagaaaagtttcaattgacgttttcaagtcagcgcaagaacatcgacgacgacgacagtgcggctttgatttgcggggttcacacacgagtaattgcagccttgctttctcgaaaaaaataattgtttagttccttcaaactttcaacttttccgtcacattaaatatttggacacatcacacatgtatggagcgttaaatatggacggaaaaaaatcaattgcacagtttgcatgtaaattgcgagacgaatcttttgagcctaattacgccatgatttgacaatgtggtgctacagcaaatatttgctaatgacgaattaattaggcttaataaattcgtctcgcagtttactggcggaatctgtaatttgttttcttattagtctacgtttaatctctactacttaaaaaattcgtagtggtggtcttgattcctgacatagcagacgcatctgacagacacacgtaatctcaaccatccgattgccatatccaacggcgtcaatcttctccccatcacgcgctcgctcctctcttgaatcgatctcctccccacgcccactcctcctcctcccacgccgcgtccttcgccctcctccctgggcgacgctcgccccgccgccgcatcgcctcctcaccagccacgcccgccggcctcctccgcgatcgccgccgccctctccaacgcgcctccacctcgcatcggatcgatcatccaccttcgccctcctccctgcgtcgcctcctcgcctcctcaccttcacacctcgccaccgcatcgcctcctcagcagccccgtgccccgcgccccgcgtcccgcgccgccctcgaccgccgacgctgcgacccgcgccgtctcctcgctgccgtcgccgcgccccgagtcccgcgtcccgcgctgccctctaccgccgatgcgggagcaggaggtcacgccgcgtcaacaccgccgaggagccgcttcctcgccgccgtcgcgacgacccgcgccgccctcgactgccgccacctccgcagatcgccatcgcacgcctccgcctctcaaggtcacacgctcatcgccgcccgacaccccgccgattggggaccgaacgctgaccctgcatcgacgccacaacagtcgacagaggggagatgttgaagacctcactccaacgacggctgcgcgcggcgacactaccaggcactgagggagagaatgcggtgcgaggtgcggcggggttgttcgtccttgcccagatcaatgccgccgccgatccctcactcgcccctcgcccaagtcggcgccaagggcggggttcgccaatctgcttcccagccgcctcgcccgctccatgggagaggtgacacctgtgcccgcctccagcgctccatgcccccggataccatccgagcacgatccctccttagcttctgccggagaagggacgcatgcgccgaccttcagcactctacgcgccctgtggataattggttcgttctctttacgttgcaatccattcatttgtcaagaatcatcattgtgagtgccgagggttattacagattgcaggatcactaatgctcttttttgcccataaggtgttcaacgaaatgctgcttagccaatgtattaccagaaattgatttctctgtaagtgagaatgtcatattgtcatgtcccctatgttgttatttatactaatgattgcaggattctctctgttgttatttatgctatgaagtgctgggaagttgagagtgttgctaccaagcaaaaagattcaattgatctgttggagcaaactaatttggatctcgcagtctcaaaactaatctggttcttgattgtttcagagtggatgaaaataaaaaatggaatgatgcagtgaagattatgtaagcaatgttcgtgatatatcgatcctgaaattctcatagatggccattgcacaaatacaaaaatttgcaggttattaattagtgaactacatctctgtaaatctgcataacatatgttaaagctagcccaagaattaatatgttgtaaatctgctctacagttgacactgcttacattttctactattaataaccctcagctgtgatagatctgatacctgcttaaaaatttgagctgagttttcatacctagcagtaggactaacattttatgttgtattgttcagctcaagatgaacaaccacaccaaccccaagatcaccaactaagcctatcctgcttcatgattgttgctgcaaactccaacatgcttgctgctggtgcaatctgagccggctggtggcagatgggagcctgccctatgttgttagcagctttcttcactccaagtcatgcttgctgcctgtggtcttggtagtttcttttttgtgttgtcaatttaattattatgatttcccatgtgctcggctattggtgttcttgtttttatctgttttgtttcagggtgtcattactatggagtagatcatttttttcttattttttttaatgccttgtaaaataaccaactagcagggatgttcataaatttctcccttttgtttggtttttttcagacatatatatataatgaaggcatatatacacaaaaggaggagctgtttgagggtctaaaggacaatagctcaattgactgggaagctgttgtcatatgctgagagcaatctgctaaatgttaaagaggtgcatctaacttttgtacccagtgaactgcaaatctgcaccttcatttttgattaatagtttctttggattcagatcaaaatagctcaacatgggaatttttctagcagaggatgggcaattcttggaaaatactatatatttcttgtcgttgaatatgatcatgtcccattattttggcacttgctgccttgattctgttgcctgtcccagcccttcagctagctctctatcacacatgaatgcgtgacccttgatggttgtatgcagttgggatattttggtgagttcatcccccttccccaccccacctctctctctctctcaaaaccatcatttatcttcactattgacttacaatttcacttctagctgatgatgatcaatcaaagctagctcatatgtattagtgagtttatgaaaaaaaggatcagatattcaataacagagtcagctccttccgaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtgcatactctcatatttggaagtgaataccaaacgtgtatgaaatagtgcattcgatttaatctattctctcttgggcatttattcgcaaatgcaaagatttttgtaatttgatcgtagcatagattatggcaaccttggctttgtggtttgccatgtcatgtactgatatatgaatgtgatgctttaattaacgttgaaaagccatgaattatgtattcgaacgaattgattggatgtgtcctgaaatcggttcagactttcgttctttgggtactggcgtgagacggggaaaaagacgctgaagacatcaagcataacatggagttgataaaacatcgtcgactgaatcatgatttgtagtttttttggattgccagatttttttcagtgttcaacaaattttcactcaataattatttaatatcttttcacttaatataatttgaaattgatatatagcatttcccgttgcaacgcacgggcaccttactatacttcaaatatgtatccgtatacttaattttttttgaaatggaactaaacacggcctgtattcgttgctgctagcaaaaacgacgttcccaataatttgggcagagcttttgcaatagtactactctctccctccgtttaaaaagagcgtcttttttagcctgatttgtcccataaaagctgttttttatgattgtggttgagaattaatcctcagcatgaaaaacaaaacgacgaattaccgtatgatcgattaagtataagctaaaatatttaaaaattaattaatatggttttctaaaacaatttttctatatatttttttaaaaaaacacaccgtttagcaatttcaaaaacatgaatacggaaaacgaataagttgaagttggaaacattgactatcaaatacaaacttgagcagaagactattaaaatccgaatcttaatctgaaaaaagggcctagaacagatcaagatctatttaggattcagattttacctcgatttttgttaacacgcttttcagactactagacagtatgttccgtgcgaaaattttctatacaaaagttgttttaaaatatcaaatatattcctttgtcaagtttataataattaaaacttaattaatcatatactaatcgttttctcgttatatgcacatcaactttattttcatcttttcaaacaccaaatgtgtttagacaagtatgattaattgattattaattattaaaagcttgaaaaatccaggagtatggctgaaaatctgtccaggaatattattaatgtgttttatgtgggcacacccgacataaattttccttgtccgtattgacggctgttaattactaaattctcaccgtcaatacctgtataaaactataaatacaagacaccaacagtgtggtagggtttatttctaacaattttcacgagtgtttgtgtatatatgaagagatccatacatggaaaagtaggttggcctacgtacatacgaccgatggatgatcagcaatgttgtgaaaaaaaaaaacggccaaaaagctagtatttgcacgtgcagtagtacccgccttttaacagaaacactacgtactggtcaatgttgagctctaaaaaaatgggctcccgagaaaattaaaggtgtactttcaattgacgttttcaagtcagcgcaagaatatcaacgacgacgagacacagcggctttgatttgggggttgatcacacacgagtaatttggacagagcgtttgcaatataatactccctccgtttaaaagaaccatgctatatgtccgacgcaaatcatccgaccaacgtacgattgggacggcaaccacaaaactacgcgacagcgtgagtcagattttatggatcggtcctacaccatacgcgcctgccaccacatcatatatatgcaagcccatattttttttattttttttagagaagggtataccggaaatatgcagccatttaaattagaaacttagcctatcgaataggaaacttagccctcaaataacccaatctgaaattccctcctatgaagatttgaactcaggaccttgggatgctactcaggtcattgcaaccattagtctacaatgccctttaactttagagaagggtattttttacccggcctccatatccgaccgaatatatgcagctatttaaattagaaacttagcctatcgaacagggtgcaagcccatatataagtgactgttggatgcaacttgcaagcccaaactattgaagacaacgtgaacatgacacttctgccggagttgaggtctatcgtaatccaatgtctgctaacttgatctcaacatttttctcatgttgttttcaccgctgcaagtgcaaggcactatggtttcaagttgaattttcatggcctaacaagatgcatgaaacaaaatataaatacagtgaaatccaaaaccacaagcatagtgtctattcgtcaaataaaaataaacatgcaaacgtgttgatctgtctagttcgtcgattgaaatcgcaagacacatataaccaacgtctgacccctctttccaagcaacataagctgctacttgggcttttggaaaggcccaacaagttggaaaatcacatcggagcccaaagagatcacgtcacatacgccggtaacaacacggacgtcgcataagccgtggtcgtacaaagagtcggacggcggggttgtgtgtatagcattttcggcaggcgatgaatatgcaaataattaataccatcggccaccgtgttggacgaggccggtgtgaccttcgtcaagcagaatgtagcgcttgccaagttcagcgagtgttttaatcatgaccaagcggaccgcaccgccgtgtccgcggacgataccgcgcgccaccgagctcctcgaggccgggggtcaccttcgttctgggcgaggcggcggcgccggagtacaggttcggcgtgacgttcgaccgccggagaggagtgatggagatcccggccatggagatcgacgacatgaagcggccgctcctcgtcaacctcatcgcgttcgatcgagcagacgcggtgcggcgaggtgccgggcctcctcaccagctacgtggcgctgatgggcagcctcatcgtgacggcgcgcgacttcacgctgctccgccggcaccgcatcctggagagcctgctggccgacgacgaggaggcggcccggttcttcgcccgcctcggcgactgcggcgccatcaactacaaggagcaggctttcgcggggctgtacgaggacgaaaaatttcaatggcaaaataccaaaatttagatagaaactcagtgaaaattttgaaacagcatagctcggccctactctggcggtgctgtaccgcgactacttcgccagcctgtggtcggtcatctccctcgtggtcgccgctctcgtcgtcgcccttaccgctgcacaaacttacttcaccgtgttcccggccaaaaaaatgactgtaatctttatagacatcatagcaggccaattccaaaattttgtgcatgcgtttccaggccgcaaataaaacgagcttgcacaaggctgaatgtttcttatctgtccagtattaaaaaatatttgctttgagctatctttcattatcgatatttcgttttgaatcagcttttaaccaatgtttttactttcacccatcatttttttttctgtttgctttcatccacctcatgcatctgcaatggtaaaaaagacaagcaaaacaggggaaacacgaggaacgatgcagccaggcataaggccaagtacagcaaaatcccctgctattgaacaacagtgctatactagtagtacaaaacttagagtaaacactataactataaagacatactcctccatttcgttttagtttataagttgttttcgactttggtcaaagtcaaactattttaagttgattaagttcgtagaaaaaatagttacatttttatcctaagacaaatatattataaaaatatatttaattatagatgtaataaaactaatttggtgttataaatattattatatttatttacaaacttagttaaatataaagtagttttactttggtcaaaattaaaacgactcataatctaatacagatgggctatcaacatataacgtggcctaatcagttcaatctaaaacagagctaggttaccaccgtcaaggcaccagtaatggcagcaaagtgagcaagaagggaaaacatcaaggcaaagaatcactaactggttcttataatccaactgtgagcggcacgttcgtccccaccgtcctcgccgcctgcactggggtgggagcgggttggatagaaacgtccccactccccgcattctccctccatccccggccccgctcaataagtcaggtgaaaaacatcacccgcccagctctcgcagtggattcggtaggtgagtggggccctgcaccacccagatggacagcaactttggggcgtctagctagaggtggcgcgtcgcaacgaggtgatagttgggggcagcgataaggcggcatcggccggcggcaacgacgaaacggcaacgtcagctaggggtagcacgctaccaggaggcgacgtcggccgggggcggtggaccgtgaggaggcggcggcggctgagggtgacacactgcgacgggatggtgctgtccaggtgtggcggcgaagaggcgacgctggccggggaaaattgcgaagaggcagctccggctcagggcggtgacagctagggacgtcgtgtgaagaggcaggttggctgggggcagtgtgttaggagggtgacagatgtgggagttagaggggagagaatgacggtaggtaaggatttaggaaaatttaaggttttgtttatagtccttcactaaatgggctaaataggtctttgaatgtaatatcttttgacttgtaactcatatctctgaggacttgcgggtcatctgcggtaaactaccatccccatctccgcccctgcaattttgagggccccgtacccactctcttgcggggaagaattttcttcatccctaaccccgtagggacgacgggtcctcgctggatctccagaaagagaaaattgccacccctaagtccgtcctgctaaggcgtcaacctcgcgcaaaccacgatcggcattgatcaaccctacttgttgcgcccgcatgcacccgcaggccgtcctcacggcccgcttcgtgtccatgcacacctcccagctcgaaccatgtgcctggatggggaaaggctagtcggagcatgcgcgccagcggtgcgcattttttcggacgaaagtagttagactaaccaattagtcttagtatttgatagataagattttctcaacttattataaagtagttagaccaactagtactggaggtacacgttaaattttggtataaagaagcttatatgcctataaaagtttaaagaggataaccatattacttctcaatgttgtggaagaaggaatatggttatcggacggaaatggtaccgttcaccaattaattagaatatggacaattaatcggaattatacggaaatttaacgatcgtgaatatatgtacaaattttacaagagtatatacttttcgaagatttagatgtgtacaactatataaatcaaatatcttcattttgttttttaattaaacagataagtaaaacattaactcttctaacaccgatttatacatcacatggtggtagaattggttgcattaaataagtaaaacataaaaatatatgtaacaaaaaaaattaagtaaagaaaattactctaaatcatcatcaaattcaatgtacagacgattattctggtgatttaacgaaaaacaaccaactaatcgctaaaacggagttttaacgttcgtgaatgataaatgtacaccgtatcatgttaatgaaacggttttactaccgttaacgtatatgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgatgacacaacctgatcgtcagatcaatacacactcggcggattcaaatccccaaacaggagtagggtattacctctcattgagagggcctgaatctgtctaaatcctttgtctccgcatccatccacttttaggtctcgtgcgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgccttcgtcgccgccgactggtgtcatcgcctatacggttggtcggtcacaccaccgttcatgggcgtccatgtcttcaccgaccggctggcctccgtcgccgccgagtggtgcctccgcctacacagctggcctattatgccgccgctgttgggcgtctacgacttcaccgccggcctgcctccgtcgccgccgactggtgtccccgcctatacggtcggttggtcacaccaccgttgatgggcatcgtcatctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttcccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatcacttacgctccaggaatggatcagtcagaacatcaccgactggcttgccttcgctgctgccgactgatgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgactggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgactggcttgccttcgccgctgccgactggtgtttccgcctgcacggctggcctttatgccgccattgttgggcgtctacgtcttcaccgaccggcttgccttcgccgccgccgactggtgcttccgcctgcacggctggcctattatgccgcc

SEQ ID NO: 58259 - DNA, 685 bp, Oryza sativa
ccggacacgactattatctctaacaaactctaagatacacataagtctttacggcagacttttgcccaaacatatctctaaggaaactatttaaaatatcctaattaatagatacaattgcctatctgggagcttatctctatgatggcaatcctttcgtagcactctgatcgatcccagaaacgatttcataaccatctcaatgaaatcggctgtatcggctgtcccctgtccaatgtcatctcagccgatgcagactctagccgatacctccgcagccgatgcgcactctattcttcgatcacaatccctttgccgaatccacttcgattcaaatgccgaacttggttcattacttaccaaatttggtcgttaacaccaccccctatcaaacgtcataaaacgaaatggcatagtgacgaatagcaccatcgtcatgaggaatttgtcacagaagatcacatttcttgtagtgtgcggcgctaaacggcgacggcaatgcgactcggctagcggcggcggcgcgcggccggcagtgacggtggtggcagcggcgcatggccgggacggcagcggtgcttagcggcggcgacgctagggttttggtggggttacacttttagggttacaacaacaacgcttaaagaattaacacctaaactaggagatcacgagaaggttcctc

SEQ ID NO: 58260 - DNA, 22565 bp, Oryza sativa
taacaagagcttcaaaattagcttaggttttaagctgaagctgtgacaaattaaagcacgatcttgtaaaggttgcacattatatgttacactttcaccttcatttgcgtgattgcttccacgagcacgtctcctagctcgtaagcatggccaacactacaagtcaagcactaatggacctgatgaattagtggtaactacaatgttatgtctagctcttagttaattttctgatcaagaccgtagagtgattcaacgtacggcatgcacagtagtcgatcagggcgcccattttttacttgcaccgcaagccaaacatcgattaatatacgcttaccaaattgggtatatatagcaaagttagattagctcgttcagttaactaaaatgttcaaatgtcgatcgttcgaggaaatactcagcgtgttcacatattatgcacatggtttctcacttaaccaagtgtccagaccactgtacgtagaacttctaatcttacttactccatcccaaaatataaatagtgtgtttgaaagagattttttggtagcagatacgcctatggtagttcaaaacggctgcaagttgcagcgattttcaattgttggctgcagcaaaactggctatcgaacaagaccggaagattttggatggaagggatacactatacgaatccagataccctatctagattcgtagtattagtaagtgttctatctgtctaaaacgtgccccttatattttttagggcggagggagcatatatttcgaccgctgtagagcgaatgagaaaaaaaatcatcatttatcctcacattactctctccataaaaaaataatttctatagacaaatcgtatctgtttctttattagtagtttttttttccatgagacgatgcatgtttacttgaatgatgagaggtaatcactaatcacatctcgataagcaataattaagatgagcgaagacacgtttgttttggatttattctgtccaaacttctaaattaatttttttgtaaccgaatttagcaatcgaacttgcatttagggtatcacaatgtgcatctaaagtgggcagcaaggaataaaatactacttcctccgtttcacaatgtaagtcattctagcattttccatattcatattgatgttaatgaatctagacaagattcattaacaccaatatgaatgtgggaaatgctagaatgacttacattgtaaaacggagggagtactagttagtatacacagtgaaaatggtaagtaagtaacaagtactaggtaatatgcttattacctagttataaggaataaataaataatttctctcatcttttctcatggctagtgactgtggggtctagcttaccgtccacttttattctttcactaactattatgattacaacaataactaatacctattgacatagagcttacccttattcataaaataggtagtaaatattggtgatttccttataaaaccatatattaacactatgattctgtgatctgaatgtgatcagaagattataggatggacctggtcgcgctagcgagtggacacgttcatctacggctatccattatgttaatctgttccccacgaagtaagaacaatatcaaggccttgtttagagcatgtttaatagaatagccaactactagctccgaatcatctataactaatgtaatagtcaattcatacaataattacctactatactattaatatttggtcccacctgtcatatacacattacgtcttagagtccgtgctgcagctggctacacatctgtagcatgctgctcttctctctcttcttttatttttttaatatataagtttattgctggcttatagtctactattgtatctgctcttagttgggggaaatttttgggtttggtagtcacatcgaatatacagacacatatttgaaatattaaacgtagtttaataacaaaataaattcagattccgccagaaaactgcgagacgaatttattaagcctaattaatctgtcattagtaaatatttactgtcgcactacattgtcgaatcatgtcgcaattaggcttaaaagattcatctcgcaatttacatgcaatctgtgcaataagttttaatgactacatttaatactccatacatgtgtccaaacattcgatgtgacagcgtgaaaatttttgttttggaactaaacagggcctaactagatttttttttgaaaggagggcaaaagctttgcctcgtatattaatagaggagcaggaaaacaagagaaaatatgtacagggtcagccaaaagccaacccgcaaacggaaaaagttgtctcccaaaattccaaactcctgtagctttgttgctctggctttaacccaggctctcccttcctcttttatttttgctataactgaggcaggggtggaggctgtgctccgaaagattcttgcattacgctccccccaaatctccaggacacaagcatcagcagagttcgcagaggggctcgtggagtattaggggattcagcaataaggttccaccaaagtttgacggaggggcagtcattccatttactcaattggaggtcagtttgtgtccattgttggatttcggcccagattctcttagtgactctacatttggccagtaggtgcagggctgactcatccgttacacagcacagggggtagatcttttgattttgccagcctcttttccccaatctatccgccgtccaaagtctgttctgggtagcaagccaagagaagaatttgcattttggcggcgcccatgctttccagattgattggtagaaagcagatcttgccgctcccatgaattgcagcctatatgccgatcttgttgagtatttcccattcgccgttagattccaacgaatgctatcttgttcttcattcaacggggcattcttctaaccatggaccatagatggacaaactggcgtaagtgctccgcttctgtaatgcggaggatgtcgatatcttggatccaattattattctatatggcgtcatgcaccgttctattcttccgtttagaggctaagaaaatgttgggtgcaattttctggggcatctgattttccagccatctcgaatcccagaatcgcgccgttttgccgttgccaactgttatggttgttgccgccgagaagagttctttatcttgaaggctacaaggaactgacatccccacccacggtttgtcaggggctacccattcgttccaaagccatcttaggcgtaaggcggacgtgaaacgctgtagatccattactcccaggccacctagatcttttggccgacatacccttttccagttgactttgcatttgccgtcggaaatactttcacccccagcccagaggaacttcctcctgattttgtcaatgtccttgagggtatcatcgggtagtttcagagatgttaagtggtagattggttgtgccgtgaggactgacttcgttaagcagatcctagcagcagatgacattagcctcccttgccagggggctagtctggactggcacttgtctatcagcggctgaatgtggacctttttcaatctacctaccactaggggtagcccgaggtatttcattgggaagcttgtcaaagctgccgggaagatgctcgtgacatcagtaaggtcaatgttcccacaacgaatgggggcaatctggcttttgctcatgtttgttcgaagacctgaaactcctccgaaagctcgcaatatttctgttagattcgtcatatcttgtacactagggtttacaaagatgccgcatcatcagcataaagggaggttctgaatcttggtgctctgccgcgcaaagtagaaagtagcccaaggtttgttgctttctccagtaggtgatggaaagggtcaatggccagaataaagagcaagggcgacagaggatctccttgtctgagtcctctaccatgctttattggaattcctgggcaaccattaagaagagcccttgacgttgaggagattagcagatttgtgatccagtttgtccatctggttgtgaatcctcttcgttgaagaaggtcaatgaggtagtcccatctaaccgaatcaaaagccttggagatgtctaatttgagcagcaacgctggtgttcttgtttggtggaattttcttgccagattccgaacgtacataaagttatcgtgaatgctcctttttttaatgaaagcactctgagcctggcttatcaaggagcccatgtggggttggaggcgaagagcaagaacttttgagattagctttccgatgccatgaatgaggctgattggcctgaagtcgcctatgccttcagctccttccttttttgggacaagcaccacattagccgagttcagaatctgaaggttgttgcttcgcaattggtcgaaggagtgaattactaacatgatgtcctctttgatcgtgccccatcaagctttatagaaggctcctgtgaaatcatccggcccaggtgctttatccccaggcaattgttttaaggcagcaagcacctcctcttcggtgatgggcccgttaatcattgccaagtctacaggtggcaactgcagggcatcccaatcgaagtctaccaggcatggtggcgggcgcgctagaaaagcttcgaagtgatctttaatgatggccgctttttcctcatgcttgaatttccaaatattccccacgcggagccgttgaataaatttttttctccttcgcgcattcattttaaggtggaaatatttcgtgtttgcatcgccttctttgagattggtgatccttgaagcttgccttttgcgagctctttcaattatagacagtcccatgactctgtccttgaggccccgtcttaggttgagctcagcttgactgagttgtcttgactcttgtgctatatctaactgaaggatgacctcgagggccatgtggaggtgcatctttccttgggagatgagatttctgctccaagctttcagtctaccagctgttgcgcccagcttgtggtagagtctgtgatgaacttcatgatatggagggctcacagcccatgcttgagcaacgatctcctggaaacctggaaggtgaatccagtagttctgaaaacggaaggttctagcgcgcggcgcgtctccttgtcccgataataagagggggcagtgatctgagagcgaagtcgagagcacatggaggaggtgcttctcaaaggcggtatcctaatttgggctacaaaagaaacgatcaagtttgaccagagtcgggttatcttgctcattgctccaggtatatcgacgattttgtagtgtgatctccttgagctcgcaagcgttgagggtttctttaaatattctcaattgtcgcaggttaaggttggcattgtttttatctgaggccttgtaaattatattgaagtcccccactaggagccacttggagtcgtttctaggcttggtgtctcgcaattcttgtaaaaaggcttgtttcgctctatctcttgtgggcccgtataccacggtaaggaggaaagtggtttgacactcttttaggagaacagtggcagtgagggagaaggtgcctaggacgaagttagagaggtcgacggtgtcttcattccagagtaccagtatacctccacgtgttccaaaaggccttgtagctggcttataattgtaagaccgtaggtagctcccaccgagagatccaacaatagctacatcaatattactcatttttgtctcttgcaggtaggcgatgtggggcttcgccgtttgcagcgtttctctaaccgttgctcttctacccggtctatttaacccatgaacattccatgtcatgatgtcaactataggggtatgacataattagcaagaactctattattaaagcagaataccctaaaagattgagccccaagtagtatgaggttttgacttggtctacgccaatcctggattgggccggtatgacggcctagcaatctcaaagcgtatggattggttttgtgggcctccggctgatttaaactaaagtggcgagggggcaggccggcatcgcgcggagacctgggctggtgcagcgtacacgggctagcggggagagcttggcctgcttgggatggcgaggcagaccagttgggcctgtttggccaagttgagcccgttcggcctcgtcgcaccagaggcgatcttcttcgcaaagtcgcaggagccggcgccgcatcagcgccgcaggcaaccgttcttcggcagcacatcagagaatcagctttgtcgcacgagtgggaagagggcacgaagaaggtgcggaaatgcggcaccgaagaatcgctagtgggggtagagccacggaattgctgcggaatagggatgtttccccgaatcgaagtgccgtcgctcaggacattcacgcgtgtccattcgtcacgccactacaaagctagcaaatatgaaagatacatggagatatcaatctcctggacatggagcgcagctcccagatcatgtcgccgccgccagttcctccctatagcaggcgtccgtcggccccaggtacttcgcgagcaccgcgtccgccgcctttgcatcctccctattcagaccgaacagctgctcgagggcatcgatggtgtcttgcggcagtggtgcgttgaacatggctttgaagtcagccactactttgtcggtgagagttccttcctccggcgtcaaccccattcggcggcacaggttcagctgtgccttcaaccccgacggcaggccgaccgttggttgctgggctagtcttgaactcctgtgcctgtcctgtcgtggcatgggtggaggcggcgtctgcaggttcacgtcggcacactgcaacggtggcgagggaaggattgaggggtgtggagatttgaagaggacacatggcatcgccggaggtacctgagggaagtcgactgccgaggtagagagcatcggcgtgtgtatcgccgcctcaggttgcacagtgggccccagtgttgcttgcagatcgtcgaccgggtcatttgcagcagcctgtcgcgctggttcagcttgctcggcatttgcaggatcatcaagagcgagggtgtccgtcggcgccacggggctggcagcagcaaaaggagtgacgacaccccctggcgcaacaatggttgctggcgctgacagcttgtcaatggcaatcgcaacccagccgccaggacgagctggcatagggccccttccgcagaggccactgagatggcctcttgtatgcgcgagaagaccctcgccgcgggattgtagctccccaaccagcggaccgggcttcattcccgaacccacggagcagaggcagaggggagagcgatcttggtggctggaattcccccgccatggcaaggccaggagagatgtcgttgtcgcggtcgccacccccgagatcgccaggctcctcgcagatgtcgtcctgtctacggcgcccatcacgccgatcattgccgccacggtcacgagctcttggcgaacgcgtgcgctcccgtcggaagtgaacatcaggctcccgcagcccgccgcgtccttgcgcaacgtcacggccatggccgcgctcctcatcgtcatcatcatctcgccgccacccagggccgtgaccggcgccggggtggtcattgttgtatcttcccctgcgttcccggcgtctgtcagcgttgcgccgcacatcccggtcatcacggcgtccatcatggtcctctcgacgcctatcacgatccccgtcgtgctgacgccatccgccatccctggcggcagcttcccttgccgtcctgcttccttggtcgtgtggctccctcgcgagaccggcattgtcctctacgccctccgcccgcccctggcggaaagcataggtcgtcggcgttggggggtggtgagggaagttctcgaagaggcacggcggagcccgttgtccatcaagaacgcccagatgccacggagggagcgtacgtgtcgctagcctgcatgacttcggattgcggaggtccaccgccgccgccgtgtagtcgtgaatctcttcaatatggaacaacaccgggtgcttgacgccttgctgccagtgctccggtggcgtctccgagatggtgactgactcaagtagggggtcacgggtttgacgcgtgattgtcacccacacgcgcttgtcgatgcggctcgggtttggcatccaagcccatagggagatcaccctcgtgtcgccagcgtccacagggtggacgaggtccgtctccactgactccagagtgcaggtcctgctgatgatgcgctcggcgatgtccggcgcccacaggtgcattggcacgccatcgagacagagcttcactctgtacatgagggcagaaccagcggcgttcttcaggcttcgccattggatgaaatggacttctatcccttggcccttagcaaaacctttcttcacagcttcttcacagtgccggtgatgtttgaacttgaggaggaaggcctcccggaaatgcagtgacatcgcaatctccccagaacgcaggccgaactcatcagcgaggacacgctccacatccttggcggtgacagacggcggggcgcgcatcgcccaggtgatggccgccgtgctctcctattcccgcagctccgcgtcgatggcgtgggacgtcgggatgaagacgatgtcttctaaaggccttgtctcggggtcacccagctgcgccatgatgcccgaaggcggcggcggcagaaggatctctggtacttgacgccggtgaagcagaggcagcggaggcgaagaaggggtggaatcacggggtgttggtggagagcatcggcggcgaagtgtggttggaggaggatggcggaggagaggaggcaagggcgaccgggctctgttcttgctgggcggtgggcgagttggtttgggggaggggcagaccggggggcgaaaattgcagtagcgcgctctatggctagagcggttgcacacgaagcaacgaggcgggtcttggcacaccgaggcacggtggtcgcgagcgaggcacacaaagctgcgacccctggttcttgccttgaattcctccagcgagagagccactctcctgccagtaccgcggccttgtcgccatgaatcgggccggtggtcgggacttgaatgttctccccctctccgcctgcgacaggatctcaccactgtccatcccggctcagggggtgtgaatgctctgtgcagtgtcgtatacctaggaggggagctccttctttcttccatctcataggcgcggcggtaggcatcgcgtcgaggcgacggcatagtaaatgtagacttcaattttgcccgcggcggtggttgggcgggaggcgagcttgcgttgactctggcgggggagaggacgacctcagcaaacgagcgtgggcgagttggagttgcaaaggcaagggtgacgctggtcggtgaccaggtggagcgagctggagtcgcggagacgtgggtgacactatccggcgaccatggagggcggcgggggtggtggcgtggcctgccagaacttactaggggagggggagcccatgctgcggctcaggggaggggcggactgcggccaagagacggcggaaatgggcgcccaaacctgcgaccggcggagaagcgtgggcaccgtcggttggagcaccggcggcggcggtggtgaagcgcgctgcggcatttcaaaaaaatatgtgaagtggtggtaattcttcatagggcctaactagattatcctagctactagtgcgtattaggagctagaattaattcgtgcctagctgggttcactgtattttgacacatgggtgtttcttgcaaatttgatgcacccccgctgattcgtccacatttgtacctggagaggcgttgtgtggggcccacatcctagaacgcagacgggtccgtgatgtgtggggtgacacgtatataactcgagtcagtcaagctattgactctttctgattttgttttccttcttctttttcatgttattattgctgtgaactactactagtgagcatgaggtttcaacttcctacttctagtatttactactactaggggtgtattatgtttacatgtataagactagttctagtttgaccgtatgatagtacttccttcgtttctaaatattaaataccgttgactttttagcacatgtttgactgttcgtcttattcaaaaattttttgtgaaatatgtaaaactatatgtatacataaaagtatatttaacaataaatcaaatgataggaaaataattaataattatttattttttaataagacgttaaacatgttcaaaaagtcaacagcgtcagatatatgcaccagcggtccttaaacttgtcaggagatttcacttaggtacacgaacttgcaaaacgcacatcgagctctctaaacttggtttattgtatcatcctggtccaaagccgcatttgaccgtggtcttacctatgtggcacgccacatggacgatgacatggattttttttattttttcttccttcttttttctctttcttccttcttttttctcggcggtgacatgcggcatgaggggaggggctgtcgtggtggagaaaaaagaaggaagaatgagaaaaaagaaggaagaagggataaaaaataaaacaaatccatgtcatcgtccacggccacggtcaaatgtggctttggaccgggatgatataataaaccaagtttaaggaccttgatgtgagcattgcaagttcgtggacctaagtagaatctcctgacaaatttaaggaccgttggtgcattttactctttagaaacggagggagtatgatactatgtgtagtcaggtggtactagatcggtataggcttcgagcttctaacttccaacttttccgtcactgttaacagtgaaatttggtaagcccggagtagtcatcggcttagagtcagaatcggcttcgaagtcctaagattagttgatgagagttatcaagtcgtcagttgtcggattcttgctatattcggttaaggaaattgatctactaaaggaagtttatccagaagagatagagttcaaagagaatgcggcatggcaagttatctattaattagaaaattaggaatagtctgttagttttcttttatatttaggaaaatgtgtttagtgtcctataagtactttatgtttttcttttatctttagtttctttcttgtctgacaaggactggtatctccctataggtataaatatgtacacccagggtcattgtaatctatcaatatatcgatcaataaaactactctcggcgcatcgccaccctctataccgaggtttttacttatcatccgacggaacttggcacctaacgcggggctgcatcggctttcgatctccggcaaaggggtaagtcctacgttccactggccctagtgaatttgttggctacattggtgttgttcaaggctgcatcgcttcgatctcttggatcgctctggtttggttgatatatttgcctacctgatatctcaattctatctctaattacattgtgtttagagacgcatcggtttagttggaactgtctcggttaggtccgatcttctgtcttagccgatatatctctacaatcacaatgttgttctaaatagatttgtcatatccatcacattagatagatctatcggctcatcgagtattagattatcatatacaatctcgtgctgcatcggttaggttcaacctactagattgttattgataatatgaatcttgttaagccgataggttcatgctagtgttttatcggggtgctagctgataaattatctggacgttgcatcggcttataaggatttgcatatacatataagttggatttagtcgatgacaataaaggtttcattgatttatctaattgtttggattttatgacatcggacctttagctgatttatgctttaaccttcggatcaatgcttattctatcatattgtattgctagccgattggtttatactggattatattattgttatactatattatcatcagtcgattgcctgtatatcattattaaagacaagtgtcagactatacattggacataaagccgatagctcagaaccctatcgctatcggctagcatcggctatcggctggtatcggcatcggctggaactacaacatcggcttgtcagccgatcggcttattgatctactatttgcatatcttgtcagttgtagggtcaaactgactggcacgcctacatctcagtaacctttggacctgcactggagttaagcagatctcctaggccagtgtgtgtttttcgcatcaacagtcacatcaaatgtttggacacatgcatggagcattaaatgtggacgaaaaaaccaactgcacagtttgaatgtaaattgcgagacgaatcttttgagcctaattacgccatgatttgataatgtagtgctacagtaaacatttgctaataacggactaattaggcttcgatttgtctcgtagtttacaggcggagtctgtaatttgttttgttattagtttacgtttaataatttaaatgtgtgcccgtatacattaaatttgtttttgccaaaacaactaaacacggccatagtatcctctatcctggatggccgccatagtatcctctatcctggatggccttcttgtgaagacgccggccatcatcaacggtggagtccaccaacatagctttggagcttgtcactagcatccatgaccgattctcatgtccttcgcagaagtgaaacggatttcatcaacaaactacacgagcatatatagtgttgagctattgatggttttttttatacagaagcaggacacccggtgaaggggcccaccttgctctcgtgttgttaggagttgggcccatcccattcgactcccgtcccctatcattactgttcttctaagacgcatctgatttaggttattgggtgaactttatgataagcatatttctcgaactgcaacgatgtttttttaaaaaaaaaactttgcgtatataaatgtatttaaaaaatcaaataaacccatttttcttttttataatagctaatactccgtatttaattattcattcgctaatgaaacgttgtgtttttttcaccgatcagctcagccttccaggtgaagcgaacagtgccaagccggtagtgaaaattgccttatttatataaaaaaaaagtaaatgtgaatgcttaatttggtttattattgttttgtcatatgaaatagggctttgtctactgtcctcagaacagtatcgccgtcgtacgtagcaaatgaaaaatcaggatttgctaccttactgggatcaggccgagtttagttacaaaatttttcttcaaactttcaacttttctatcacatcaaaaattttctacacacataaatttttcaacttttctgtcatatcgttctaatttcaatcaaacttctaattttagcatgaacaaaacacaccctcgatagactcgaagtttcagcttaatttggtgcatggtcttgaccaattgacaagccggaagctgaagctgcttctgtatgcctcctggacagactacagtgactaatagaacatggtttctgtctgaaaccgacacacttggtcgcctcccaccggagtattttaccattaatgacctctcagagaaaccaatttataattaccatcagcatgcaattgttagttcggatttgtatataataaagtacgactaaaagtttaagataagagagaacctctgaagtctaatcctttagttgggagattttgaaagctattgactcacagacttggtcaagcagcctaaccaacaactctaggcttagcactgaagcttcttcatgacaacataatgagccccagttgatattatctgatgtccagttactatgaacgatttgatgttgacaacactgtcgtatacgtatagttagtagatatttagagcaaacaaaacttgttttttttttcaagggagtgaatgagtgatagggaggcagacacaaacagataaacaaattgcagattaaagaaggagtactaacaaacagattaagacctctttattcgcagccggatcgaaatcactatcgtcaaacatgactacatcagcatgtatactcgttcgtcgcgtttgtgttcaattgctaaaaaaatccgtcccagattcgatcgattcgagcagtaaaatatactccgtatttgtttgacctcttgttcccgatctgtgtacagcaagatgatgcacgtacggtggcctggcgactgcaaaaaccacaagaatttgagccgtctctttcgttcttgagtctgtcaaagccgcggtaattaagggcaggtagatggagcacaagtcacattgatcagcttgcagttttttacctgcgccgaactgatgcgtcctgttccccgtacaggccacaccattcaccattcaccattcactgtactgtagcacttataactaatcatggataattagatttaaaagatacgtctcccgatttacatgcaaactgtataattagttttttatctatatttaatactatatactacctccttccttgaatatttgacgccgttgacttttttaaacatgtttgaccgttcgtcttattcaaaaacttttgtgaaatgtgtaaaactatatgtatacataaaagtatatttaacaataaatcaaatgataggaaaagaattaataattacttaaattttttgaataagacgaacggtcaaacattttgaaaaaagtcaacggcgtcaaacattttgagatgaatggagtatatatcaaagattcgatgtgatgtttttgaaaaagtttaaaggggaaaactgcgccaaagtcgcaaacggcacaacaccgattgatgaaagcgtacacatatccattacatcacatgcatccacaactacaaatgcacaattgaacatgtctagctcacctgcgtttgagagggataggtatcatcaggtgagaaaggcttgggaagttggcttgctcacttcggtttgggcttagcaggccacgtgggaaagtgcctgcagtggccttgtttgttatttggcccacaatccaacaagggcctaggcacccccccccccccccccacccaaaactaacaagatcgctaccgcctggagcacaggcaaacgtacacacgccatgcgctgcgggggtatgcagccaacttgcgagagaagctcgtggtacatggacgtagtaccagtaggctcgatcagctgcacacgggcgcgtgcatatgtgcacgattgcacacgtacaccaaccaattgggagaaacggaagtgcgtagtggagaatggtcaatcggaggaggagggaccaacggtcaaaaggatggacaatgatgcgagaggggtgtgtgtgtgcgacctgaccacccctgctgcagctgagtgcacagctaagctgggggcgctgcctccctttcccctgcaagaaagcccagtaacccgtgggggcgcagcagctgctgctgctcactgcacaccaatcgcaaccgtcattggaatgggctggaccacctccctccccttctctccattattactgcctctttctccaacacgtacaatactcctccgtgtatgtatggctgtatttagttggatccaaagttttgattttggttaaaattgaagataatatgactgaaaagttatgtgtgtatgacaggttgatgtgatggaaaagtactgaagtttggatctaaactttgaatctaaatacagcctatgtactcatcacggctgcttctgaatctctgcttcatacaagaaggtgtacgtaacgtacgcaccgatccatctggatttggcctgcaggttagcgtcgtacgtcgtcccgtgccgtgcgcgcaggttgggtggccaatggtgcgttggtcaagcgcacgatcgatcggtgtccaaacacacgggacgtacagagagaggcagtgggtgcatgtggcaggggagacatggccgcgccccagaaacccaccacaaaaactaatcaatcgtgcagagatcgaatagctaaaagccatgagccagtagccgcgcagtctcccgccgctattattgatctcctttcgtctccatcggttgatcgatcgatcgttgccgggaaaagcttgctagctgctcgcctgttcggccccgcccgacagtagcgccatcttttactactactactactaatcggtccatcaattcggtggatccagcacaaaaaaagacattagcaaatcctccaaaagattggcaagaacgttagctagatcttgtgttttctactagtaagtcacaagtttaccagcatgttaggagttgcatttagccgccgtagtacagtacgtagttcctaagcctcagtttttgcctttgtctttttttttccccttctcttaccataagccggtctggctgattgcgttgtgtaaaaaaactatttttcttctaatatattaacgtgcaatcattttgcacgtttgcgaaaaacaagtttaccagcggtcaagctggctagttttggtactaatcttgtacgaggtagggttgtgtacagattcataatttcagaatgtgcggaggaagtaattatgaacggttgctaattaaccttgatttgtacttgaacctactgctactccgagaattgtaaatctactgtacagtgtatatattgacgatggatgagggggagatgtagtaaagagtgtggaaatggagggggctggtgatgcagtcactaagctagaagtagctcgttggttggttggttaggttgcatgtggtaaagctgacatggatgtaggggaaagcggggtcgagagcggacgagaccgtcagatcgatgcgcagaagtggtgctgtttgtgatagattccgcaggtttcaggacaagggcatatgcagcgagttttgctcttgcaacacatcaatcattggggaaagaaaaggagggagcggtgctttatatgctgcgagtatagtagcggtggattgttactgccattgctcgttaccgctgcccctccgagagtagcaaaaaccacgacgcaaccaagcggtttttcttgctccgagttggtagtacgtagtgatttgttattacagtcattgctcgttacatctgttcctccaagagtggcaaaaaccacgacacaaccggatggtttttcttacattcggaaatctcaccgctacatgagtagcagtattagtaaagctagcgttgtgatagaacctagacaatgaagaattataacttgttatctacaatttttctgtcagtcatcataacgcgtgtcagtgtttatgttgacaatcatcctgacgagcctactagctggctccaacactgttatctagctgttatctctcattcatataatagtggtatgttagttgtaataactaattggaagggactgtagacaggtttgaaaagagagagaccttggtgagagagctcttgccgaagtacggaagtttgtgagaatctcctacaagacctatgatagacttatgtaattaccgattctcttgagaaaatttggggggggggtgtagctaatgaaaaaaaaaagtgtacgtgcggtacttaaacttgtattaattaatgtgtcatctaggtccctaaactcttaaaatgaatatccaagtcccagaacttctcatagtatgtcatataagtcctaaatcgtcacaaccccttcaggatcctacgtggcgttgacgtgtcatgccacacggaataacgtggcatcattttaactgacaaataggtcctgttaaaaaaaattcctttttctttttttcttctctttttttccctttcttctcctttctctgtgacccaagcagaagaaaggaaaaaagaaagaatgagaagaaaacgaagaaaaagaaaagaagaaaaaaaaaagaaaatggcacgtcacatccatgtggcatgtcacatcagcgccacgtaggatactagaggggatgtgtcgatttgggatctaaatgatacactttgacaaattctgggaccgggatatatattttgagagtttagggacctatatgagaaaaccctacaagtttaagaaccgcaaatacactttactcataaaaaaaagttggctcgatcagttctcattagccgtagcagtgatggagctaactatgtacgttattgggtcttaggcaatgaggagctcaggttattgatcaatatttttttgtcgattattcatggtgcacaagacaattcggtttgccgcctcaccagcttggtagcatatgctccttttctttttagagaaaaggcagacgcccagcttttcataaagcataacagagagtacagaatgctagggtttccagctttacaagaagcaacacagttcaaaataaaaggaggactaatgctgctggcacagccaaacaagccagagataaagcaaagaaaacaagtccatagaggaagcagctttaagatcaggacgccaaatcttctatttttgcctaagcctagctgatcaaattgtgctgtctccatttactccccatagtctttgttgtagccatccttcacagatgcaaaatgctggggtttccagctttacaaaaataacatagaaacaaaacaaacgatgagcccttgctattgacacagccaaacaagccaataagacctcatgttgacatcatcatcatctgttgttgtctccgagcgcgaggatactggcaagcagtgagctttgtgccgtctccaattctccccttagttttgctggagccatcttcctccactgaattgcaaaagatagagctctgtgaggcaaagtcataatatctttcattagacgattattaaacacccagtcatttctaattagccaaattgcccagattccagcagcaacatatacccacaaagttttgttatctacccccctctgatgttgaatgatatcgagcattttacttctgtcagtaggaattctatcccacccaaaggcatctctaaaacaacaccagagaaactgagttggtgggcatctgaacatcaagtgatccacatcttcctctactccacacagcttgcataaggggctgccaggccacttcatttttttcagttgtttagcaacttggattctccccttaatcattaaccacataaaattttttatttttataggcatcggtgacttccacaaaatctgaagctgagcatctttaatgcccccaaaaaccatctctctatataaggactttgtagtgaactttcctgacttttctagcttccaaagcatcaaatctctttctgtcgataattggatagtagcaagctttgcttgcagatctgtccattcagccacctcctcttgggttaaggtccttcgtagattaatttcccagtgccttctttatacacttgcttaaccgtcatccctggatcagcactgatgctataaatgtatgggaacatgatttttaaaggaacctcccctatccagatgtcatcccagaatctgatggccgccccattacctaccacataggcactgccaaggttcatccatcttttaacctcgtgcagacctttctaaaactgggagcccccctcaacagatgattgaaagaaacctcccccattagctagatatttgtttctgagaaggttgcagcaaagactatcagttccagattccaacttgtaaatccacttacaaagaagagcctcattcatgattttggtgttgagaaaacctagtcctccatcctctttgggtctacaaagagcctcccatttaatcatatggtactttttctttccttctaaaccatccaaaaaaaacctcgctctgatagcatccattttgtggtgcacttggtctggtaataagtagaaacccatcatgtacatgggaatactacttaaacaagagttgatcagtatcgatttacctccataagagagaaaaccacatttccaggtagccaatcttttttcaatcttcgcgactggcactcctaaatcttttgctgtcagtctcccctcactaacaggaaggcctaggtaaaaaataggtaactcccctcttttgcagttgaagagatcagccacactctctgtgcttcctgttcctctgctccaatcacaattacttcactcttttggaaatttatcttaagtcctgacatagcttcataacagtataagagaaatttgacagttattatgttctcctctatgtttgtcatgaaaagtatagtgtcatctgcatattgcaggtgtgtcagccctccagtgaccagatgtgggactaacccttgtaagtgaccaccctctttagctttatttagcatctcagaaagagcatctgccaccaagttaaacattaaaggagacaggggatccccttgtcgaacacctttgtgagtcctgaaaaatttctccacttctccatttatattgatagccaccctacccttagttgtagcatctttcatccagccaatccacttttcacagaagtctttcctctaaagtacatcaaacaggaagtcccaatgtactttatcatatgccttctcaatgtactttattatatgctccttttcttttggcatactataagtaagaaaaacttcattgttcctaattatatgcaaggaatatataggttttggtttcatgtacctttattttaaaaactcctatgaaaatgtgttgtacagttggttatctacacgcgtatgaccgaacggtgagtgagattctagtgtaatacagtaattttcagcgcttttgttgtcaatattattccttaactaccttaagcctatattggttaattatctcagtataaatgagataaaacatgaggagtaattgcattggagcatatataacgtgttggtgccttaatttgtcgttgcaaattaacatatgacaaccatgttcacgacgtactccctccgtacttataaaggaagtcatttataaaaatgtttaagtcaaaccttaagaatataagtcatgaataactctcaagttgttgagtttgaaaatataaaaattatatgtatagatttgttttgaaaaatactttcataaaagtatacatatatcacttttcaataaatatttttataaaaacaaaaagtcaaagttgtgttttggagaccgtgtcgctgttctaaacgactttctttacgagcatggagggagtactaaataccccctatagattcacacgtgtgacagtgaactgaaccgcatgcagcaataattaaccagacgtgccgtccatggacgaaacaacagtacatggcgggcaactgcgcgctgtaaaaagccgtcaaaatgtagcccccaatgacccgggacggacgaccgatcagagaacagaacaaaaacgtggagcaatgttgatcgtaaggtgattgtgggctcgatttatatatcgttcgcatgcgcaaattaattaaagtggccatacatatatcagcagctcgtagtacatgttgctgggccatgcatggagaacgatgatcacgggcagtaactccaaattaatcaagcttgcatacacatgtacgaatattgttcatgtaatgcaactatgcaagtagatacgtacgccgtatggttcagcagaaatataatcggctgacaagtctgtctgtgcactctgcactgagagcaacagggagcggatgtggccgtgcgtgcgtgcgtgcgtgtggtcaccgttgcagtcaagttgacgaagttcttcacgggttgcccggtcgggggagcccctgcctgtgccgcccgggaccatcgatccatccatccatccatccatccatccatgcgtcgcgcggcgccctgtacgcctgtacgcccgcgccgcacgtacgtacgtacgcacgccatcttccgtggtccaccacaccgcccccgcggtttggttggataaccccaacacaactgcatgcggcctcgtgccaaaaacggcttctcccacaggaaaaaacggtagaaattttcctctcctcccggatcgcgacgcgcatgcagccgcgatggggggagatggcgcgcgcgtgctacaccggtgcgggggttggtgattggggaccacggtggttttcacgtacgagcgccgctagctagctgtggaagtcgatcgggataggggaggggtcgcgccgtcgccgtgtaggggtgtgcagctcgatgattgagttgtgtgtggtttgcatatgcacctgcaccaattattaattgtggcgcacaccgtccagttatatgcatgtttcgtacctgggtaaatccaactttggattcgcttgtaccacgtgataattggtgtaggatttggcaccatagtaaacagcactagagcagatcagcactgtcattcacattagcagaccgg

SEQ ID NO: 58261 - DNA, 7770 bp, Oryza sativa
cccatatgttaagtgaggtattattttgtaccttattcgacgtattagtactcggataatttatataggcctatcgcagtctgggtcgtagaaacattatatggatttaaacaaggagaattatgtaacatgaagaaatagtagtacaatttgaacatgatacgactatttgcattgcgattacatagatgatattagattcgaactaggagggaggtagtgcaatagttgggggcaaggggccgcctgcaaaatagccggccccgactggcttttttgtattcgggccccttgccgccccaccagagggcggcaagggttttcctgcaaaaaaaccctccctccgtcaccgcccgttcctccccccgtttgccacgtcagcttgccgccccagaggtgggcggcagggtctatttttgtaatttttttggccggtagattatttctgtaaatatttttttaaaaaaatctaaaaccgaaaaaaattctagtttcggctcagctcggcccatctggaaagcctatgggccggctatggcccatggatagagtgcaatagcacacgcgagattcggggtagcgcaaatgggcggcggcggcggcgggaggccgacggcgagcggggcgaacagcagcagcagcagcgatgatgacggggacgccgcctggaaggcggccatcgaatccatcgccgccgtgggtttcggcctgccgctgtccaacggcgcggcgaaggccacctctggcggcggcggcgaggccagccacggcgtggagcagcagccgccgcaggaggggaaggcgcaagcacctgggcttaagctttaccagatcaaggttatttcgtgatttattcttgtttgctgctgcttcccgttccttacttataatcgattggttcgttcatgccccccagggataggcagttaggtgcgtaatgtgttactactaacttaacgcattcacttctatgatattctaagctgttttgcttccacacaattatttgttctatggttgattcggatactttgggaaaacgcatactacttcgtatgaatttcctagcaatgttactaccatggagagcacatacatgagtcatcaatttacctatgacccccttcataattctaatagcaataactcctgatggttggtacccttctccatctaccgagattctcgatgacaaggcaaatctagtgccattgtgaatgataactctcaaaggcatatatgacaactgacaagaatataaaaaattttagcaatttaggaaaaaagaaaaatagaaacaaaagagagagccatagattttcagaaacatttgagatactctgtcaattttatctcatcagttagcatcatctaattattgtagtgagtgttgagtcaaccgatgcatggccatttgagagttaagctagtggattttattcatatatcctatgcagttattcgtagctctcttgcatggtttttttatgcataattgagttgatccaaactggaaagcctagagagaaactgtaagatgctgtgacagtgttattgatttggagctgtaaatctgtaactacaccaccacagtttcaccatttcattatggtgagctgttcctactttaattttctctttgccttttgttcagttatgtttatgtgtttccttttatggttgggaaatttcatgctgcgttgtaatctttcaagttccaaatggtttgtttcaggtaaggaacatgttggacaacatgttagagaaaaaccttgaaatagtcaaaactacctgttcgaacttggccgatcctatggaaacagatggagggataaaattatttaaaaaggctccacctggcatcagaatggatgccatgggtaagtgtcgaacaacaagtattattttcaacaatattattgggtaagatctcttgtgttagcaaaacatacttaactgtatatttccagataaataccatgtgcaactgaagagaccaagaattctgcctggaacagatatcgatgagaaatccaagaaggttggatagccattatcataatataattataaccatgcttgaagtttttttgtttaacttataatactattgttccgttgaccatgatttcagttcaggcatatgcttaagtctgttgctgttgatggcaatgatatacttgtttccgcaaagaaatcatcagaaagatcattggctagattggaagcaagagaagctgcagcgaaggcagcagccaagagggaagaagaaagggtgcgggaactgaagaagactaggggagagaaatggcttccttcaattgctagacaaatgaaggtaagaccaaacataaaatgcatactgtaatatgttcttccagagaaaggcccgggggtcttccagctagccggcccgggttcgatcctcgctcttcttgataaattccaatatgagagtccctcattttttatctagcgtaacatgttcttccattgatagtttggtgggattaggatgggaatcaattgatatttgagcggctcttctacacagactatgcaatcacacactgaattgctcctctttcttttccctgcgcaggaagaaaaagcttgggagcaacggaagtgatgatgccaccatcatatcaataggggtacctgtgctaatctctgatgccatcatcggcacttcggcagtgaccttcttcactttctgtctatgacaagggacagtagatagatcatagattaatggatgattttgcgtagctgataattcagttctggatgtcagcattgctctgatccctatatgggccttctttgtagacaattttgtattgtaacattccaggatcttgtgtgatgaaagtagcgtatgtatgcattatttggatatgaatctaaaaagcttaaacaactatagttttgtctgaagtttagaaccggaagaaagtggcgagttgtcaccagcagtagcttcaacgaggctggccaattcagcccatgggctgcagcttgtagcctctttacggcccaaccggagccctcccttgccccaggatttctccgcttccctcgtcccccaccttgccgcgccgtcacaccgccgccgcctcctcgccatggacaccccgccgtccgccgccgccgccaccgccaccgccgttgcgtcagactctgattgcgactccgcgctcgtcgccgacgtggcggaagcgctcgtgtcggcgtcccgcctgccggagccgccgcctatccccgccctcctcgccctctacctcccgcgcctcgccgcctcccaccacccgcgcgtgctctccctcgccgcctcccacccggggctcgcctcgccggacctgctcctcgcctaccgccgccacctctcgccgccctcctgcctcccctccctcgtcccgctcctccccgtcctcccctaccgccacctcctcccgctcctcctctccttcgtcccgctcgacccgcttcgccacctccaccgccacctcctcgcgcacctccccacgagtcccctcgccgatgccgcgctctccgcctacgcccgcctccgcctcccccacctcgccgcccagctcctccactccctccgccgccgccgtggcgttcgcccttccctccaggctgccaacgccgtcctctccgcgctttcgcgcagcccatccaccttgccgcaggcctccctcgatgtcttccgctccctcatcgagctccgcctccaccccaaccactacaccttcaacctcctcgtccacacgcattgctccaagggcaccctcgccgacgctctcgccacgctctccaccatgcaggggttcggcctctcccccgatgccgtcacctacaacacgctcctcaatgcgcactgccggaagggcatgctcggcgaggcccgggcactgctggcgaggatgaagagggacggcatcgcgcccacgcagccaacgtacaataccctcgtgtcggcgtttgctaggcttgggtggattaagcaggcgaccaaggtcgtggagtccatgacagcctacgggttcgagcctgacctgaggacgtacaatgtgctcgccgtggggctgtgccaggcggggaaggtggacgaggcattccggctgaaggatgagatggaacggctcagcaccgcgttgccggatgtagtgacttacaatacacttgttgacgcctgcttcaagtggcggtgctcatcagatgcattgaggctgcttgaggaaatgcgtgacaagggggtgaagccgactttggtcacacataacattgttgtgaagagtctttgcaaggagggtaaattggaggaggcattggggaagctggagaagatagcagaggaggggttggcaccagatgtaatcacgtacaatacgttgattgatgcatactgtaaggctggtaatgtcgcaaaagcattcacattgatggatgagatggtcggaaaggggctcaaaatggacaccttcacacttaacaccgtgctgtacaacctatgcaagatgaagcgttatgaagatgctgaggagcttttgcattcacccccgcagcggggtttcgtgcctgatgaagtcagctatggtactgtaatggctgcgtacttcaaggagtataatccggagcctgctttgcgtctgtgggaccagatgattgagaggaagttgataccaagcatttcaacgtacaacacgttgatcaaggggctttgtaggatggagaggctgaaagaagcaattgacaaattaaatgagctcgtggagaaggggttggttcctgatgaaaccacatataatatcatcattcatgcatactgcaaggaaggggacctagaaaatgcctttcgattccacaacaagatggttgagaattccttcaagccagatgttgttacctgcaacactttgatgaatggcctttgtctgcatgggaagctagataaagcattgaaactctttgaatcatgggtggagaaggggaagaaggttgatgttatcacatataataccctaattcaatcgatgtgcaaagttggggatgttgatactgctttgcacttctttgatgacatggaggtcaagggattgcagcctgatgcatttacttataatgttgtgttatctgcactatctgaagcaggaagatcagaagaagcacataatatgctacataagttagccgatagtggaaaattatctcaaagctttgcttgtcctctgttgaagccttcttctgcggatgaagcagatgtcaaggaacatgagggtaaacctgaggcagaatccagtgaaaaagcacaagacaatgctctggagacatacatggaacgcctaaatgggctatgtaccggtgggcaattgaaagaagctaaagccgttttggatgagatgatgcaaaaggggatgcctgttgacagttcaacatatataactttgatggaagggcttatcaagagacagaaaaggcaaacccatgcagctggacagtccacactatagatttttgctcccgtgggatgcgggcatgtgacatcattagggctttagtcataaatctggaaaactcaagtgcttggctaccaggattaccatcatggacaaaaaaaaaagaagtcggtatgtcaacattttttttctgcagtcagaaccttatatttgtaactttcagtacaaagtaaattcatttttagttttttcactgcacgctatgttaaatgtataaagaataccagcagtgatttgaatctttttttgctcctggtaaaatagtgtagcttctagattccctccaacataaaattgttgagcttctacagaaaaatatataatcatgtgcgagttcttgatcataacctattaaatcctaaccacccatccatcttcaacagataagaattgaaaattgtcgatgactatacttagtaaaacaaagtatcttctgtgatattgtaaaatacatcttgacaatacggtccatgttcaaccaatatatatgtcttaatcaaccttgtaaaccataattccgtgcaatcaggcatttactcttggaccttctctgcttgaagttttcatagctgtcacatatgcttgtgtgattccatcagcatggttgagacttctgttagttttcatgaagtatgtactgggtagttggacattcgggcaatgataagtttactcattatacaatgacatccaacagactatagtttcttttgcagttgaaaaaaaaaagatagttacttgcatctattggctattgatgaagtgatgaaccacagattcttatttgtggtacagtgtgatttttttttgttcttgtttgtgaggaaaaaaactgttgtagaatgatgtgcgtttttgctgttcaatcgtgtttatttgaaatatgtttaaactttttttatattcatttcctactagtgatgccttgcctgaattcagaataatatgtttcgacaatgggtgtctatacacacacatatgaagtatgccttgagaaatgttaaaagttatgtaaatgaattgttttaaagttgtccagaccataatttgtcattgtacttaaatatatttggattgtatgttcttttagtcagtggcggagccaggacccagcaacctgggcaggtgcctgggctccgtccaacgcatgcatgactagtaacctaattaccatgcatgcttagctagtcattgtcccagccatgtgtagcagtagtattatttaattaccatgcttaacaaaatagcaaaacaagtgcttgaggattgtcaattttacttgcgtcattttgtatggatttatttgtactagttattcatcaatttttgttagccttgcctcattgcccaggctgaagataatttctagatccaccaccgcttttagtaattttcttctatatttaggtttatactctactgttcttctgactgtgttaagcctggtatttctaaggctcatctctcaactagccaccttgatgatcctagagaagttgccaggacactgcacttcccgatattgttcacccagaaccatctcagggctttattctttcagaaccatatcaagatcttagtcattcagaaccatcttaggatcttattcatacggaaacatctcagtgacttgttaattcagaaccatctgaacataacctcgaagttcaattgttgctgcctctggagctcctggacgtgttgtgcaagcattcataatgtaacaggagagccctggagctcaggtacttccccccaaatttttcattgctaatttcaatagagtcaactgtcgaggcaagctgttcccataatttgccggtttcaatgaggattaaatgtcttttattgacattaaagtttcgtaaaaattgaaccctattattagaaattcatatgcaacttaaattgacattgagcacaaaaattctagtcttcaatgcaacctcttttatgaacagaacaccttgggaaaaacactctcattggatgcttttaaagggaagaaaactccacacaaataattgttcacttaggtgcctaaaaattttgtcccctgagtgcttttaccattttatgttagtttggtccaagtgcaaaatttgttccttaaagtatccttgttgtactgcaaacatttattctactacttaaatttgaggttcttttctctttgaaggcttttgtaacaattaattggaatgaacgtttggagcgttgattgcaggtcgtagaacgtttggaa

SEQ ID NO: 58262 - DNA, 42532 bp, Oryza sativa
cggatggagcagatatcactactttccttgcaccaccctatataagccagatggaatctcagcattttttgcatgtgaatggcttagtttattttctgattggccagaggggttgtgtaaatgcagaggcaaacctttaagtgtgctgatgctttctcagttgttgtaaaaacaccagatgattcaacaacatattcagctccaaagtttccccaaggaatatctgagggatctctgaaatggaaaggagaagcaccaacaaataattttagcaaaactaaagcacgtgggagaattattacaacccaaaactatataacaagaatataaggagtcaagtatgtcaaaagtacaatttttaaacaaaaccgtggattcaaccagacctgaagaattcatgttcttaccttttgcttgtaactgaaattttcttcccattaatctccaaggttgactcatccacaacctttatggtgcctttaaatggaccatgtgtcgaatcatacttgaacatataagcctagaacaagaagaatatcacgatcaaagaacttgaaatagtctaaatgaaacatatgaagttgtagcactcaatacagttatgttcaaaaacagtttagtaaaggtgaacctgtcaattttctcattaagaataattatggttatctgaaattaacaaaatagtaaaaaaaaaaaagtgaatagcatgggttgggttcgtgttctcatgcaagacacacctccagcatgtaaaggaccttatataggaatgccttttctctttaagatcttatgtcagataatgataaacaaagcatgtttactaagttaagaagagctaaagagtacttaggcatattatcatattagagtaacaagcatttctactcaacatgtttacactgttatttgtagaaataatataaagatacattgaacatcatcggttccactgcaacaggacgtaatacatactgtgcttttccaaaatctatcaacagaacttaccatgtacttagcatcgataaaaggatcattaacagccacaacttcaatgtcatctctattagttgcaattcgtagaaccaacctcccaatccgtccaaatcctgcaataacaagaataaagagttcctttacaaccaaagactaaataaagatcaaaagtaatttaaggtcacctacagaagcaatgaagttgaacaagggttcacttcaacgttccaagttgagttagcatagcgcaacttccaaatagtaatcatacattacaacaacttgataatgtcattatttttccaatctacaggaggaactcaccattgatgccaacctttgtcttctccgtgctagaagattctacataaagaagaaaaaaaaataatcataacaccactgcagtcctcataaaccccttttagtgtttgatggatggagcaacttacgatgggtggcaaggggtgcttgtgtagcagttgctctcaccggctcaacgctgctagcactgcagtagaaaagcagtttattgaaaatgcaatgtgctacagctaatactgatcaaccgtatccatgatatgcacagagcaaaaaccacaaaaacacaagttgagaaaacgaggggtcaagtccgttttgctctcagaaattttccgctctaaccaacagctgtgctctcggttgtcaaattttgttattcaaggaattcgaataatctggatgatggaggcactcacagtgaagacgaagccccaacggaaggaaaaccgcaggtaaccttgctcctaacgcacgacacctgcaacacagcagcaacatcgatcaatttggtggaaatttagcaagtttcaatctgcgaaatcatggctaaacaaacgcgaacgaatctcaactgaactcggaaaatcaagcgaaatacaagcaattaaagtgggaaacagctgagtgttcactacaatactccattactcctacacatagaaacaaaaacatcgccatacgaacaacagtttcatgcgcatgagttggcagctgtcagtcacacgaaacaggaacaggttctcaccgaagagaccaaaaaaaatcagagagggagagagatcgggatggcgaatggggaccttgacggggtcggcggcgcgtgatccgccgccgctgccggtgccggcgatggccggggtggcggaagcgcggagggggacggcgagcgacgccatgcaggtgcggcggcgctggaaacttggcttcctctaaggaaggcggcggaatggaggcgggggcggaggagacggcgagcggagttgtgcggcggcgggggtcgtcgtcggcggcgtggttccgtgatgcgtctcccggtatctcggcctcgggcggagttgtttatggctttattattacttgtaggttttttttctttctgtgcctcttttgttttatcgcctcatcttttaacttatacttatacttataaacataagctacaattaaaatttttaatcttaaatttaaatttaaagttgattttagaattttttttaatttccatcctagtttatttttcagcttaaacttttaatcttttagatttttagattgttaataacatgtatataaaaattttatttacaaactattttctatttgtaaatatgttatttcacaaaactatggagtccttagtttgttctctctttacatttgaaaaacgtgtgaaaatatttttattgaggattgactccgataatcatttacagttaggatcgggtatatctatcagacactgttagtacagtacaggtgtagttttgcaaaggatccatatcagtaaattttggaaggaaaaaaaccaaaaagagaagtcacgtgcttttcttgtgaagcatctactacacattttgtgagcgactcatgcattctgttgtaggttcttcaagaacttcgtatgaccatggacatttaaaacttcgtatttcttttcccttgtgttcgagaatatttggaaggagttattgctcctttcggtgtatgaaaacagcaaagaataagaccaaaaacctgcatatattaaaagcgcgaggtttaacgtgggcctacacgaataattgcacagtacctttcacgaatctacggtttgtttggtttcggtcaggagacggatcaggcgtcgcgaaacgtttcgttgcatccgtccgatctgaggcgaggcgagcccggcccggcccggcccaactgttcgtcggagctacccgcctgggggcccaccctcagaggcgaatatgccaaactttgatgcggacgagtccttccctgtgtccgccgtctccatcgacacaccccaaaggcccaaaggtgaccccaaatactactctacattttgaaactgtggggtaaatcactcaatgtcttcacttagggcctgtttacttggggaaaaaaaaattttaggtgtcacaccgaacatttgaccggatatcggaagggattttcgaatacgaatgagaaaactaatttcataattcgtctggaaaccacgagacgaatcttttgagcctaattaaaccatcattagcacatgtgggttactgtagcacttatggctaattatggcctaattaggctcaaaagattcatctcgcaatttacacgtaaactgtgtaattagtttttctttttattttatatttaatgctccatatatatgtccaaagattcgatgtgatatttttgagaaaagtttttgggaactaaacagggccttaatcagactatagaggtcctgtttagttccaaagtttttttttctaaacttccaactttccatcacatcaaaccattcatacacacacaacttttctatcacatcgtatcaatttcaaccaaactttcaaacttcagtgtgaactaaacacagccagaggctcttttttttccctaataggtccgctagttcaatcccaatagctatgatccttccttttaaaacatggtataaacacacgtactcacaacacgagcgcactttataaacacacagagacaaaacaggatgtgaagggagattgtgaaacgagacgaaacgatggtcgggtaggcaggcgccaggcgcgcgggagaacggttggctagttgaggagggtgtgaaataaggatgttataatttattattatattgtttttaaatatacatgtaggacgtgacgtttgactatttattttatttaagattattaaatattgaaaaaaataagtcattgctgaagtatctttgatgacaaacaacggattaatacttaaatagattttcaattagactaatgataaaatagcatgtctaaatatactagcttcattttctaaccatagttattttctatatgtccagtgtaatacttaattatcacatcaatcacgtatatgtaaatattttccttatgttatctcaaacaaagtttcctcccaaccttcatttaacgggtagcattacaaattatgatagaattatcttcaaaaatattgtaagttttatagtgggacacttttaaatataactacattatatttataatataattccaccacaactatacagtaactacaatattagttgtatataagtataaaaaatatatgtaaatttatacctaagttatatgacaacatatcctatgcacacagtccttcacgtgtacacacgtgcacaccaactaaaaaatgtcaccaaaaaatctagaaaaatcatacacatactttcaattgtattacacttagggttaaaatcttaacgtcaaattcattatattttagccataacaaaaaaacaaaaaatctgacagttttaaggttgtaattttgtcagaattttatcttttttttattctctatgtagaatgaatttgaagatatgactttgcacgtagatgtaatactattaaaagtacatgtatgaattttcctagaattttttgtgataatttttagttggtgtacatgatgtgtacacgcgaggacctgtgtgtataggatacgctcccaagttatatagcgattataatgtaacaacagtataattacgttgtagttacactacttacattttaaagctttttgcgacagtttttagcaatttttttgttaaatcctaatctcacttaaacaaccaaacaatatttatatttggaaactgagagagcagtatcaaagcttgccttgaagtcaaattttgtatcaaataatcgcccgtaattacgccgtgccgtcaatcaaatctggcgagagacgaagcgaagcgacgcacaaccaccactccaccagtgcgcgcgacttccgagacgaaccgatctgacggacggagagaacgccatcctcgatccaacggcctagatcctccctagcctcctccgttcccgtgtcactataatggcaaggcacacacctcgtgccacacacaaactgcaaccaagaactgccgccgccgccgccgccgcctgtgacctctcctctccctccggcgacgtcggcgaacactccgtcaccgatgggcagcgcccttttctccaccattgccacctcggtggaaagcctccgcgtcaccggcgccaacgccgacgtggacggcgtcgccgcggagaagaagccgccccgcaacgacaggaagaggaagaggaataagggcgcgagcgggaggacgtacgaggagacgcgcgccaggtacccgctgctcgtcgaggcggtggaggcgctcgccgctgccggcgagctcggtctgccgccgccgccgcacgtgcgggggcaccgtctcctgctggaacgcgtcagcgaggacgacgcgcggcggctcgagcgcaagctgaaggtggaagagctcgcgagggggaagttcgagcttcgccggcggcggctcaccgcgtcgttgaaggaggcgctggtcaaggccggcgggcgagcgccgaagcttgagacgatacaggaggaggaagacgacgacgacgacgactcccacggcgacagcaagaggaggaggaaggcggcggcggcggcggaggaggaggagtgcgggcgcgggaggcggcagtacgaggagatgcgggataggtacccgttactggtcgcggaggtggaggcgctcgccgccgccggcgagctcgcgctgccgccgcacgtgccggggctccgccgcctggtggagctcgtcggcgggtgcgacgcgcggcggctggaggacatgctgaagaatgatgcgctcatgaaggtcgtgaccaacctccagcgccggcggctcaccgtgaatttgatgtctgcgctgatcaagaccgaggagaagcacaaatgaatccggcgagccgtcgatcgccggtgcaatgcagcagtacagctccagtgttttgggttttgcagtaagctcacgcatggctgcttaaactaatcagtatcattagacaataatgtagtatataatagactggagtagtatcttggaagaagaaccctaaacccttgtttggactttggatagtggagggaaatttaactgaaatcccgggaaatctgaatggattggtctgattgatccccatgtatctggagtattttttatggcagcattagctaatcagcttagtggtggcaaactgaacttttggccatgcatgtcatgtgtgataatgttggaacttggaagaactcaattatgttgatgttatgatgcttgattagaacttggaagaactgatggcagcattagccaattagcttattagtaagtataatgtcaactttcagaacctgaataactcctaggtcctagctcaacagtgctgaaaacctacaacttgattaccagttgacacggctaaacttcattggtttggtttatggaggagcatcaatccccatatttctcaaccgttgggcttggaaaattgaattggagaggttcaagtgtccaactcaaatccctttggtttcgcagggatagcagtagaaggttttcggatttttcataatacctatttctatacaagcttgtaggttcatacgattatatattggcagcaacagaaataaactcatatatgttttgtttttttgttttttttttttgtttttgctgtgttcttaatctgatccgcagttgcttcccatgtcaatccaccggatagtccagcatatattgtttactgtgaacttttgattttttcagatatgtactgcttcatggccaagctcaaatttaaatcgtgaatgttccagtaggtcgagcatgatcaaaacaccacttcatgtatctgatatatgcatccaaacttgaagttcaatccatgttgttttactgaccattttacacttgtacttggtgaactgaaccagagttcctgcatggtcttgttaacagaatgtgaaatatctaaacattgaaaatagaaagctagaatttacaattctttatagcactgctcaattgctcattgttgggagagagataaaaggcttacatatttgctcctagtattgggcattgtctactcccctcttcatgcatcagggtattttggcattgttctgaaacaagaagcaatcttcagtccttcacaatcattttctccaataacacagccttcaactactccttcatgaacagagtctccagtgttggatcgagctgcattgccattggccaagctcggattaagatcacgatactaattgcactcggccaaaattccacttaatgacaattcattcatacggccaaggtcaaagatccggggttgcctggctgactctatttaggtctcattacccaacttgcttgttagctactgaatgataaatcaaattgaaaggcaaaacacaacatcaactacgtgaaaaataaaacaagcaagcagaagatggattagatagctagctgggcgcggctgcttgaagttgatcagcgtggttccctacttcattgcgacaaggcaatgtgacgacggaggttcaaacgggtcggactttttttaactccgaacccctcctggtagagtggtaggctggggccatctcatggcccaaatggagatgcatttacatgtagatgggctgggattccggcctggtaaggcccaataagtagcccaatatctccatacccttcacagccagccgcactaaaatgtgagtcaagtggcctcaccaaataaattgtgcatcctttgtgtaataatttattttcagtgtttctgaacctctttttcatagtataattgcagtaatatagactaaatcagctaagaattttttttaaaataagcttgaagttgatcagcgtggttaacaactacgccaagacaatgaaaaaacggaggctcaaagggaattggaattcggagtttacgactcttggtcccgtcgcatggcccatatgaaataaacatgtggatgtgccaggtctcgggccctggtgagtcctcaaggcccaatatctgcctctgtttcaggcctcaattccatagcccatcagtacatcgcctccacgaattcacagccgcagacgcgacgcgatccattcgttcatctaccatttcatgtccgaagcatatatactatatagcagttaccgttccgattctgggaattgatcatcatgtcggcatccatgtcagccatcaggctatgacaaaagccaaaggtaattaacataccctaaacatggcagtttaaagtggctgctcacactgacgacgacgaatctgttgacgatgaatcttactaatttgtgaattaagtgacacagagagtcagctgcatgcgtgagaccatgtgatagatcgatgttagatgcatagtagcttgcaagttggggaaatgagcaccacatgaaaagaggtaaagctagttagcatgtgtagcttgaatgcttaattagatgcaagagtacgtaaaggcaacaaaatgtgagattatcatattatattcctagattatataatctgttctagtgtagcatttgatggattcatcgtcagtgagccaatgatagatcgatgggctctacacacaaatcttgtcggatctcttgtcacctatgtttatctagtgtaggtttacatacagtccggtggctttgttaatttattcaatgatgagtagtagcctttatctttaagcaacaggacacttctctcggcttcccgctggtgttctccagttgattttaaatttgtatacgtctacgagtttttagctagctcgtctgcagggttcagtattttgattgagcgccggatagaccttgaaacggcatggagtcttttttaaaaaaaataataataatcaaattttgatatacttcgacttacttcgataacattatggtcaattatactgtttcaaatttgaattctcgaaaaccatttgaaattttaataggaatctactttcggacggtgtcaaaacctcaaaatttcacaattttcgatcacaacgtgaatcctggtcatctgcagactgcaggcatatggtaaaaccgtgatgacaacaaaacgtactacatagtttatggtgtttctgcaaatgagccaaataatgtgtgatcagctatagttaattgttcattatcagtgtgccaggatttttattaaaaaaagatgaagccaaaaaagggatcagaatgttgactagggccatgagtcatgctgccgtggtagtagactggtgagttggtgagtcgcaagtcgcaactgcgcgtgcatgtgacgaggcttgtgggagagcctccaaaaaccatgtgatccctccactgttcccacatggcgagcacgcagatttaaaacgctccgatgagatttaaaacgctccaaaatgtttgtgttgttccgtggagcatgttcttctgaccggtcaaatcgtacgaaaattcactagtttttgctgccaactatgggtacatgtgtggtttgcacaccacagcagaggactgtgtacaaccactagtaagatgactttattcccgctctaattatgatttgtgagcgttttcttgtttcctgaactaaacaaggctagctaggtaggagtaggccggattattcctccgttcaatttatttttctcagaatgttgggggttcctgaaacatctcaatcaaacaaaactaaaggaaacttattacacagtgacatatgtgcatgcatctcatctctctatgtctatgctgtgttttccgaccgttgtcaccgttgtgggccacaatgctcactctttgtgggggcagaatcgatcgataaaaagctataaacactatcggatgttcagcacacgtatcaacggatactatccgtcgcatcactgttgacaagtcacaacaacaaatgctgagttgttgcgatggcgatcgatctggcgagttgagtctcgcgtcgatcgatcggccgcaccgttgtgcttttgtccctgatatacgagtctggtaggcttcggatccacatatcagtgacaaatgagcgttgcaatcgactgcagtggatttgatctcctttaattttcggacgcaacgggcggcgcgcgcgacattggcacggcagccgcgcgtggctccgacgctcgcatgcaccgacccaccgccaaatgttgtactacagtagactactccacctcggtacgaccaaaaaaacgttggccgatgtctctgccaatctgccatgcgtcaaggtgcacggttgtcattgtcaacaagtagtgtcgtagtggtacataccgatgcaggttcatgcatgcgtgatttcttggttttgtttctccggtaccactacactcgactccagctgccggcctaagctttttttgttggagaagctagcatagcccacaggttcccttgattcctggagctggctcatccagagccagctgctccctaatcatcatcacttacattattctctttaacaaaaaacaaaaacaaacaaatgatactccatatatactactagtactagtagccatagtactgttgtagtagctacaaagagaggctcatgggttatccttgtgtttgaagccaaagaaagaaacttaatcagagacgaacaagccacaccaactttacactggtccccaagcccacatgggccaacgggaaaccacttcccactctcccactcccactccactgccccactcacctctactcctataaaatctcaccgtccacatgtacccgagacctcgaaccatccatccatctatccacccaaccactctctcgctcgctagctcatcgctcaccggccggttgagatggcggcggagggcaatgcgtcgtcgtcgtcgacggcgacgggaagggggtgcgggctggcgctggggaggttggtgaggaagctgaggaggcagagcaggatgatgctgtccacggcgacgtcgtcgcggccgccggcggcggcgaggtgccagtacgacccgctcagctacgcgcgcaacttcgaccggagtggcctcggcgacgacggcggcgacgtctccgcgcagctctaccaccgctacaccttcgcctcccgcttcgttctctcctcttcgtccacggccgctcgccggcagccgcaataggggccgagaccgatgctagctgaggcacgcatggccggtctgcgcgtgccagtgctgcgcgtagctaagctagctagcttagctctagccattagaggtagatgcactcttgttcttcatcctgcagtgttgttaattaattagtgtgttcatatgaggagggagtggtggttgtaagggatttcttccatggctctctccattggccgagatgatggtttcgatctctcgtgctgatttcttggaaatccatgcacattattcctgatataaatcgtcccattaattcctttttttcatgaaattctgaaattggctgattaaatcgccgagatcaagaaaaattggatgctcgccaactttgtagtagatgttgtgttgattgcatcattcaggctacaatagttgttacggcgtcgttgcgttgtcgctgcattctacagtagtcggtcactactactactcactagtgtcaccgctgcgccacagcgattattcgcacgggacccctgtgcccacgggtgacggtgccgaccaccggcgaggacgcgagatcgatcggtgctactagtaaataaaatttcacattttcactgctcctgcattgattcgaggagcggaagggctcgaagaaaaaagagaggaaaaatagagaagaacggttgctctgtgcagcaaatttccaacgacggaaagcaaagaacttttttttagaatcacagtataaacgtgtgcacacttaaccgtatgaatgtattaacatatatacactaattgacattatactcctactactagatttttcacgtacctgatcttgaggcccaatcgtttgccaaattgaaaacccaagtccaattataggccaggccctcttgaaggtgcagacttcagaggagactgcctgtttggggttaggctctactaatggcccattgtacttatcggcctatagcttttggcccagttctccatcgcataggctgaatatttctgcccaaagtatcacggtgatccaacaatgtaaaaaatcaagaaacaccacgagcgtaagtctcttcgctcgagaatttcgttacagccttacatacaggtagaccttcttcgacagtcaccaacatgaacacagacatgggttttttttcattgctccttccatgattactcgcttaattagtacgtcaacagaaataattttttttagacaagtacagcaataatattttgttcctagcagttctgaacatgctatgctattgggatatcaccacttcagcaggttggagccaaaaaatctggatgatgcctcaaaattctccagcaaggtcggagccaaaacatcttgatgatgcttccaattcttcaccaaggttggggccaaaacatattcatgatgacaggattgtctcaatatctctgtcactttctcatcaccttcatgatcaaacagatataggaagtctgactccggcactttcttctctttgaaaccaagatggagcgaagtagaggaatacaaattattatagtcatatatgttggccagattcaaagaattttcggacatgcaaaggcttgagacaaggggatccaatgtccccaattctttttaacatagcggctgatatgttagccattcttattgaaagagccaaagccgatggccaaattagtggggtaattcctcacttagtggatgatggtttgtccattctccaatatgccgatgatacaataatatttcttgaacatgattttgaacaagcaaaaaacatgaaggccattctttgtgtgtttgaacatctctcggggctgaaaataaactttcataaaagtgaaattttctgctttgggggagctaaggaaatggaggaccaatatagacaactgtttggttgtaattctggatcctttccattcagatacctaggaatccccatacactatcgaaaacctcagaaattctgattggaaatgtgtggaggataggtttcaaagaaaacttagcacatggaagggaaaaaataactcctatggtgggagattggttcttcttaactcggttctttcgagccttcccatgttcatgttatccttttttgaaatacctctagctgtacttcaaatactggattactaccgatcgagctttttctggagcagtgatagccagaaaaagaaatataggttagcaaaatgggattatatatgccggccaaaagatcaaggtggactgggtgtcctaaatcttgatatcatgaatagatgtttgttgagcaaatagctattcaagcttcttaatggtgatggcctatggcaaaaccttttgcgcaacaagtacttaaaaggtaaacccctctctcacatgtcacacaaaccaggaacatcccaattttggactggcctaatgaaagtaaaagatcaattttttcagtatggatcttttaaacctggtaatgggatagaaataagattttgggaagacacatggttaggcttgcaaccactcaaatatcaatatccttctctgtacaatgtggttcgaaagagacattctactttggcagaggttatgagcacaacaccgttgaatgttttattccgacgatcaattgtaggaccaaagttagttgagtggaatgatttgatttctcgactagctaacataaccctgtcaaatgaaaatgattgctttatttggtcgctacataaaaatggccatttttcggtcaaatccatgtataatgcgatcatcaattccaatgtaagaatccacaagaggatcttatgggaggtaaaggtactactaaaaatcaaagtatttatgtggttgcttcacaaaaaaagtaatcttaacaaaagataacctcataaagagaaaatggaggggaaacaagcaatgttgtttttgtaatacacaagagaccatccaacatcttttctttgactgtcatgttgcacgttttgcttggcgatgtgtcttctttgccttcaatattccccctccccacaatgcaaaagatatttttggtaactggctaaggggagtgcctagacacacaaaaaaatgattttatttggagctagtgctctatgttggtcaatttggcgttgccgtaatgatatggtttttaaccataaaaaaatgcctaacatcatgcaggttatattcatgtgttccaattagctccactcttggtgtatgatgctttcacaggaacaacaggatactatgcgtaatggtgctacacgcttgaaattggtagccaaggaacttttactccggtttggatggcgtagtacctacagaatttcgtgatagaatctacgtgatttaaaaaaaatatgattttagtatatcatattatcggcagaagttggggtttgtcctatctcgtttttttaagctcttttctattcacttctggactttttggctgtatgcctgcccggagatgtaacccatttccattatcttaaaaaaaatgttggccggattatgatttccgcagggtgtatgaacaattttgcttggattgtactcgcaataggtgcatcgacctgattacagagccaaaataaaatgggaggtgaggatatacaatggagatagatcggtgtaaaaagtctgataagagaaaagtatagatgccatccaaaattagatgtatatgattgctacattatcattgtattcattttaaggcaaaaacagaaagtggatgttactgattttaagagccatagcacacgattggtccactaccatagtctgttaaaattaattgcattttgggccacatatttctaccaaaaattcactttgaaccactcttgaagtgcttttttaactttagattaggtatttttatcaaatgttattactttgaattgggtggcccacatgtcaataagactaaccacctctattgtctatgtgtctcttacatgcgggccacctggtcgaaacatttgacaacaatatttagttcaaagtgaaaaaaaacattataaaggtggtctaaagtaaaactttagtaagaatatgtagcccaaagtacaatttacttctaatttaatttatgttgacaaaattacatatatttaccaactaccatagctgcacttcttcaacatagtacacaatacattaagataatatcgtaaagggctcagtgactcaccgaaacatgtatagtaatcttttgagtttttttactagtgaagcccggtaccaaatgtggaccgctggataggtatgatcggatggctgacatcaattggtaccttcaggtaccatttactccctacgtggtacctgccaaaggggaatgaggtggaggggtaaaattgtatttgcacattggaaaggaatttcgtcgatttgattcgtgttttggataaggctttgcagaggaaaatctacggcagtggcggcgagccggcgacgcttcaggaattacggtgcgctccaccagtcttctgaggccacaacggtgctccaggagttgttgtcagcggcgacaacggcagcattccaggagttatcggcagtgacggcggtgctccagggatcatctgcaactgcggtggcagcgctccgataattgtcttcggcgacgacggcatcactccacgggtcattgctagcgacgacgatggttgatttggttgaacagtttttgagcaagaaagatacatacaggaataaattgagaagcaggaagttccccgcaaaaaaaaagagaagcatgaagttgatttgcctaaatggcttcaggttgatttgtcagacaaacacaaaatcaatactcatgcgaaaagctccaacacaacctccattccggaacaattatagggtgcagactacagcggcggtggcgacaaagtccggcgcgtcaggatacatgttgcggcagcgtcggccatcggccccactgtcgttgccgcagagcaaggacacgctggggctggggggaggacaggcagcagcgacggcggtgacagagacgtgcgcgacggagcgagctgaggaacgatgtcatgcgtcaaggagagcagaatgcgacggcagcggcgactcggatatgcctgtgaagatgaggagatttcgtcgtcgcacgctagctggctgctttacttcatttccaatcgtaccccagtttattgaacggccggatttcgtttggtacctgtggtaccagtacctggaggtaccaacttctggaccagaacaaagctcgttcctgcagcagcaatcacaagttcacaatccagtggatgaaaaagaaaagttagtcaaataagcaatcgaaaatttgagcaggagttcaaatttgttcccaatttgattacccaaggatgttgtctgcaataggtgcctagcaattcttcaaacttggcaagaagaaacttctctcgcttcacaaaggctgatctcaccgttgatatttctgacagggcttgtgtattcagtgggttttcagatgatgatctctttcttttcagtcctcggattggctgatgtccgtggatcatcgtgttcagcttctcccaatcaacgtcagagatcacgcagccggaggaaccgaaatctcgcgcgggtttcagccattggcgcaggcagtcgaggttctcgccggagagggagacgaggaatgacccgatcatggcgctctgggggtgatcggaagcctcgccggcggcggcgtaggggtttctcttcttctctctgctgctgttctgaagaatttcggtgaggtcgcattgcctggaccagaggtgttcgatcgcctcatgctccgagatcggcttgccggcggcggcggcggcggcgcggacggcggcgacaaggccgtccagtgaacggcattccacacggagcatggcgtcggtgtcaaagatgtctcccggtaggtcagcctcgtcgtcgggcggaggaggagcggcggcgtcgtaccagacggtgttgaggatgatgttggaggcggggtcgagagggccgtagcagtgcccggcggcgaggagggagcggatgaagcggccgcgccgccgcgtcgtcgtccaaccgtcgccggcggggagcacggcgagcgcccggatgtagaagccatggatggcgtcgaggaggcacatcttcagcgacagaatgtgctcgcatggggagaggtcgtagttcagcgctgcgccggcagcctcgtcgccgtcgtccgccgcgcgcgtcacacccgccaagcgtctggacagcttcgcctccatggtttcgcaatcgaacgtcaggtcggagatgtacccgagttgaggagagtcgatgcggcttgcgtctgcagcgatcgtgattagggcaacacggccatcttccccgatggtggttcgaagcgtcaccgtgccatcttggccgccgccgaggccgtacggacggcgcaagaagtctatgttgacctgcggccattgatgacctagcaagttcttgatgtccatgacgtcgccggcggtgagcagctcgctcccttgcagttaggccatgataggggagagctgaccggcggggaactgcgccgtcatgaggcgcgccagctcgtcgagcgcggggtgcgccgccttcagcgccgcgaccctgagcgcggccttgatcttgccgccgtcggggagcaagcgtgggcgctggcaccgacgacggcggtcgtggaggacgagcctgacggcgagggggaggtcgatcgtgggcggcgaggtggaggtagcgcctagcctgttcgtcggagatgtaccggaagtaggacgacatgaaggcgacgaggccggcgtaggagcgggcggcgaggataccccacagcgacttgccttcctcgcgagggagggcgaggtgcggcgccgcggccgccctgccggaggcgtggtgggcgatggcgttgaggatgatgttgccgacggggtcggcgaggccgaggcagtggccgccctcgaagatgcagccgacgagctccgtgatctcgtcgatcggcagccgccgcgccgcctcgtcgtacaacctcttgatcgacgtgatgatctttgcgctctcgtcggggtgaggccgcttcccctcctcgccatggtagcaggcgaagctgcccgtgcccgaccatggcggcgccaccaggtgatgatgggacgaggaggaagacgacgacatggagcccccacgagttggggattttctttcctccaagatttgctggtccaattagtttttttattattatttttgccctcgatccgacggttgctataaatcggtttaatgtggagaaaaaaaaagaccacttccttatatacttatctgtaccataatatcggatattatgaaccctcgactattaaaactagtcaacactgtcgtgtaaacgtcacgtaagcgaaaccgtcctccaaaaccaccgagaaagtcaaattacactcattttgatagttgagaggtcaatatatctggtcggtttaagaatacgaatcagattcgatgagtagttaagggagttaaagtgaacttattaaaaaaaaatctcggatgtttggttcaggggagggctgcctcctgcctgcattgggtttggctctaactagtgggccgttttagttatatagggctacaacttttggcccacttgtccaaccaagcccactaaaaattctgagttggcctactatgggctacgaccaggtcaagcaccctgtcactcacacaaaaagtcaattgtcaccagatgattgatgaaaaagtagagtaacgacatcctgtcgaccaggttgatacaagtgttccattgaaaagtcaacccgtcgatccagttgtcctgggacgaattgatggaatttaggccgccagcaagcaaagaccgagctgagcagctccagccgggtgttatcagggtcaaaacaatccaaatattttcaaaaatttcagttcgtttgacttggtttctggccgcgacgtctgctttctctcgcgtagcaagtggtcaacagaacagtaggttcctcgtttgactatcctatgtaatccaatattccctccaatgcattgctacactcattcggtcattcactatactttgtgtacggatttttatgtgaccagttgttccatcacggcaagggtacatgccagccgaacaccttagctaagtttggaatatcgtggcacactcccgcccatgcaaacctagtacaaataaagccccaacttcacacaacaaatttgcatactgaagaagataaaaaaaaaagttcgatagattcatcgctcatactagcaagcatggcaatgccagttggagttgcaccggtgttgttactgttgcttttgccattggcggcggcgacggcggcggcggagagtgacgacagggacgcgctgatggcgttcaaggccggcgtgacgtcggacccgaccggcgtgctccggtcgtggaacgagacggtgcacttctgccggtggccgggggtgaactgcacggcggggcgcgtcacgtcgctggacgtgtccatgggccgcctcgccggcgagctctcgccggccgtcgccaacctcacgcggctcgtggtgctcaacctcacctccaacgccttctccgggagcatccccggcggcctcggccggctccggcggatgcggtacctcagcctctgcgacaacgcgttcgccggcgagatacccgacgcgctccgcaactgcaccgccctcgccgtcgcgtacctcaacaacaacaacctcgtcggcggcgtcccacggtggctcggcgcgctgcccaacctcgccgtgctccggctcagccacaactcgctctccggccgcatcccgccgtcgctggcgaacctgacgaagatctttcggctcgagctcgaccagaaccttctggaaggttccatccccgacggcttgtcgcgcctcccggcgctcggcatgttagccttgtcgcagaacagcctcgccggagagatcccggtggggttcttcaacatgacgtcgctgcgtggcctcgcgctcgccgacaacgcgttccgcggcgagctcccgggcgacgcgggcgcgcgcacgccgaacctccagtacctcttcctcggcggcaacctcctcgccggcccgatctcggcgtcgctgtcgaacgccacggcgctggtggctctcagcctcgcgaacaacagcttcgccgggcaggtgcccggcgagatcggcacgctctgcccgctgtcgctggagctgtcgaacaaccagctcacggcgaccgacgacgccggcggcggctgggagttcatggacaacctgaccaactgcagcgccttggccgagatactcctcgacggcaacaagttcgccggcgtgatgccgccctccgtcgtccgcctctcgccgcagctcgaggcgctgaaccttgccggcaaccgcatatccggcgtaataccgccggagatcgagagcctcgtcgggctgcaaacgttgtgcctccagtccaatctcttctccggcgagatcccggaagcgatcggcaagctcaagaaccttcgagagctgctgctagagcagaacgaactggccgggccggtgccatccgccattggcgacctcacgcagctgctcaagctcgacctgagcggcaactcgctgaacggatcgattcctcccagccttggcaatctgcatcagctgacactgcttaacctctccggcaacgagctcaccggccatgtcccgagtgagctgttcaccctctcgtcgctgtcgctgctgatggacttgtcggacaaccagctggacggcccgatccctcccgacgtcggccagctcacgaagctcgcgttcatggcgttgtcggggaaccgcttctccggcgaggtgccgaccgagctggagagctgccagagcttggagttccttgatttggcccgcaacgtgttcgtcggaagcatcccgccatctctgagtgggctgaaagggctcaggaggctgaacctgacgggcaacaggttgtccgggagcattccgccggagctcggcgggatgccgggactgcaagagctgtacctctcgcggaacgacctgtccggcggcataccggcgagcctcgagaccatgagctcgctgatggagctcgacgtgtcctacaaccgtctcgccggccaggttccagtccacggcgtgttcgcgaacacgaccgggctgaggattgccgggaacaccgcgctctgcggcggcgcggcgcggctacggttgccgccatgtccggcgccgggcaactccacacgacgagctcatctcttcctcaagatcgctctgcctgtcgtcgcggcggccctttgcttcgccgtgatgttcgccttgctccggtggcgccgcaagatcaggagttcgagaaccggaaacgccgccgctcgcagcgtgctcaacggcaactactacccgagggtcacgtacgccgagctcgcgaaagccaccgacgacttcgccgacgccaacctcgtcggcgccgggaagtacgggtcggtgtacagggggaccctgtcactgaagacgaagggggagttcgcgcgcgaggacgccgtggtggccgtgaaggtgctcgacctccggcaagtcggagcttccaagacgttcatggcggaatgcgaggcgctgcgcagcgtcaagcaccggaacctgatcaacatcgtcacctgctgctccagcatcgacatggagggcaacgagttcagagctctggtgttcgacttcatgcccaactacagcctcgataggtggctgcatcgtgcgaagcatacggagaccgggaaatggtgcggcggtgccggcggcctgggcgtgatccagaggctcgacgtcgccgtcgacatcgccgacgcgctcaactacctccacaacagctgcaaccctccgatcatccactgcgatctcaagccgagcaacgttctcctcggcgaggacatgacggcctgcatcggcgacttcggcctcgccaagctccttcttgatccggccagccatggcgccgcggcggcgaacaccgagagcaccatcggcatacgcggcacgattgggtacgtcgcgccggagtacggcacgacggggatggtcacggcctccggcgacgtgtacagcttcgggataaccctcctcgagatcttctccgggaaggcgccgacggacggcgagctccgcgacggcctgacgctgccggagttcgtcgccggcgcgttcccggacaacatcgaggagatcctcgacgtggccctgctgctgcaggccgaggagctcgacggagcagcgtcgtcgacgacgtcggaggaggagagcgaggcgcgcgtcacggtgcgcgattgcttggcatccgccattagggtcgggctcagctgctcccggcgagctccctacgagaggatggccatgagcgtcgccgccgacgagatgcgcctcatcagagacgcttgccttcgtgcttgtggtaaataagtaggacagtatactgattatttgtagaactttgacagccgaattagtcgatggataattattactacgtcatcggcatcgaattctatcactattcgaggcttcgagcaagctgttgtggagtaaaaaaaatgaaaatgtaaaatccatggaattcaggagctctgatctcttgatttatctagtgtactgtactgacagaaaatggatgtactctgcatattcagatttcagaatagattgttctgtttatgtccagattccagaatataatgggcctgggaaattgatcagtaactgggcctaaataggcctttagactgaactagtcctgcctcttgtttatttggagtagtctttgtttcgcagtagttttttcttttcttttacctcttgtttttttttctttcttcccctccggcataggcctggccgattgtattgtataactaaaactctttttcttctaatatattgacgtgtaattctttcgcgcgtttgagaaaagaactagtggctattgctgattcatcctcttgctatcgccgttgctgaacaaagtgtgagagcataagaggaaaaaggagacgttgcgttgtcacttgccattgccagcgtgaaaccgttgaagatgcctcataaatgcgacggattaacagtttattagcacagcactggataaattggatatacgtgcatacgatggcgtccatggtttgcttgcttttgctgtggataagttggtcactactccactcactagctgcaaaaaagcaagggaaaaaaaaaaggtaattgcaatgtgctgcgtacgtgcgcaccctggatggtgatgtgcttgtttaccgtaggaggagcatttgcgaattcgttcttatcctagagaaattaatcgagccatttcacgctgtcaaggtatatatgatcgggtttcagagtttcagtgtgatttgccatttgccaacaaagcaacacctcaatgtaaatagcagtagcataaaaaaatggttcttttggattgtaaaaattttgcagattttaagtagctttataaaattgtataaaaaatatttatttttaaagaggtcggaaatgtcaaacactgagagagatcggtagcgcttgctgctgccgccgctgcggctgcgagagctaaaaatcagctacagcagcagctgaaaacggccacagtcgtgacggctgcagcagccagcagttccgatcaggcccaccgttttttgtcaagtgctgtaacagtgtactttgtgctgtaacagaaaattggctggttgtcaggtgctggttaaaaaggccaattttctgtcaagttctggtttgtgatttgtgatgctttggctattagttaccctacacaagtactccctacgcaacaaagaatggttaaggcatgagcccctactgtttgtgtaccaagtgacaataattggagctttcgatacaaacaatacttaaccaactaccttgtacggttcccatctgccgccattttccaactaactcgagctactacaactaataatcatcagtaacacgagctaattaaaagcatcttccagcacggcaggaggagcacacatccctcatcctctgacaccgacatgtggccccacaccacaggcacttgacctgtgtcggatccggacccgccaacccgccaggtgttccctccaatgggaggcgagctctccctcccaagagaatttaagaacagagagaggaagtggagagactacttcccccacctccgcctctctctcgatccatctcccccctctctcctctcctctctctctccgttcccaatctgcggaggcggaggcggagctagggcgcggcgtcgccggcgaggagttccgcaggcgcggtgtggacggggctcctctgcttccgcacacggcgggcggcgacggcgagcagggttggaggggcggcgcggcgacctcctcgttcctgccttgcctgcctccatctgggtatgaatcggacatcagtttttgtgtttccgaaatttcaaaaaatatatgcatgtcgggttggggggttcagctcgccacgttgggcaaagccgtccgtggtggtgtataagttattgctttccacatttgttaggaaaaaagtatgcgtgatttaatccgatggtagtttgactactaaaaatagtggtcgtctgatagctgtgtctccttggtcaaattgggggtcaaattgttgggatcattgtcgttaataagtgattgatcggtccaacagttaatccgtttgtgcttttgtttgcttgtacggaatctgaatcatgcattcacaagtttttgttatggaaaacagtagggggaaaaatcctatatgaagtatctgtttgttgaacagtaggaaatacgaccgtataattgtattgaagatcttgtgattttgaactgcccaagtatgccaacagtagagttggtagttttgcatatacaccgagtactaattttgcaaggctagtgttttctcccctgttctgagattatatccatgatcccatggcttatcttcatccattctgtgaagagcaattgcttcttgtctagaaacctttctacatttgctatcttggtatggacaaacttttgttgtaggaaccttaggttatgtctttactcggtaattgaaagttcacacaataatccagcattttgatcaaattaattagatcgttccaacatacttgaatttagtggccaaacataattgtttatatcggttatctcatggccacgttgttaaaaaccataacaatctccatgtacctctttttccatcaaagttcgttgagagtttatacataaatcagaaaatagtaaatatgagattgtaatgggaaggaattgtagctagcgatacacatttatccctataggtgatttctgccctagtgtattttgtaggttaagagagtcgatggattgtctacactagatttgtacaaagttttcttcagctgtaattcaattcaagtctataagaacagaacatgaattaaattttattgagaataatgccaaaattggcattgttagcaaaatcctctaactggaagtaatcaaataaaagtttctaatctcaagccctactaccccctaactcagtagggacccaacccaacattgcaacctccagctggactaattttccttgaagacaggctgataacttaagctaggctgaagagtacaagggccttgacacattcactagcccagtttaatgatattttttgggccttgacatattcactagcccagtttaatgatattttttgggccttgactgacataattttgagcatacctagcaggccaaatccttgtggggcttggtcaggttgggccacttgtgttatatctggtccatcgctacattcgtaacctagcataatttattagttagtttcagttgtcgcttgtcagaaaaaattgctcaggtcacaagtcccctgtgaaccaaaatgtttgagtcacgaaattgtcgatggcaaatttttatcctctgaaaaggtctagaaagtaacaaaaaaaggaagtggacccatatctttaattactgccatatcaataccaaatcatgcttatccgataactgcgactttcccatcatcgagttatatatatacccttttgttgattgagacttgtataaattgaaaaggagaaattcaggtgcataaggaatctacgttgcatgcataagacggtaagtactagcttgtttgccaactttctacttaaatccagttgtgcaatagcctggctttagataagtttaatgatttggtctagcgaaacttgtttcagatgatcagatatatttcttgtagtgtttatatctgtgcgtgtgcgaaataaatgcatagatcgaggggggtgagcagttcaatgtacaatcaggaacatccttcagatatgaatttggcctgtttgattaaaattttctgtttcctacatacatttgactttgattgcctatctaacaaatatcacaaataccaaggtttttaaaattgttagctagtactcaagcagtcacagacctactactgattatatatttgtatgccctaactcgcctgattgtgtagcataactggaaatctagaactatactgtaatagttgccttatttatgacctactagatctgttcttcctttgtagtacactgaggaatatatacctcctacatgtattagatgttattagcagcgtgtactgaaatagcccccacgtgatctattagatgtgttaacactttggaatccttagtcttgacagccttgtgctacaagtattgtgcctgaaggagatacgggtatgtatgtggattgtgattagtcctattgaatctatgcatagaagagagaccatcaatactatttaaaaagaggaattggttctggttctatgcatgatcagatttttcattaatgggtttagaatagaccatctacacatgtgctgtttataggattttttttgtgtaaaatattgcattctttcactgttgcatatgcatatattagttatcggttgatcttgcattattatatgtatacaattatttagattagataatgattacttgtttaaactcaaaatttgtgtatatttatttcgatccatcacaactcatgggatgtgatgctagtttatcataatttaaaatgtgcatgattatccttgattcagatatctatatccattgccatcaacttcttatttgttttgatgcgtgctcatattgatcatgcttttagatagcaatatcatacaagtatggtactgccattattcaaatgtttttgagcctcagcctttcccaccccttgtcactgtcttggggcaatatttaactattgaagaattaactatgctttgcagggcacctgtggggcctgtttgcaataagaaaccccgtggctactaatgactactaatacaactcacagtcttaatcgtgtgtgttatcatacagggaggctttcagacaaacattgaaaattcttgctgaccatattattttctttttcataaataaacactatcaagggtcaccttttgtgggcttgcttatttgcactgaagatgaatttggaaaggtactaaagtactagtggcttagaatttggctatgcaaggttagcaggagaaccggtattgctaatttgtgctaaggatgaaattggtaggtgctgaagtactaaatgatgggagtttggctaggtaaagcttgaaagagaaagtcttcctaggatatgatagataaatcaaggaatttgttgctcactgtgcccaaaatcttaatacaatgatacacaaagcttatgtgtattcgcgaaaaatgtgcccaaaatctaaccaaccaactgctaaccttgctaggcaaggtaggctaaggaaccaaacatggttgctaattgctattgctttctgatcaaacattctgttcgatgattttctcctgtagactttattacaagatccttttagttacacttttgtgatgcatcatgcatgcttacagttacttatatctgcaattttttagtatgtctactaatggctgatttcttcaattatgaattccctgctctgctgctggtacataaaactgatgctagcatcttatgtcggatgactatttttcagaacaagtttagacattgaacttaaaagtaaaactatagcagatcgattcatctgcacaatttattagtttgtaacatgggaggctaggactattacctaatcgagaatgcaactgacaatgtttgttattcttattttgcagtgttggaaatatcataagttttgggacaagcaagagaggacatggagccatcatcacaacctcagccggcaattggtgttgttgctggtggatcacaagtgtaccctgcataccggcctgcagcaacagtgcctacaggttctgctgtcattcctgccggttcacagccaacaccgtcgttccctgccaaccctgatcaactgagtgctcagcaccagctcgtctatcagcaagcccagcaatttcaccagcagcttcagcagcagcatcagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaagaagagtaaatgatccctgtgaattgtcaagaagcttaccacctgattcagaattttacttttagccaggttgtcgtctattctgaatttatgaataggattaggattctctcatggtagttgcatttctgctgtagtggaaaaggatttatgacatgagagtatgagactaatgggtttcagttactataccgtttcctgtcaatccaaaagttggcctttgcgaggccattgatattgaacctaatgtggttgaactgcccatgccaacgtttgtaagctctgatgtgggtcattctgtatttcatgtttgcatggtttcatggaatcttctttgtttagacaatgaaaatgttttacattcgtggcatctgccataacacatacccgatgagtttttaatgaaataaaaagacgggtgggggatacatccccagcgtactcttgatttgctagtaaacagacaactcatagccaaggtaatgtagaaaactacagtttataaagcctacaatggtttggtaaaactggtcttgtggcattcacatgcagccctatattaatctaaccattttgtttgattttttccaccatttgaatgatttatcgttagtgcgctgtgatatttgcaattttgcattgtgttttagtagcttatagctccgtgcttgtttgttaatctaatgcaatcgggtcaaagaaaaaaaaatgaaacggtactgtccatggtgagggctgattagtatggtcttggagtgtagtcaagccgttttatacagctgtggtctcttcgtaaataacagaaagtagtgtacaagtaaaatagaaaaaaaattcggaataaacattacaaataacagaaagtagtgtacaaatgcatgatgccatgatgtctcctaacccattacgctggcttattagggcgtgtacaagggtatctttctctgtcagggaaaaaaaaaactagcgcgaaatgtgttgatactatgaatttaaacataacatctcgtattggattttttcttttaacggaggcagtataggtgcattgggcgtggggagcgtactcagttactcttaccgttggcacgatgcaaccaagccaagtaactacctctgaaaaaaaaaaagaaaaacaagttaatagattgagtatcttttgcgaggaatgtatgtataagcagttagttaattagcacaagtaaactgaaagaaattcagaaataaacccacctgtaatttgtagtcgttaacctaaacttttaggtacatcaatatattaccagcttatgttgagagaatattttctccaattatccatcacatctactccctctgtttcaaaaaaaactcaacctagtattagatagaacgttttctactgtccagatttgttgtactagaagacatcaaatccaatactacattgagtttatggccctatttagttcacaccaaacttcccccaactcctaactttccatcacatcacatcacatcacatctaaaactttcctacacatataaacttctaatttttttttccaaactaccaattttctccaaacttctccctaatttcagaaactaaacacagcctatgtgagacagaaggagtacatagcaaaatcttcatagcattaatgatgtcaaaagctccacggtgaccagagctcgtcaagaaacatgacgccagtcactactcgccagccattaatctcagttcgctttcgccggctggccgcaaacggcaaatattcctcgtccaagccggaggccccgagaagaagaccttgccgagataggcaagcccggaagccacgtcgagcctgcagctttgctcgcatgctgatctcccagcttggtcttggccgtttcctgtcgatccagcagtcaaggatatgcagtaataccgagtccaaaaacaatccttgtccgtttgtttattttccttcttattttcatcggatcaagaactgtagttcgttacctacgctatgatgcccatgcatgtgcatgtttcttattgctatcttatgtttgcaaaaacaattattgtccgtctttcttttttcttattttcattcgattaacgtatccttgtccgtttgtcttttttttttccgataaacgtatcatttttctttattcttttattattttctgataacagtcccaaaaacatttgcacgaaaaacgaaagatttttctcgcctagtacacggactaacaaatctaacatcacaaaaactttaccaagttttgacaataccaaaattctagcaagatgacaatattgttaaaattttagtatgatttcttaaccaaatttagtaacaaactaaacgtagacatttttttttgacaattttaaagaaaatggtatggttaaaaataatgtcaaagtgaatacacccattataacgttgaaaagaagaccagacgacccacacgtcattcttttactcgcttttgcgttttgccacaaacggcatgctttagctaggacctcagccaggtgagaagaccttgccgagagataaggaaggccggaagcctcatcgaacctgcctgcctttgcatggcccgctagaccgcacttccaattaattgtttttacaattaggtagtttacgctttgaccactcgaaggcatttttattaaaaacaataagtatctcaaaagtaacctacgatgcatattgtcttgtaaatacgcgggcttcattcctaactaagaaaaatggtaaacggtgtattttacaactgaaaaatttacaaacttaaaattcacaagtataattcgtcacgcactgcatgcaaatatgcagtgatgcacacacagctaacggtcccgggttctcccaccgcccatcgcctagagacaagttcaagcgcagtaccgcctacactcccatgtgctagctgcttccatgcttgcctactctctgtttacgagtagtgagaagcagagagtgagagagacgaacttgatggtgatgcaccctaacgctgcgctcccagtcaaagtcaaacgcagtagcacctagtacgctcctactccctccggaggtatcattttaattaatattttagacaatgacacggtctacaaaatatatctttaaccttatttttctattataatataaataataaataaatacatgtttacttttattatagtgctttgaaagacaaatctatacatgttgttctagttcctttaaactaaatatttttaaagttatcgatgatcaaagttataaaagtttgacctcaaccgtgtctaaaacgtcaattaatatagaatcggagggagtatactcgtagtcgtatttgatcatccataaacgcgtccaatatctttgggtaatggattttgcgacataacaaaaagtttagaccagtttttttactagagacgataacaacgtgccgagcaattttggctctcaaataatgatgttgttttttatgggaaaacggtttattttcctttgcaggttgttttcttgattatttctccagaagctcggtttatatggtattatcacttcagcttatttatatttggagcaagtggttaaggagttttatacctggcatttgggtgatgacctagttttcgagttgtaagaccttgatctcgagagtttttatgattttctctcttcttttaaggcctcgtttgatctatccttttggagataaatttttagtgcacgtaaaacgagaaacctcattaccatatgattaattaaatattaataattataaacttaaaaatagattttatctgaattttttaaacaacttctatatagaaaattttgcaaaaaaaaacacatcattgactgtttgaaaaacatgctaacggaaaaaagttgaagtttggagttgaggcaaagaacttagcctaagtgtgcagtgtcttgttcacttggttgtgtgcactatcatgatacagagggcctgtttagatcccctggtaaaattttataccatgtcacatcgaatgtttggacacatgaagtattaaatataaacgaaaaaataactaattacacaaattgcgtgaaaattgcgagacgaatcttttaagcctaattgcgccatgatttgacaatgtggtgctgcagtaaacatttgctaatgacggattaattaggcttaataaattcgtctcgcggtttacaggcggattctgtaatttgttttgttattagactacgtttaatacttcaaatgtgtgtacgtatattcgatgtgatacgcaaaactttacacccctgaatctaagggtgtgtttacaagcgaaattagtaatttgttttgttattaatctatgtttaaatgtgtgtccgtatactttaaaatttttttggccaaataactaaacacgaccatagtcccatatgctgcttttgggttagagaccagcccgatggtgacaaactgatccaactccaaccaacgtttgcgttgaggtgctctctctgaatttttcttgtgccccatgacgttgctagctgcttttgccgattagcctcgtttcgttgcttttgctctcctgctgcaatgctgcctgcggctgccacgaacttctatccgcggagagcgacgttcgttcccgatcgaacctgaaacttcctggcattttcacgcgcgcgaacgaacgaacgaacggacgaactgtactgtaaatactcaggcgcccgaacgaaagttaacgaacgaacgaaagctgaagtgctgaacgaacggtagactgtaaaactcaggcgctccgaacgagaagttcagtgaacgaaagttacagccatcggtgaattcacagtgctagtgccgtggagatcgcggcctataaatacgcttcgttgctttgctcctctccttcagctcgaaggaagccgttccagtgtctcacaagccaaggtaaagaaaaaaaagagagagaaaaaaacagagaaggaaatcaagagaagaacaccatttgattctcctctctgctcactccttctccttcttctgtttgtccgtcttggattggagctagcacttctttgactgcccttgttcatcgaggcaagtgcagaaatcttttcagtgtggctggatcccgtttaattcaagcgatttgattggggttttttggttttttcgatggacaggcggcgaggcgaggtcgcgatggggcaagggaagatcgagatgaagaggatcgaggacgcgacgaggcggcaggtgacgttcagcaagcgcagggctgggtttctcaagaaggcgaacgagctcgccgtgctgtgcgatgcgcaggtcggcgtcgtcgtcttctccgacaagggcaagctcttcgacttctgcagcccgccggtcatgtgcgccgccgccgcccggccctagcttctatctctgtttcttgttaatttgtttatgacgaaatgccaatgaaaaatctgctttaaaagaaacaagaaagagagagagagtgtgtgtgtgtgtgctgatctctaatcttgatttctatatatctgcatgccttagctgagttttcagttctttgtggtgattggtggtgtgtgcgatgattcagaaatttagcattgcatttatttgttgcagttgatatttcactcagcattccagataaatgtttgggggtactgttcgattaacatcccgatcaaatgggtagtgttcttcatgattggtagtggatttgggaaattgggatcgctttccttgcattcaacattatcactagaaatctttcgatggttcatgttctagagcttgcttttctttctgatttaatcttttctggcatcctgaaattttgatttcaggatctattcctataggacttgtgcttgctgcatagtgcattcttcaattaagcagtgcccatgaccacatcgattagtactactagaagctaatactccttttacatgtataagttcacttcattggtccaatgtactagtaataccatattgtttctggatgtaacatatttgattatgctttgttaagcttgatggagctgtttcaccgttatgagatcaccaccagaaacactcggcttcaggagacaaaccgtgatgatgaggtaagcgaactgaatctaacacatgttatttttttcttttttacatttgaaaggcaattgcatgtcccacaccaaattcctaatcactcaaagcttcatttctacaactaatctacatgtgtgatgctgccttgcagcaaatggtcatggagatcacaaggctaaggaatgagatcgaccagctcgaagccagtttaaggaggcaaactggagaagacctgtcatctgtgtccacagtggatgagctcagccagctgcagctgcagcttgaatcatctctcagcaaagttcatgcgaggaaggtactagcacttgcttaaatatggcagaagattagtgcagatcagcatcaaatccttatggaatatacaagtcctccacgatttttttttctttgctcacaaattcacaattagagtttatatgacagaatgtgttaactgcatgaggtgcttgtgtgcaggatgagctcatgagccagcagctggaggatatgcgtcgcatggtacactactcccttattgtagtcgcagttgtggtttttgctgatgagtggtgagctgaattaatatatggattttctgtatgaaatgcagcatcagaccgtgcatgagcagaacaatttcttgtgccgcatggtaactaaaatactcctactagtatgccactgcattggctttaatttctttttgagttcttcctaaaatgttttcatgattcgagtgaatatcctcttgtttcttacgtgtcatctatcctataattcaccaactcgttttactcatcttttactcttacactcttacattcatcattcaacggttcagatcatccgcgtaaaatccgaacggttcagatcgatcccacctccacctccctcaatcagcggacgacccgcaccgccccccccccctccctatcgctctcccaccacacctgcacctccgccctccgccggaattccgctcctgcacctccgccatcagtgctccgctccgtatcagccgccgcgccgtcctctgcatcgcatgtctgccaccgatccccgccgccggctcgccctccacgatcctccgcctccccgctgcacgaggtcctcccgtcgccaggtcgtcgccgccgttctgctccaccgatccccgccgcacgaggtgctcccgtcgctaggtagccaccgcgccgtcctctgcatcgcctgtctccaccaatcccctctgcatcgcaggggtgagctgcagctatggagttccttgccggtgggggagcagcaggtgaatcccgtgagaggtgagtagttgaacaaaactcatcatgcagttcatcagcaggtgaccagtccggaacttggcatcgtggaggttcatccggattcatcatgcattctgaaacaaaacccatcatccagcgcttgccgcttttcctcagagtacaatgaacgcggggtgctcggcgaaatgtcccgtccggctcctcacctgcaatgcatgtgttctggagagtgtttatggattctggatcttagaccccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaattttttttctcaaattagttggactgatagaaaaatattgcttttcaagattgtaaaataaccaactgactgggaagttgatgtcatatgttggaagcaatctgctaaaatgttaaagaagtgcatctaacttttgtacccagtgaattgcaaatctctatctcgtttttttatttacagtttctttggttttaaagtaaaataggttgacatgggaactttactagcagaggaatgggcttatattcttggaaaaaatacatttctccatgcagaatgtgatcacaataatgatacttgctgccatgatttctatcactcatgcacgcattgcccttgatgattgtatgcagttgggatatattggttagttcaccctctatctctctctcaaaccattatttatcttcattcactattcacttacaatttccctcgtattagtgatatgcattagtgagtttatgaaaaaaagatcaaatatttaaaaacagagttagctcctttggaacgaagacaaaatgctactttgataacttgacttctcaacaccactcttatctgcacacaatttttttaatgaccagtttgaactttcatctctttacagtcatcaagcaagaaaattcttggcgattctggtttatatgacttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaagaaattttgttgtagcttagattaaggcagcctcagctttgtggtttgccaagccatgtactgatatatgaatgtgatactttaattaatgttgaaacgcatgattatgtatttgaactgaattgactgaatgtgtcctggaatcggtttagaacttaatatatcaatcagacttttgttctttgcttactggtttttctgtgacatggagaaaagacgttgaagacataatacatcgtcgactgaatgggtcgaccttatggcttgttttgcaaattttgaaccttgtcctggatgtagtttatttggcttgtttatccctttcgagtatataataactgaggaacttctaataagcttcttaactaaactcgctcatatgtaagtcttaattaatgtcttgaatctatacttgatagcccaaacaatatattgtatatctttttgttgtttcgccgtagcgttagcacgggcatgtaactagtataaaatagttatcaaatttttttaaaagaactgataagatagatcaatatgaaaatatttcactccataaacatacaagtttaaattcaacttttataaattacaacaaaaatgacaaatataaccgtgaatgcgggttaactatttccaatttaatttattctttttttaacatgtggacgttgaatttaggagtattataatactcaatttgttcggctttagatgagtgagaactggcacagcgagaactggcagagccctggttccggggaggcgtcggcaatggaggcgctgacgatgctgccgccggcggcggcggcgacgacggcggcggaggcgttcaattgcttcttcccggaggaggagaagggggtggcggcgtcgagcacgttgctgcagctgtggccgcagccgcacgacggcgaccagcctgacctgcggctctggtaggtaatcaaggagtactttggttaatattccaccaagcacaattagccctgatcagttatctaatctgttgcacattattcttctccttgcagattgaggatcgctgacttgtcaattgaaacagcctacatggtggctggtggacgtggatttcatggacgtccttgcagtaatctagcactaagacagcattagcatagtgaacttacaatagctcgagatgagatagtcgtcgttatgtttagataaaacaatggaacatagcgaattagtgatagggataaaagaatggcactactcgttcgattcaggttaggattattataatctagattattaggagtaagctgaaataaacaagtagattattagactcgtttgattcagcttaaaattattataatctggattattaggagtaagctgaaacaaacaagtaggttattaggatagattattataatctgtaagccagattactataatctaataatctcctctagaggagctttttccagattattaggtggctaaagacccactatctatagatgccttcaataatttagataaacaaacatctcgtagcttattttatgctagcttattataattcagtttagagtaatctgatttaataatctagattataataattttaagctgaaacaaaggaccgtaatatcgtacaatgtattaaccacttggagtgtattttaatgttgatgattacgtgataaattaacctcgtaatatattttagtgttgatgattacgtgataaattaacctcgtaatattttttttagcattattcaaacttttggctgagtttagatctaaagtttggttccaaacttcagtacttttctatcacatcaacctgtcatacacatacaatttttcagtcatatcatcttcaatttcaaccaaaaaccaaactttgcgctgaattaacacagcctttgtgttcctacctgtgggaccacattgtcagtcgctgaattttcaaacctggccaactcgctagaacggacacgtgaacggacacgtctcggttgccacgtggcacagaaaggctctttttcttgggcccgcaaccgccttcaccgtccttggcttattggctaccaccaggcgaggcctccttctcgcggaagcttcccccaaccacttgtccccctctctctccctctctgcgcgccgccgccttcgccatggcggcctcctcgcctcctctctttccctaaccctagagccaacgcggtgggcggaacgtcctccagatcgcgatcgcgatcgcgatcgccccgcagcggcgtctccacccccctcgtccgccggtttctccgtgccgcctcttccgaggtgggaggtatggtatacgctccttcggcgactcgacgaaaccctaaatcctagccttttgtctgtctggttcttcctgaattttgttggtgggggaattttgtttgcgattcaggcgtggtggtgctgctgcggcggttcctgcgtttaccgtttgattgattggtggtgggggacgggttagggtttgggtcggagggatcgcgaccgctacggccttgatcctctcccatttcgttgatcccccgctctccccttggtgatcccaaggtgaatttagttgcgattcctttaattacacccgaatcgcgttcgggctcgtggttgcacgattgcatatgtgacatggtgatggtgttctttgtttttgtgcgatctggttcggctgtgctggtggttaggttgtgagttcattgcgaagttgcgattagggctattgacgtctattagggttttcaacttggtatcttgtttaggcccctttcttcggaatttaacctgggataagagttcgtccagttgggcaggttatggtgctattctttatgcataaattcgttacacatggatctatatctatcactggactctggtacgaacgttcaccgcataaattttgactcgtgtaatgctaaattgctaacttctaaggctcgtgtagctcattcaaacagtagttttctgttttgtttttctgtaaataatggtgcgctggtacatcgaatgtagatttgataaataatgttaaccttcagtggtttaaattaaacactaagtgcttaggttaaattcataggttcagttcatggaaagtttctttccatcagcagcaattttctgtttaggttgattttgaagaaaccctctctgatttagtgtgattcctttacaagattggcctctgagagtccgtttgatgatttccatcaattatattagtgtatgctacattggtgctagggataagtaaaaaaataatttcagttaatatcagaattattgagctgtataaacctgggagttaaattagtgcaataggtctctatcattcttcttgaggtttaattctataagtttttggttggttccagacgcggttccagacgcgtatcaaactggttgattcactggtgtgtttttttcgttttcgtgtcgttttatgttactgtcagaaggatggctattcccatatatcacacatatttggagagttcagctgttggaaggttggaattgttttttttttctcatctggtgtatttctcaaaactgaccggtggttctgaatatttcaatgcctgatcaggatcaatttttgcatttctcgagttcttaacagaaaaggattttgctatacacactgaaaccagtgacattatttcattgtgagatgcagattacacttttcccatatatatatagtggttggcaaagggctcctggagtcctggttcttaaagatcgataacagctttcaccacaaagttctctgcaaattgcataagatcaaatacatgattcgttagtgcatccttgccatctgttttgatacttctatatgcaagtgatctggtgttctttggtgaattcatgtgtaaccactgctccttgaggcagttgaagggggtattggactagatccatcctacacataaccctcatgtgcaagggttctgcttggatatgtagtttttctacacaccattgacaactgataagtatatcagtaaccatgtttcctcctgcaatctaatatcgttctgtgttctgtcatt

SEQ ID NO: 58263 - DNA, 45097 bp, Oryza sativa
ttgaataagacgagtggttaaacgttacaagtaaaaactcaaaatcccttatattataggacagagggagtacaagtgtacgagtatttcaattcgtctgagtggtgaaaggtaacttcggtgaccattttgggatgagatcgggctgtttacattgcatattgcaaaacttggaatatttttatttgcacttgggtatggtgcttccttgctagcccttaactaataattggatgaagggatagattatacatgaacatgtttgtacataccaggagcgaattctgaatttgcgtgtaacttttgttattggtacaagatatccatcgtgttgcaatgccactgtttttctttaaccatttatcatttatgggtcacattctcaaaaatttctttgaatgacctgtccaagtatgattggtgttaacaatttacaaactttgcgtgcatgtctgttgcatacgtacagtggattatcctttggcagtatgacctgtttgtaatacacatcaatcttgaatctcatccgcatgaaccagattatagtttaactaaactatttgcattttaaaaaaaaaaactgcaagggaagactactgtgagtaggctttcttcgtttaagaaatgaaacatcacgtcaagtatatatgtttacccaagtaaagaatgctggaacggcaacaaatgggagagggaattacactcccttttttcgctcatcaaggaacggcaacatgatggagacgataatatgatatcatgatagcaacatgcttgggcccttcatttctccattggtgccatctcctaccaactcgccatgaggttttggccgtttgtacgcgcaagcatttcgatgccgaatcacgagctgatcagcctgggagtacgctttccggcaagcatcagggaaaaccaagccgtataagttaaaaccgagcgcccagctgaacctgacccagagattcacatgacgatcgacgagatccatccatcgctagaacattcgattgcaaatattttgggcggttggtttaagtttacccgtgcacaggcaaggaaagcttgtgggtctcaacttcgacttttgtgtacacacacagccatggatggcacatatactcactctcaacctgttgccaacacaagcacagttccctattatactatattcagtcaagagtgaaggacactcagcccattttagaacctcagagattttaagaagtagctgagacaaatatgaaaaagctgagttctcagcttttaactttcagtttattttctaaaattcatacccataaaggttctaggaatctagactaattcgaagctaaagattttctaaaaaagctacaactgcaagaaattaccatgtaaacaaacaagacgtcactctgcactgtaggctcccagtagatgatacagtccctcatgtgatcgttaaactagttcagagcccagaatccggagttctgggattaataacaacaagccaaaatctcataacacagcaagtgtgcagcgcagctgcaggccatggccatatacaaaaaccaaataccaaagcatcaccagggccggatgcctagctttggcagcagcaagtcacactccgtaggcagcagtagcaaaataaccaatatactagtagtactagtagaaaatgatatgaaacggcaagtgtcttgtgtgggcgatcgccaagtcaagaccctctcttccacgcttgcttggcaatctcgctcgcgtctccctcccgtgcaggcatgcagcaagccagcagttagccggtgagcacaagaaacaagcaaatgcaacggatatcctactaccacctcagttggccttcacctcttcgtttcctatataaatggcacagccacgctaagatcattccagtccaacgtaggaagagcagatgcatatatggtctcttcatctcctcgacctagctagctgcttctgttaactactgagaggagttagcaagctatagctaatcaagagtgtgctggttttgttcgattctgcagggtaatgtgctgctaatgtaatcagtttaagatgctcacatgatgcaccaagacatgacctaagctagctacctttgttgctttgcattctgccgttattttcggcaacttattgacgtggattattaattgcatagaattgtttaagaagttgtgttgttgatgcttaccctgcagtgtcctgggagagacgatagatatgaaggttgatccgatggggaaactgttgttcttgcttgcatggattactctcttgcaaggtaataataccagttcttttaactattcctttgccctgtttaattagcttgcaagtgcagtatcatgtcacaccaattgtagaggttttcatatatgctttggaactttactgagcgtcacggtcatgtacttaaattattatatatcactatactctgttgtaaatcgttactgagatatataaattaagctacttctgaatttgtctgcaggttgctgcatggtgaaatccttttcttacgactactcatcaagcattgaggcaagtcgttctctaatatgatctgtaactgttagtcgtagtacacactgtacactagctagtacttcatctgctacatgttatcgacgaatgtatcgttggccggcctaaggcatcgacagaaattaattatattcctgcttagattagcgagcaattaatctcgcgattaacaattaaaagctagctcgattgggatgacaatagctatatcacgggcgggagtggcggcgcgatatgttaattattacgattatcggcctcacgcaatgcgtttccggtgcgagttagcatggaatttctttcttaatttgcccgtacgtacactatatgcttttcagtaccatgcacgatagcggcggcggcggccggcgcagcgtgtcatgtaagctagctccaaacaaaatgcacacatcattaatcatttatcattatttggtttttttgactataatatatactctctcattccctaaatgtttgacgctgttgacttttttaaacatgtttgaccattcgtcttatttaaaaacttttataaaaatatgtaaaactatatgtatacataaaattatatttaacaatgaattaaatgataggaaaaaaataataattacttaaattttttgaataagacgaacggtcaaacatgtttaaaaaaatcaacggcgtcaaacatttaggaatggaggaagtatatatcaatatatgtagttatatgcaccttttctctttggtccattcttgtgctcttcatcattttattttcttattgtcattagtttgatgatcacgtttaggtatgcttcagatgtgtctgcagagcaagcaaagcatctctatgttgccgagattagagcagcatgcacttttatgcatgcttagacaaattaataaagttaattaattaattatggcgtctgagtgtgtgggcttgttcggtacagtgcttgcctgagccgccggagccccagtacggcggcggcgtcgtccggaacgccgacttcagcgctggcctccatggctggtcggccttcgggtacggcagcctcgccgagggctcgtcgccggcggggaacaggtacgccgtggcgacgaaccggacgcggccgtaccagagcgtcagccagaaggtcctcctccagaacgacacgcactacaccctctcaggtctggtggtcaagaaatcgaacgtgtgaaattaatgtgtagccgtcacgtctcactttgtggttttccatgtgcatgcaatttgggactgagacgtcgcgtactacgtgcgtgtgcggtgcagcgtggttgcaggtgagcgacggtgtcgccgacgtgcgggtggtcgtcaaggccgccggcgacttcatccacgccggcggcgtcgccgccaagtccggctgctggtccatgctcaagggcggcctcaccaccgtctccggcggccgcgccgagatctacttcgaggtaactaattaatcactttcactccgagttgatttaattctttgcaaatactacggagtacatgcgaacgtgacgcgtgcttgcgtgcagagcaacgcgacggcggacatatgggtggacagcgtgtcgctgaagccgttcaccaaggaggagtggagcaaccaccgcgacgcgtcggcgagcacggcgaggaggaagacggtgaggctccaggcgacggactccgccgggaacccgctgccgggcgccgccgtgtcgctggagaacgtccgcaacggcttccccctcggcgccgccatgagcggcgagatcctgcgcaacccgtcgtaccagcggtggttcgcgtcgcggttcacggtgaccacgttcgagaacgagatgaagtggtacagcacggagccggcgccggggagggaggactactcggtgccggacgcgatgctggagttcgccaggagccacggcatcgcggtgcgcgggcacaacgtgttctgggacgacccgaaccagcagccgcggtgggtgcaggggctcccctacccgcagctgctggcggcggcgtcgcggcggatccggtcggtggtggcgaggtacgccgggaagctcatcgcgtgggacgtggtgaacgagaacctgcacttctccttcttcgagcgccgcttcgggtgggacgcttccacggcgttctacgcggcggcgcggatgctggacaccgggtcgacgctcatgttcatgaacgagtacaacacgctggagcagccgggcgacatggcggcgctgccggcgaggtacgtgcagcggctgaagcagatcatcggcgggtacccgcagaacggcgccggcatggccatcggcctcgagggccacttcaccgcgccggtcaacatcccctacatgcgcgccgccctggacaccctcgcgcaggccggcgtccccgtgtggctcaccgaggtcgacgtcggcggcggcgcgtcgcaggcgtactacctggaggagatcctccgggaggcgtacgcgcacccggcggtgcagggcgtcatcctgtgggcggcgtggcggccgcagggctgctacgtcatgtgcctcaccgacaacgacttcaacaacctgccgcagggcgacgtcgtcgaccgcctcatcaccgagtggagcacggcgccgcgcgccggcacgacggacgccgagggcttcttccaggccgagctcgcgcacggcgagtacaaggtcaccgtcacccacccgtcgctcaacacctccgtgtcgcagagcgtcaaggttgaaatgggatcagggagccactacttcatccaggtctaagctctagctcatcactcatcagctagacagctacccgatgatttcattcagggctttggaaatgatcatactggtcattcatgcccgttagctgtatctcttcatagtatcaagatgcatgtgtagtcgaaattctgcagcttaaatagcctaatagtacccatattagccattcatgattcatgtaccaattttactctgaaaaattgcagctgaattgaaatggagctacacaaaagggaaaaatatagcctaatagtacccatattagccattatgctaaacttttggagtctcttgtactcatttccagttattctttctttctcgctgaaggatttcagcaggtttgctgtagcttggacggccgatccttttcccatggccattagcgtatgattgtttttctatcgagatgacatcatctccggtcatgattctgacttctgttacatttaatcaccaacaaagagtatactatttcaaattgaatcatgatcctataaaaaaaatagaaaaatgatgtcatccggaagcaaacaagcgaagtcacgagcagaacacggacaaaacaaaaggcacagcacacccaaacttccaaactgagttgccatgtcgcgttcaatccacacaccacaactacgggagacatgacgtaaacacaatatatactggagataatctagtgatttttatattaaaatccattacaatcaatatttcttttagcttgcataggcatgctagtgtaatctaccatagaatgaactgtagtgtagcaatcgaagttcacgtgatactgtaagggcattgacattgaaacaggaagctgacaccttctgattcagaatatgaaaaagaaaagcacaaacaacaacctatattctggtacagcacctaactaagcaagaagccagatagataacaaagggactagtatttgatggtaccaattttatgaggtcaacaagttgtcaccaagcttcaacaaagccaaacttgccgagcaccgctgtcgtttcctgccttgaactgcatttgaataatgtgtaaaacatcccatcagtacattgtgtaaaaaaacagacccatctctcgattttccaagggattcaaacggagttttgaataattggcatcactgttattgctcttaccttccatctctcaatatcttgtagactcctggtgttattaggtccacaattgttgaaccagcacgcccagaagggaggattccaccatcaaagacatatgaacaatgtggccacagatcctcaaaatctttgacgttgacactactaggatgcccgcttaagttggcgcttgtaagtgcaagcgcacttccagcaccacgggaaatggctcgaatgaaatcaaaatctggcacacgaactccaatgctttccaaaccaggattaagagatctctccaatatactgttgttacctaaatgtaaatgaatgaagagttttattagacacattatgctgcttaagaaaggtgcaagatagaagttttgaagcataggctggtgtccacacctcgttttaaaacaactgtgacaggcccaggaagtagactatcaagcaggccatgaggtaggtgatccacaacagcaaaccgtgatatgtctgggacatcagcaacacagattgcaagaggccgtgtctgtacgcgtcctttgatctcatatatacgattaactgcttctgcagagctgtcatgaagattgagagacccattttaaaaataaccaatggatgaatgcagccaaccagtcagagaatctccaaaaaagtaaacctagcttaaaatgaacaaagtcacgaaacattgcttccaaatctaaatgaaagtgagattcaatagtaactaatgaaagtttctgaactgtttgtgaatattttttgtacatgactaatttagatatgagcacacaaactcctcataactagaatctggatttactgatcagagtttcttttcaggggttggccttgttagacatctactcacatcattgcagaaggtgttaaattggagttaacatgagaacaataggacaacaaagcaaatgagaagaataaaattcttggcacaaaatgtacttttagtaaaactaaccatgcatcacaagcaaagccataaatcgtatcggtgggcaccgcaatcacttgccccctgttaattgagtcaattgctttcatgacatgatcatttgttgctggaaggatgtgttctgccgtggcttctattcggtgtgtcttgtcatctgacacccttaccgagcaggataccacagacttcgtctcatgttgagatgataatctgttgaccttaacaaaactgagaaaaacaagtgtgtcagtgcagtaatctgaataaacattttaaccaaagaaatacacagttctcccatgtgccaaaagagatttccatacagtatgaaattttacatagcaattaacaagtgtgctgaacaagataatatatacatcaagtctcaaggaaccatgtcaaattgagagcatcactcaattgcattaacatatatatgaaaaatttgggagaaccacggatggaatttgtgtataaaccccaaagttcctcattactattgcaccacagtccttagcaaaccaagaaagccccaaatttgttgaagaaaaataaaaaatcttatgtgcagatacaatttacagtaagtagcattgtgaagtcggtactctgattatagcaaattcaatcatcaaaacatcctagatgttcacttcttaccattagtattaaaagacaattcgcggggattatcccacatgaaaaggtattatacaagataattcaattaaatatacaaacactatctccttttgaatgaattggatgaaaaacaagagtacaaacacaagtcgtttgggcgaagtaaataagtagtagccagtaattcaacgtccgtggaacaatgtcaagattctagaattagaattactagcatgagaagtgcaaattctagcctttttcacaaataaataaaagatgtttgaacaaacgaaagcttagtatatttctagggagcgagcaaacaagaacccagagtaacgaagaggggatacctccgagccaggggttgcctggcgggagcaccgaccagggggagcctctcccccgctgccctcgcgcacgccttcatctccctcctcctcctcctcctcctctcccccgccgccggccaccgcgaaagattacgagccgcggagcgcgacgccgaggcggccggagcaaaatttctcccggagagagaggactagtcaaaccactaaacaaaaagacggttttactgtatatcatccgagcccgacgcggggaaagggtctctgcctcagtgtctcacagacaggtgggccccaccccgctcctgccttctaggaggggctgttccgcgaggaggcgtaaagtggaggggctcttttgcaaaaagataacggaattgctatccttccgtcgatagaaaatactacatccccaaatcttcgggattttggatcactgaatgtgcttcgtgattcgtgctcagttgtttcttttccaactccggcgtcctcctcttcttctccggcaccggcgacagggaagacagctgcgcgggacagctcgccgccactggcttgaggaaaaggagaggagagggagggggagggggactcgccggcaccgttgacagttgacacctttcggccagccggcgaggccggggtggcggcacggtggggcgtcggcggcgcaggaagcgcgcggtgtcgagactcgagaggaggagcgctcgagcgctttgtgcggcggcagggaggaaaaaggaaaagtggtttagggttttgtggattttgcacgaatctcaaaccaattcaatggtctaaaatttgcaagatattaggaggggttttctatcaaagattaaaaaataaactcccccttcgcttctcgctagggtttaagccggcggcggcggcgaggttgtgcagatggcggaggcggccgtgaggtgcctccgggacgggcgcctcgacggggagcacgctccggcacttgccgtggcgagtaatatccagtgcggcccgctcgccgccggcgccatgctccacctcgcggccgccgtggcctccaacgccgccgcggggaaggcgcaggcgaggtattattgttgggcttcttcgatggtttgctgctttagctcggggtggtatgggcgatgacgtgagttggctccgttgcgacttgttgtggcgcaggggactggtgatcgtggcgttcgatcggagcccggaggtgtatctcgacttcatgcggcgccgcggccttgatccaaatgctttgaatcgatggtaatggtcttaacatttcagagcttacaatttgaacacaactgccacttaacaattatgatcttaactgcaaaaccagagctttgcgtatctgaagaaatttattatgctagtgcgacctctttggcaaatctaaaatttaaataggctaagttggcacctcacactcacagccacctatagggaaatgcttgagtcaacagtattcactcatattgtcaacatagcttattgatggtagaacctacataaatactgagtgctcagtaagttttagaatctttttacattgttccaacagtgtacggatattggattgctattcagacccaattggatggaatcagaagattagaagtcagcagcaacaagaaagtggtgcagatctctgctcagcgaacaaagagaatgttacaattttcagaaatgtgaaggatcttgataaattgatgtgctccactattgatcttggaagaggtagaagctttttgactagctacttgtctctctttgtgatcttaaagcttatgctgttgctatgaataccagggtttgcaggagaaggcaaaatctatttttcaattgctgttgactcagtaagtaccttctcggagacgtctctatcttatagtttacttggagtttggatctcccatcaataaaattttaccccatatgttgcaattatgccaaagcttgcttcatgtttttctagacatgttcctcttataatgctgtatcaattgttgtcaagctgttctaatttggttgctgtggctggtgagtttattgaatcttgagctactggattagaaatgttccatctcaacaacaaaaaaaattgtttgttggactgtcttgcttagatctggaaataaagttaagcttgcacttttccagaaaccaagtttagtgttttctgtattgtattgtagctattgttcagcaagctgtcatttcagtacgtttggatggtatctgaaagccaaagcatgatctcacttttctccccatctgtataacaccaatatttcacacacaagtcacaagctttccaccatttgtgtcttaccatatgataagttgacattgattactctttgaaacaaaatcatctttactttaattctgaagttactttcactttcgtgatactgttttagcttttgttaatgttaacagcaagatcgtgtatgatatttcagattagttctatgttaaggcgtgcttcagtgtcatcaatttcaagcttcctcagtaatcttcggagccatggtatttactttctttccttctatttgcgtattcatggcagttggaagttggaactcaatgccaatcatttgtattaatgatgttttgcttgtacgtaacaatgatgtgttgttattcacttgatccttgaagtataaatttgtgttctcatattgcagatcaaatatcatcaatattttggctaatacattctgatctccatgaacccaaattttcccgagcctttgaatgtctctctaccatggttgcttcattagagccagctgtggttgattctgtttatgaggaagaaattccagggaatatttctttcctggaggaaaattattctaaagcaaagttttatttacgcctaaaacggcggaatggacgggtcaagcaccttgtaaggttttgacttcaatgttcaaatcattctgaatttcacgtcatgaagagtgtacactgataaatattattcctacattttcagtacgaggagttacatgttgagggaaatgatgttagatttgtttctgctccttctgtaagtacagaagtgagccaaagtctgttgcctaaggttgggctatacatttcttactcaagttaaaatactcttctgtcttcactgccaactaatctagtcttctcaacattgactgtattgcaacatgtggatttaacaggttcagttcaatcttgagctgtcagagaaggagtgcagtgacaaggcaaatgttgttcttccttttgaacatcaaggtacttaccttaccggaagttatttgccaaaagttagcttatgtttcaggtctccttgtcagctgcattctgactgcatgagctacatggatgatatatctgcaactaaattcttttaacaccctaatctcaggaaagggtgagcctatccatatatacgacggacggagatctctcccagaggctcaacaagatagcaatttaactgcatccgctctcctggatgaagtaaaatttcctaaatctgcagctccaaagggtgaaattcattactttcgtgattctgatgatgagcaacctgactccgatgaagacccagatgacgatttggatatttgagttccacccatggtgtgagcaccttatctgcatacagaatgccttgatcgtacttgcgaggtaaccgatagccccgatcagaacttataatcatgagtagtattagtatttgttacacctctgttttctgttctttacactgatggtagtgtttttgtgacaagataatagaatgatagtccgtccgtgctacacactaccttgtactgttagtgcatgcattcagttatccccaaaatgtttaaaaagtgtttacatatgcaaaacagcaacaaactacaatttcttggggaaactaaaatggaagcaggcgaccttttttttccctttattaaaggatggtagacaaggaaagtttttatgagaactatgtaccgtgctgattaaattctctcatcacagagtccttacaagttacaaatgaaatgtaagcattggatctacgtatatatataaaaaagttactagaatcactaaaaaaaatggaaggaaatgaagtgacaatgcaattagcctagaactagaaaaaatagcaacattgtgaccaaggaaacgactgctgatccagtgggcagcaaagtctagggcgctcctacaattcaaactaaatcatatcatattaattagtacgtaccggatctgagctcgattttggcctctgccttggagtcgaggtcgagggtcatgcagttctccttgaactccttgtgcttgacggtggcattgtactcgccgtggaagatctccacctcgaggacgcccttggagtcggtcttgccggtgtggccggccgtccactccttgaggagcttgtcgatggcgtcgccgacggggaggttcttgaagctgttgtctgtgaagcacatgacgtagcatcccttggcgtgccacgccccccagagcacgatgcccttgacggccgggtgcgcgaacccttcgcgcatcacctcatccaggtactccacctggttcttgcagggcttgacgtccacctcggtgagccagatgggcaccttggcctgcgccagcgtgtcgatggagccacgcatgtaggggatgttcggcgcggcgaagtggctctcgaggccgatgccgtacttgaggtcggcgttgcccgggaactcgcggatctgcttgagcttggccacgtacttggtcggcagcggcgccgcgtcgttgggctcctcgatggtgttgaactcgttcatgaagaggatgggcttgctgtcgagcttggccacgtccctgaagatctccgccgacgcgtccttgccgagcttgccctcgaagaagttgaagtggaggttctcgttgacgacgtcccagtggatcaccttgccggcgtagcgggtgacgatgtccttgagccgcttcgccatggcctccttgagctccggcacgcccagcttctccacccagtccatctgcttgtcctggtcgtcccagaacacgttgtggccgcgcagcgtgatgttgtgcttctccgcgagctccaccatcttgtccgaaaccttgtagtcctcctcgttctggtggaactccgtgctgtaccacttcatctcgttctccagggtcgcgtaccggaaccgcgccgcgaaccacttctcgtactccggcatgtccaggatctccttggtcatcgcgttccccagcgggaaccccttccccacccgctccaggctcacgtccgcttccggcaccggcttgccgtcggggcccaccaccgtgatcttcaccttcttcatcctctcctgtgtcaattgccaattaattccaccatcagtcaatgttactcttctccagctctctgattaattcttcagcatcagcagcaacgacatgatgcaatcgagttcatggtgcatatatatgcaccttcttgacggactccgcgcgatggcccttccattcgtcgaagctgaagggctgcagcgccatcccttccgccatcacctccgccgtcacgttggtctgcatgcacacaaaatacgctgttcattcccgttcattcctctatccgacttaaacagctagctgctcccttcgtcccaaaatataattgattttcggcagatgtgatatatcttaatactataaatctgaataagctctctcatcagatttacagtatagaatgtgtcacatccaacaaaaacctcttatattttagaacggagggagtatgatctactctcgtcgcgtggctgatgacctcgaagaagatgtcgcccttgccgtcgtcgtaggaggtggcgccgcccttgagcatggtccagcagccgcacttggccgcgatcatgccggcggtgttgaacttgccgtcgggggtcaccagcacggccctgatgtcgccttcccccttggagagctgcagccacactgcgtatgcatgcgcacgacgatcaagatcagagcgaaagagatcatcggtctaggagtcggctagccggcggccgttaccggacaaggcgtagtggtggtccttcttgaggtcgaccttgagggcggagcccttcaccggagcggcgctcttgctattctccgacagaagcttcttgccgctggcataccccttagcctcggtctccttcaggataccgccgccgtacagaggcttctccggctccttcacgcactgcacgcaaatatttgcacttcaagaatcgatctcgtcctttctcattgcatatcatagtgtacataagtgaggacgaagaatgtaacccggcaaaaagaggacgaagaatgtatgtgtcacttgcctcaatgtttgctgagtagtcatatggaacactttgagatctgaccaagcatcctgcattcgttgacaagagaggcgattaggcattagcatcttgatcttgatcatatatatatatacgcaggcgtatacggatttgacaacggcaaaaaaaattaaatgctaactgaagttctctgaaactgaaacggctggaagtctgaaacatgtttctagtcacatggccaagtgccaagtctgtgtgattacgacaactgatggatttcaataaaacagtaatttaaacagtagcacatcacattgtttgcaattgaaaggaaaatgcaaattgaagcgatctaattgaaagacccctaaccttcgaagaggataatggccaagaaaaagaccaacttccctgtgaaaaccttcatatatatttctctatcactgactacgattaatccgtgacataatgttgacatttctgcttatatagctatgggatgagagaacatcggagatttaacagtctataaataggaggaagacagtttcacatgtagggaggtaattaatccacaatgtttagtgccttaaaaatacattcagtttagaggatcaccattgatttccctagctttagctgcactccaactagtggttctgctttgtacttgatactccatagaaaccactagagtttaacagtttaatcgttggctttagcaacaaaaaaaaaattataggtaaggactcttatatcaagtatccttagctctttaaaagctaatgttagaaaataaactatgataataaaaactcaaattaactctagtttcgaaatttaaattttggctgataagccgattggaaaacgatggtgcggcaaaaatggactctcttaagttttaggatgagcctaaaatccatttagcatttctcgtcgtctttctatacgatgatgggaaacaagaacatgcagggtagactagtctcaatcaagagaagtatgtatataaagaagaacaaatggaatttcttcttccttttaatatgaacatccaatcaatcgcctctccaggaatgataaatcaatccatgggcgcatatgaaatcacacacaacaatcatgcacatggatacgtatacattgagctaataaattgagctaatagctagctagacgtgtatggtgaactcgttgtcggactccctgtcgacgctgaggctctgcgccacggtggagttcgccgccgggtgggtgacggtgaccttgtagtccccgtggaacagctcggtctcgtagtagccgtcggcgtcggcgacgccgacgtgggagcgcgtcttccactcccagatgagcttgtcgacgacgtcgccggcggggaggttcttgaagttgttgtcggtgaggcacatgacgtagcatccctgcgggtgccacgccgtccagaggatgatgccgtgcaccgccgggtgggcgtacacctcccggaggatctgctcgaggtggcgcgcctggtcgggccccggcgcgacgtcgatctcggtgagccagatgggcgcgttggcctgcgccatggtgtcgagcgcggcgcggatgtaagggatgttgggttgcgcgctgaagtggccctcgaggccgatgcccatccgggcggcgttgccgttccccgggaacgccttgatctgccacagcttgcggaggtacttgccggggagcaccgtcaggtcgcccggctgctccagcgtgttgaactcgttcatggacatgagcgcgccgccgtccatctggtgcgccttgcggtagaacgccgccgacgcctcccacccgaaccggccctcgaagaagtcgaagtggaggttctcgttcaccacgtcccacgcgatcacctgcccggagtaccgcgacatcaccgacttgatccgcttctccgtggcgcggcggagctgctcgccggagagcgccttcacccaccccatctgcgtgctcgggtcgtcccagaagatgttgtgcccgcgcaccgcgatgccgtggctcttggcgaaccggagcatcgcgtcgggcaccgagtagtcctcccgccccgggatcgcctccgtgctgtaccacttcatctcgttctcgaacgtggtcaccgtgaaccgcgacgtgaaccaccgctggtaccccgggttggtcaggatctccttgctcatcgccgaccccagagggaagccgttgcggacgtgctcgatgtgcatccgcgcgccggcgaccgggttgcctgcggcgtccctcgcctggagccgcaccgtcttcttcctcgccttcttgatggccgccccgtggtgcgcgctccactcctccctcgagaacggctgcagcgacacgttgtccacccatatgtccaccgtcgcgttgctctgccatggcatcacaccattgcatccccgtctcgtcagaaacagagtaatcttgaattcttgattgctatggcgatgagatcgatcgattcgtttacctcgaagtagagttcagcctgcccggcggcggcggcggtgagcccgcccttgagaatggaccagcacccggacctcgcctcgacgccgccggagtggatgaagtcgccgccggccgtcttcacaacggctctcacgtcggcgatcccgtcactaacctgcaaccaagctgcacacgagaccgagcacaaagcttccatgagctaccggaaacaacacggcgaaggaagaacaagacggcggtggttcttgtcgccggacggacctgagagggtgtagtgcgtgtcgtcctggaggagcaccttctggctgacgctctggtacggccgcgtccggttcgttgccacggcgtacctgttccccgccggcgacgagcccacggcgaggctgccgtacccgaaggccgaccagccctggagtccggcgctgaagtcgccgttgcggatgatgccgccaccgtagtgagcgtccatcggctcaggcaagcactgcagtccatagcttcattgttcagctaaacaaattttaccgaaggtaacaaaatagtaatagttgttcactgtggggaaactattctaatctctcgaggggatgttccctcgtttgcttaaaaaccatctaaacggttatgaaaaattctgaaaaaatttgacaacattcatacaacgcatatatgcaactctacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctatattgttaattttttttcagaatttttcacaattatttgcatcgaatttgaaagaaaaaggtatatgaggggatatcccctcgagggattagaatccactcccgttcactgtgataaaggaaatttgtacagtaatcaagattaacgaaatacactgttcataaatcatttgcacaagaaaatgtaaaaacttcagagaaatgttacagaagcagtggtggtttacactttacagcgtggtaataaccgtcaaaactaccaaaggatcctgtcaagatcacagtaaaaggtaatactaccaaaaggttatgtacggttcagacttcagaactgtacctatcaagatattagtagcagtaaccgtcgaccaaactagcatgagaacggtatggacatgccagattttgtttggtacggtatcacccaggccaaagccaaaacctacacatatttggtcttccacttgggtgcggtaactaattctgaccacaagctgaacctatcacaacaaaattctttgacctgccttcaaaagtcccaagtgacggcacctatatgtctaaccctgcagctaacataagactacccaaagaaaaaagttcagaaaagacaatggttaaagctaattactcgggaacagtacaaagctacttgtttggaagcatttgactttcctatcctggccgggcagtttcactgtgcagggtgatgagacagtcagaacagaggacaacacagacaacatcttcaccaaccaactaatcaagtaccaggagaaaagttagcatcagcgcatgatttgcccaatacagcgtgtggcggacaatggggtacacacgccctcctgctcgccgttcgccggaaaaaagctacccctgcaaactccggcacgctttgaccggctccatgatcaagctgctcctggtgctcataacgattctttccaataaaaaagatcgtgttcacaacaagcacagataggtgcgtgattgggtcgggtgcgttgcacgatgggttctcagttaggctaactgcagcatgtacagttcaaagacgggagttttgttaggctcgaattgaagtggtaaagaagaccgatttggaagtttggattggatggtgaagggttgaaacgatcgagccagaccgatagatggacgtgtgtggtgaggttctccaagttcggtgtacgaggaactaacttttggtttttttctgtggcaactggctcggttttgggaggcttttgaagaggctttcggttcttggtgtgctcctcacagattttttttttcttttgttaagtgaggtatcttgcagctgaaacatgcaagatttcatctccctcatgcttgtttggtctgtttccaccatctaccagatgatcaatggttaattaaacttcagtcatattcttgctcctaattgtagcttcgttcacattagcactaaacatgtcagggaggccctgcctacgcaaacccaacatgcagaaggtctcgatggtgactggtgagtggggtgaggccggcaaagatcacacaaaggcaactgcaacaacaagaaggaaaaaaatattccggcatatgtatgcatggcccgcatagcgcgcccacacttgtgtcacctgtcagtaacaaatcggctcgcccaactaacgacggccggtgttagctgcacatactacgcttgcatgatcaaaaggcaggtcgatcgaattagtgcaatctgatctctgctggctcagccaactagggaagcaactaagcaatcttaatcatagtattaatttgttgcactggtctgagcagatcgaggttgtgtgcaagcagcagtcaacagcagctggtggtaccatgttccagtggggtccaataactatgtgaccaacagaggttctgcatgacgcatgagctgtgggagagtgcgacgcaaagaacgaccatgctcacattggtaccatgaagcatggatttgacgatgataatggtgagagagaacgagagagagaggctgcatacctcagagcttgacgagtagtcgtaagcaagcggtcgcgccatgccagaagccgcctcagcagctggtgaaatgaaagaaacgcgagcttctttaacttaactatcctaagaacaagattgcaagaacatgcaaagaaggagagatcgagctccatgaccatgaatctgctacgtacccttcaccacgccggcgacgagccacgccaacaagaacacagcgcttgccctcctcctcatggctgaatcccgcccggctccctcccctgcccctcctccggcaagaaaaaaacccacgatgtttcgcacaagcgagagggaaagagagagaggtgcagcgagcgcgcgagagatgttgtaagctaagctaggcaggcgcgccaactgcaccgtcgtctgtgcatgccacggcgtctgcgtgggctcccacatttataggcgaggcagagagaactaccggtgtttgcctgtggctacatgctcccgcccgcgtcgcgtctcgcgttgcttgttggttgatgttggaacggaaaacgactcgatggcctcacccacgatgggatcgatcgatcgctgacgcgagcgcggctgcaatgccgtgccgtacgtgcatatggggttgcgacggcgggcgggcgggcgcggcagtttcgctgcggctgcgagagcgggcgagccatatgccagtggctgcgcactaacgaactcactctgactcgcttctgcggttcgctcgcctttttgaccatccacggctcgaccgagttcaacggacgcgcgctgtgtgtctactgtctctgtctagctccacttatctcgaccgcggccatccatgcggtcgacttggtgcaaagctagtagtgttcggttcaacgttcggtatactagggacgaagaacatgggagtgttaattaaacggtttgctaaaaatatgacggcacaattttcattcaatttcggtcactttttttcttcatatttgattgttctccattctatatgtatgcttctggtatctctcgtatatgctcttccaagcatataataaactaatacatccatcttaaaatgtaaaaaacttgagttagacacgtgtattaaggaaatatgtggagttaaataggaaaaggttgtgattgattgaaaataaaatgtaggtggagaaattaaattggacaaaattgtgattgattgagaatataatatagataaaaaagttataatattttagaataaattttaaatgctaaagttgtattttcaaatagatggagtacttttaatcctaacctttatgtatacataatttattagaaaagttacaatgtaaatatcatttacaatataattataatataaatgtaagtattttacaatataagaatggtttaactatttcttagaaatgtggtgtaataaatatactccctaattaatttgtttgaaagaggggtaattttaatcggaaaaatcaattgcaaaaggaaaaacacatcagaagaagaagaaaaaaacacatcgtaaacgtacaagcacataaaaaacctaatgtgctattggatgttttaaagagttacttccttgtttattgtcggtaagttttccaaactgctaagtttgatttgaaaataaggtacgataggttatgtttatcttgttttttataagatggtctatatatatgattggcataagggatgaaatggttgtattttttgataaatgagagggtgtggctcatatgtccatgagagaaagtgggttggattggtatattaattttgaggtatgaagctgacccgaatctaaagagaatatttattttatgggccatttcatttcatgtgtccttaactaaacatcccgaggaatatattcgctccaacctgattgatcccatccctccaaccaaacatgagcttaacgtctttttaacgtcttttgtgaaaacttcatacatcaaagttagttttctaaatttgtaataattactattcaattagttatgctctaatgactcatattgttttgcgtgtaagcgataagcctcagcccatccctccatctcgaacggagccttgtcacaggtgagatccgacggcatggggtgtgctgtaaatggacttctcccacaactcgaggctaaagagggcgccccggtggttaacaaacggccgggccggttgccgatgtgcgcaagcgctcatcatgcaaagctcccgtcgtgtggcacgcgatgccacgagacgaggacgaggccacgaggggcgttgcgcgatgacgcgcggctgctggctctcgcgcgcgtacgttggtgttccgtgggggcagctgcaacgacgtacggctggcccaggcctcggctacgtgccacggtgccagttgccacacagtagccgatctggttgataaacaaccatttgcgttccgagattagttcggcttagctccaatcaccgagttgatccggttgattaagccttttttgcgtcccgtgaacaaactgcctttgctatactaaataaatgatgagcagtggccgtatggacacacatgatagcttcagtgccactcttttgaaacggtgcgaaattttgagaaattttcacctttgtatagctactagtgtttgacactagttcagttggggcgaacaggggcaacatcagaacagagtacaatggccacgttaatgaccgagggtaatgtgtggggtgttcgatctccgacgtccatatcaccgtacgaaaccgcgcctgaagagagagagagagagagagatcaccaaaatcatcctgcggatcgtgccatgacgcgcgcgtggatacctgcgcttttgtcaacgcaacagcgacgtccccctccccgtccccggcatcccaccgatccagcagcgcacgccgccgcatcgatcgcccaataatctcctctgcttcacttcactcctacgcctctcatctcatctccttgccaatatgcaaatccctcagctcgcaacccgtacgcgcggttcacacttcacatgcaggtctgctccacgaaacacgcgaagaagaaaaagaaaagaagaggatttcctcgccgtttgtgccgtggaggcttttcgcgaccggattagtttctctctctctctctctctctctctctctctctctctctctctgtttttttttcttttttccgtgtcgtgttcgtgcgggcgagcgagcgagcgagcgggtgcgcccgtgccgttgcgaaatcttggacgaatgcacgcgtgagtcgctgaaaatggttgattggttgcaaacgccgcgcacgtaagggagactacacatggcggtgagctattggttggcttctgtggctaccagactgctgctgggattcgtggccatggattcgttcctcgtctgcagcccagacctgccgttaagttcggtacaggcgttgtcgcgttgaacggagggaagcagtttacagaaagtttctacgcgtagtagtgctcgagtcgaagtctagttgagtccgaccgactcgagatgtaagtcgaagaattcgacaagcttgggttcgaccgtcaggccgtgaaaaaaaaaacgatcgaaaaccgcaagatttcaaagtttagatgtgtgatgaaagcagatcccgagtaaaactgtaaatagtattcgaaaattcaaatttgaaacagcaaattcgaccaaaacctgatcaaaatttggtgaaaaaattataccaacatgggttgggaattcggacctggtgctaaatcgaaaagatgaacctggccggatgtacttccttcgccccataaaaaactaatctaataccggatatgaaatattctagtactacgaatcttcgtattactcccttcatctcaaaataagcaaaaccatgagtttttgtgtccaactttgatcgtccgtcttatttgaaatttttttataattagtatttttattgttagtagattataaaacatgaatagtattttatgtgtgatttatgttttttagtattttttttaaaaaataaataagacgggtgattaaaattggacatggaaacttatggttgcgcttattttaagacggagagagtatgtcacgttcattctagattcgttttttatgtaactgaggggtagcttggaataatatagctgacttgacaggattaattagaaacagtgacattgtaggattaattgtctcgtccacgggtgttaactacatgtacacagtgacggagcctccgccggtgacccaggcagcttggaataatagctaacttgacaggattaattagaaacagtgacattgcatgattaattgtctcgtccacgggtgtttactacatgtatgcagtgacggagcctccgccggtgaccccaggcaatggtatgggctcgtcgcaatgaacacgctgtaaaatttgttatattatagaattgaatacaaaattttcgtagtaaataattgttgtaattccgttgtgggctctctcaaaattttacttaacatttggcgtgatttgcgattgatccggcaaaaatttcttctgctggatgaacatggtcacgtgcgtgcatgctttaattactcgactgttagtgcggatttaacgtaaaaatgttaggtcaattggtttgaatcgttctttgtttctctctttctttttgtccttttattaattcgtttttggtttgctactttgacttggacgtatggcaggcagtgatcaacggcgtagaacacagctccagagctagctccttagttgacttgatatttcctgccttgtttaatcacagccgctatatgtttacgttatatatactgccattggtgtataccaacataagaggtagtagaattcaaaggaaataaaagagttagaatggtttgcttgtttgtttctgttagttaggtaatttggctggacttggtgtaatgtgatttctgccccaaccctttatcactagtcactgaaacattttttttcatcagctgaacctttcttcctgatagggaaaggtggttagaaccccagaaattcagagaatgtatgcccaagactacagacaatcaaacttcagagagaatccgacgtcactgtggctgaatggggagcccactaatcactgggataagcaaagaaaggcattgcaacttggctagggatcatacactgtccaaatgaatgtaacagctctccaagcccggtcaaaccataatcagatgctggtcggctacattggcacctgatgtgagacgttcatttcctgattgctttgcggctcgttgtctcagactgtgagtgctctttctgctttgatgctcatgattgcaactagagttcatgataattcatcacacagagagtttgtacacttgaaaaatagcagcagcaagatcaaaagaagatagccaaatgctcgaaatatcttatgaatatgacagtcactgagacactgactaccatattggtgtaaaaaaagacttccatttactctgttcccatacgatcagcatctggaaggtctttgaaacgataacttgaaggaaactgtgccacaattttttccttggaagtttaaacagtgagagcttaaactgcacaatttattccaaataattgggatccagtatcaaattatacattactaagaataaatacatctcacacatttttaaccggaatgtgcatgcggagtcaacaaattacagctatgctagaacagtacacaactacacaagagcgagtaacccatgatgataggccacatgtattgattgcaaattgatgcatcttattctggatcaaatggatcacactagtgtccacgagtggaggacactcaggaatcaaatcaatcttcacaaatatatgctaagcttgcaaatatccgttctcttcaaggtagcacagaacatgctgggccattgctttgggtgaaggacattccccatctaccatcttaattactatctgtggaaggccagaaaaaaatctattcagctatgttcaacaagcagataactttgcattttacatgtgggtaatgtcattcaatgtaatagataaatgatgaccctagttctttttgtctaaagtaaatgatcaaatcagaattcagattcatttatgtttggcaacatgtatgtcagattcaaaaaataaattaataagaaactccgacacttgtttagttgttttatccagctttaatcaaaccagccaaagcagagaaatcggaattgtgtatcccatcacaagtctgagatcaaaactaaatatattttttcctcatgccatcaattaaagcaagctacaatatgtgcatcaataaatgataacactactttttggttaaatattgccaattcttccgtgaatgaggttgctggatctaatagtgatagatatgtacacatataaacattaggaaggactataaatgaataaatgttcatagtcttatttctatggcaggagcatacaatgtaaatagttatagctaacagcggaatgatgatagtcagcactcggcagtaaagcactttttcagtagtgaataccctacacttagacttttagtttaccgtagtccgtatggaatggtaaggtgtggcccagtatgaatgcaaggcatgatctgcaagctcacctcactattcactggtgattcatatggatcatcaattccagtgaagcctgtttgtcaaaaaggaaaatttcaaaataaaaataccattaggcgttcaatccgtacgctcttttagtatactgaatgaactaaatataaaagttaattgtcccacaatgactcaaaaggtatcctgtacctttaatctttccagagcgtgcaagcttgtatagacctttaggatcacgagcttcacaaatttctagtggcaaatccataaatacctacaacgcttgtttctgttagatgcttaacagtaacgagatgataaaagaaacataacagaagcatacttcaataaatctagactctggaagcagcacacggcacgcatcacggtctctcctatatggagatatcaaactagcaatgcatatgattccagcatctgcgaatagctttgccacttctcctgcataagaatttaagttgtagtgaaaccatttctaacaaatggacctgttgtttttgagaacttaccaactcttcgtatattttctgcacggtcttctgccttgaagcttagatctcgatttaggccatgccttaggttgtcaccatcaaggacataagtaaggtggccgctgcaatgcaactcccgattcagtgcacatgcaagagtgcttttccctgaaatatgaaaaggtggtaagatcctcatgataacttccatgtatacagataattacacagctactggagattcaagagatccttagttctggtatgatactatgaactgaaatgtgcctcaggctcatacagagttatactttcaacgtggatgaaggtggtaatgaagcatgcaaatatgtgataaattctagtctaaatggagaaaattacattttgtgtgatccatgatcaactagatgtcagctacctacagagcatctactgaactaaatttgagcatattgagtattgactcaactggatttacaaaaatcctctcccgccgcctagcccctcttctagattccctggtcgcaccaaatcaaagcgcgttcatcaagaaacgatgcattcaagacaattttatgcttgtccgtcagtctgcaaagaaactccaccaaaagaagcggtcgtctcttctcctcaaattagacattgcacaagcatttgactcgatttcctggcctttcatcttggaggtgctggagcacaggggcttcggtggaagatggagagcttgggtcgcattgctgttccgcaccgcaacaactcgaattctaattaatggtgccccgggagagctggtgcaacacaggcgaggagtccggcagggtgacccgatttcaccgatgatcttcatcttagcgatggactttctgacattgctctttcatcaagccgaagacaccggtctgctgaatgggttggaaattcctcatcgtatctccttatatgccgatgacgtggtcgttttcatcaaacctgagattgagatagcggcagcaactgagatcttgaacatctttggtgaagcctccgggctgcgaacgaacttcgccaagtgctcagctatgcccattcaatgcacggatgagcaaatcgccttaatacaactggtgctaccctgtgctattgcgcccttcccgtgcaaatatctgggtctgcccttatccatcttcaagctgaagaaagaggacctgcagcctcttgttgataagattgcccgacggctgcccacatggaaatccaatcagatgccgccgatcggtcgtgtaaccatggccaatgctgttttgagcgccataccaatctatctactggtcgcaattgatgcacccaagtgggtgatcaaaggtattgataaggtacggcgtggttttctttgggcgggcaaggcgcaagcgaatggtggatgctgccaagtagcctggaccaaagtatgctcccccaaggattatgggggtcttggagtgccgaacttggagctcatgggcattgtactacgttcccgctggacgtggatgcaaaggatttctctggccaagccttggcagggattagcaatcccctgcacacagaaagagcgtaacttcgtcgccgcctccaccgtctgtcagttaggtaacaggtgaacaatcctttttttgggaggacagttggttacaaggaggaaacatccgagctattgcgccctcgatctacgagcatgcctctgctcgcatccaaaagtgccggatggtggctgaagcgctgattaaccgtagatggatcagagacataagcggcgcgcttaggactcaggcaatacttgaatacctcaagctttggtcgttgattcagtcagttgtttgttcatcctcagaaccagactcactctcctggaagtgggaaagctcaggcaagtacacctcaaaatctgcctaccgagctttgttctttggacgaattgcctttgaatccacaccgatctggaattcgttggcgccacctcgctattgtttcttcctctggctggtcactttgaacagatgttggacagccgaccgactgcggagtcggggattgccacatcccgactgttgcattctctgtgatcagcaggaagagagcattgatcatatcttagtcggttttccggaatcaaggcagctatggtggtgggctttgagagcaatcgggcaccccaactgcctaccggtgaatgaagcttcctttcaccaatggatgtgtgacagcagaatggtgttaagtgagtcacatcgtcgaggcttcgatacggtggtgacattggtagcgtggacaatctagaaggaacggaatggtcggatcttcaatcagcagcacagatcatgggtagatgtggcgagagggatggctgacgaggcttctctttggcgtaaagcaaacccggcgatccctgcgctgcaattcaggagggagtttggtcgccaaacctagcgcgagagatagatataggattaattgtcaatgtcctgtatcagtcccatgttgtttttcctttcaaatgtaaataacttttatttctcttaacggaaaaaatgcgctccttgcgtattcccgaaaaaagtattgactcaactactaatcatcatatggatctataatgatcgatgttcatttcaacctttatgtggttaatcacgaccaattatgttatctgatggaaggaaacgaactacacattgatcaagactaaacattccaatttaaatgataaaatcatatttctctagcacagagctaacaaatcaagtggagttattgaaaaaatagtagccaaaaaacatatcttacaacgtagaaaagcaattattattaaactttatcagggaagtaaaaggggaccaggctgtaaatcaagggagttctgaactgaaaataacctgagccgctgagtcctgtgatccaaatgacacatcctttttgccccaacaagttctgcctctcagattgtccaattgggcaattgtgccacagtatattggttgatttcccaatggttgacactagaggcttctctttaactgcaatgggaaccaagacatggttagtggcttagcgcaactctgttcctgttgttgaacaaacatatttgcatatagtacaaacaacatgaaaaaggataatctatataaaatataagggagagattatctttgacaccttttccttcacattattacttgtataatacaaaaaggtaatatctactctgattaaatgcacatgaattccagagttctcaatgctcccgaaagaacactgaaaagtactactatgattttctcataacattctcttcttgttgctaatcatatcatccatcaaccagacaagtatgtgttctctttatcataacttcttaagagggttcgcaaattgtgtactcacgttcaaagtatatttgaaaacatcaccaacgtcattccattgccccgtcaccaacttagtatgtaaataaactactcccaaagtcccaatatagtagaagattctacctatgatggtaaaaaaaaaaaaaaagaaaagctctaacttctccaccatgtagcaaaaacatccaatattctctcagattcgtcacaaaaaaaaaagaagcaaaaccattcaacattgtgccaaaatagagtattccatcaaacttcaaccagcaattcaccacccaaaggccccatacacagcaaaaaggacaaaaagaaagagcatcaggcataaaaaccatatgcccaaacacatcacggtcaagtgtcccatttgttgaattctgttacagcacgtatttgttctcaccaaaaagtcgtgatcactaaatatgtggaggtcaccaacagaagcagcatccaagcagcgggaacaaaccaatgcattatctaccacgccattcccctcgagagattctggacccatcgagacgccgacccacggccaactaaccaccgagctggaagtaggagaggagtagaccgacgacgacgacgaacctgggctgcgggagccgtccccggcgagctgctgctgctgctccatccctctcccggccgggccgcctccgcccaatgccgccaccacacgcgacggggccctcctcccggtcgccgcggccgccgccgccgagggtgccgggggccgcgctcgcagaagcggggaggggatcgcgtgcgagggcatgggtcacgagcggggcattgcagggggggaggaggaggcggcggcgggatcccgtcggtggcggctgcggagtgcggaggcagagccgcagaggcgctgcgttgcgggagagcggaggtgggagggagggaaggattgttgttgattggagagggagggcgacgtcacccgcgtggggatgaattcgatgagctgccgtgtcggtctgccttgccagttgccactgtgagtctgcgaggggcgaggctaggggtggccggccatttatgcatttgacacgctgtggcaatttttagtgccacatcagcgagctcgatgttaaggtggtataggtcgcagggctgggaggagaatgatctatctcaaaacatatatagtgcagaaatactacgtaacgatatacggtttcaataggaaatatcagatccgatatctatcataccattttgatgttaatatggttactagatatctgatatctacgaagtatcatgttttgataccttagatattagattcagtacttacaatatcatactaatgttacgctgacacaaacacacattagctatttacacattagctattttgtttgaacattatactgttatgtagtctctcttaaatatatatagctattttaatctaaattcacaaacaaaaaataaccatatttttaaaacgaagagagtatattattatcatgatcggaatcgatgatcagtgacatccatcgcagtcgagagactttgttagcttattagccacaaatataatttcaattttaaaacttaattttagaattgtctttaggttttcttttatcgtagaatgctttttttgtttttaaatagttaatagcacaagtataaagactatctacaaatattctttttgaaaggaatttagaaattaaattcggttgcttcattcttttcttttatgacttagcaatcgagactcgaacgatcggagcctcaggagggcaaaagcttaaaagatgggtttaaatttgtacagaaaaatttactccatttcgaaaggtgtaaatctcaaacttgcaccgtaatgatcatgttggctgcactttgaaagaatacatgtccattgtccaaccatttcgacacaacaacagtaagtttgcgggttgttttttctggcaaattagcgtcacaattggctttcgcaataaataaacgaagcactcaatcaaccaatccttatcacctaattatttatttgtcatatcaaaacaataattatttatttagtagtcccctgattttccatattgaattttatttgattgggacccctcctctgctgggaaaatgacttttagtaaggaagaaaaccgacgatattttagaaagagacttttcaggatacgtgagcagaagaaatgagcttcaaacaggtaaatcccagatttatcaaatcaatgaacacggcaagaaaaaactcacgtaccttgtgcaaggaatatcaatatagactactggtggcatggcacctcagtagtacatagaaagtgagctttaagctaagaaagagaggaaaacagcatacatctaacaatgactagatgctttcatcaacagaagtagcggataaaatcatgtaaaacacccattggctcctgcccacagagcagcaaaactttaaaagattgaagtaacaggtctgcggaacaaattattggccattgctttgcaaaacaaccaaagaattcgaaatttaacagccatcaaccacagacgatgttatcagggcctgagtgcaagcgctagaccaaacttggggggtctgtccaaggccttggtgtcgaattcaccagagattgtcaaaaccgacttgggtttaacctcatgctggagaagagcagcaagctttccagtgttgttgagccttgccttcacagctgtctcggggtcaaccttgtacaggccaccaacagtgagagtgttctcatttgttgagagcctgcgggttaattcagcaacaacagaggatttctgcttatcatcaaggtgatatacacctgacactttaacggtgtcacctttgtccgccctgcacatgtttgtgtaatgtatcagtactaacattacaacccaggtcatgacaagttacaatgaagcatgtacttacagaacgattgcagcatgataatctggcttggttacacctatcgcagcactgtacttggtaaattttcctgtagcagtgtcaaacccagcttctgcaccaaaggcaagtccttgagcaccagctgttccagaaaattcaaccacaggagatggcttcatgccaacagcagtggcaaaacttgcattctcatggaagtattgcatctccacctgtcattgaaaactcagctatggatcgttttcaatttaaaaacataacttgacacgataaaattacctttccagaattgtagtcaggcagcttgacacttgtcacaagctttgtggatggaaggacatcaaacacagtcaaagtagtagagatctgcagaaatcatatatttgtgttacagctagacagatgttatggagaggaaaaaatataaatctgagtattccatatcacgaacattagattctgtgtccactttgacatcgacgagagtactcttgtacttgtaaactgagctgacatcaagagtataaagcccccctttcttcacagctgtggaagtgaggccctgacaaataaaggacaaaatacatgagaaccacagcatgcaagtttataaagggcaaacaagcatacataataagttaatattactgaaaagatagggcagtattatcatagcaagtaagatcattatacatgtgacaaaattttgcaacaatggtcattgtgtatgttgaccattcattgtatgaaaatggtggatgggcacatgggggcaaaaaattatatgagaagtaatttacacagcaccatatgcaaaggagttaaatgcaatgcttgtcgtagcttcaagcccacaacaagtaatagcatcatacatgcatgtatgtatggaatgtaactcatctatattccaaaatcaaatatgaaattcattttttccagttaacagtgtctatttcaatgcacccagataaaattataggatgtatagtttctatcaggagagaagggactatggttggcaggtttttacaatatttaccctatcaccaccaatttgcattgatatattcttaacagccttaattacttgaaaataaaaggaagaactggagaagtaaacctttttcaattcaacaagcatttcatactgaacagaatatgcatgtgtgatagcacaatccagctagtcaactgttgcataaacagaatgaatatatagctaccttattttttgggggaggaatttatttagataggcttaaagaatggaaactcagtaatatcacatctcatgagagtggaaggataggcttaaagaatggaaactcagtaatatcacatctcatgagagcggaaggatcttggtagtataacatggtaagcacaacatgacctaaaataataaatccagatcctcatagcagccatatgcttgaaaagaaatgctagcgcaaatgaacactagaaggacaactgcagttacataatttgttatttgttacattgatacatccaatgaaagcatctagtgattgcaatttataacccatcctagaagaagcctgcaactacaaccagaatccttcaaaacggcaatataagaaatgaagttctaaaataaaagaagaaaagcaaacgcattgtgcagaactgttatattcaaccttgaatatcagaatatatcaactagcaagtagaaacacttcttatgttttactatatgtctatatcataccagaagagtgtttgtactggtccactgatacagatgagtttggcaacaatggtaagtggaaatgaggaataaccaaacaaaaattgctgtggcggaaacaaatcatgataacattttacacattcaatgtttccaagagtactggttggcaatgatacaggtggctaaccataacttcaactctctagtttctccaaatcgtagctacaacttatgtttctcctattactccaatcacagcctacacactcctacagaaatactaaaagttctaacgacactgccaccaagatgtcatattacagatcaagcatttatacttcgtaactgttcatcatagacaaacccccaatgatatctctattgcttcagacacatgcagaatcttcattgagtcaggaggggagcagcagcgcctcgaacaccggtgctgactacactacctcctgtagcagaattgaactttatacgatctagctcccccaattaattccctcaaatatacaagtcactgaattgctctacaaaatgaacgatttcccatttcctatcaggctatcacgcagctaacgggcattagcactacatccattcacatgaaaaaacagcaaacacgccgaggaattgcagccacggaaagacctgacaaacccgaaacctaaatagcagcaattaaacaggccatgagcccatgactacagcacgcatcctacccgtcaacaaatcaagactacgcacaaccacaaccacgactagatggcaaagctcgcgggtcaaccacgaacaagcgcaacacggaactcagcgccagatcacacgagcgcgatcggatcggatggggaacccttaccactccggaggagctgacggtggagacggtcagcttctggtcataggtgtagtccttggtgagcagatctgcagatcaccaaaccccaacaacaacgagaaacgaaaacaaacgaattagggaacggaaagcgagcgagcgagcgagagagaggatgagatgggaggaggggtaagatgcgggttacccttggccctcttgccaatgtcggagaagaggccgggtcccttcatggccatggcggcggcggcggcttggggaagggggggaggggggaggcggccgccgaagaggagggagagagaaaggagaggtcagagaggttccgccactagtagaagggaatggtggggcgccacgagaaatactagcacgggcagttgcaacctggagtaaccccaacactgcagtcacggcacatgccgccgccgccggtatttcccgggcgacgaattcgacgttccagatttgtttccaagagacgagcaacagttgcaatgccgaacatctggcagagcacgtacgaatcgcaaagacgcaggaagcggcacagctcatgtgcctgagaatgtcttttttttatttcttttaaaccctttcaccttttaattttaaaataaacccttccaaaaacatactcactccatttacttttgatagtcatatttccaaatctgaaaattttatttttgataggcatatttcaatccaacaacctatcctcttaataactttcttggatttaatgcatgactatccattcttacacacatgattggctacatgggcattgagaaatgtaaatattaataaatcgtttgtttacgaggaatgactagtagcatgtttaaatggatgataagtagaattacttatcattggtctgtgtgccaagatgaaatatgactatcaaaagtagatggagggagtaatttcaaatacgaactttttgccacgccaattaatttagtgtggcaaaataacaccgcagtcgatagaaggataatttcaaataagaactttttgccacaccagttaatttagtgtggcaaaataacaccgcagttgttagaaggttcgtatttagaaataagtttataatggattgttcttaaaattaaaaatttataaggttaaacagtaacaaaaatttatgcctgagagcttcttcacgccctcacccaacatgatccccacctacttgccagctccacgcaacagacacgctgtgcgcatgtgccatcacacttccagcaacaccaggtcgcaatacccaccgacaaagcggcgcagttaaccgaagtaaccaaactcaagcagcaaagaaaattctggcgcgtccagttacagtcagatatgcaaggcaaagcgatttttcacagttcattgcaaggatgggttgctgagataacattaccccatctacaataacagggtttgttgcgcagactttcgcgtagatagttgcctatacacaaaagctggggccttttgccaatgtgtagcaaacaaaattgtgcctcccaaatatgaagggaaacacaccacaccggccaaaatcaactttccatattttaaacctgcattgaaactataatgctagttacaggtatcttgtgaggatttcatctttgatgaggtcagatcctgatgtcttcaatgtctgagagaagggtggcaccacccgctgatctttcatcggggaggctaaccactagctggccacaggcgccagctatgtcttgacccatttgctggcgaatagtggttctgatgttgtaaattcctcttaggatcttctggaacttcttcacattatgttcgctgctagtcttgaaattgtttgatgagccaatgggattgaatggtatcagattaacaacctgttagtgatcaagagaggaagcaatcaagagagaattgattcaaaggttccaatatgaggatataacacatattatgaagacaataacaggcaaaccaactgaagatgttaatatatgaaaagtcaaaccactaaaaggaaattctccaaacaaatacaccgtgacccaacagaaagaccatgggtcataaatcataatacaagtgggcagaaattagaatatcaaacaattgaacatccagggtaagtataccgcaaagatgatcaggaaggttttccaaccatttaaaagaatcattaataagataatcaggatgaaatgaagcagaaagaacagaaagtttcttaccgctttaaacatttcaagtaatttaccaagctggtgggcatgctgctcctgatcgttaactccatcaagcatgatgtactcaataaagatggtctgcttgctgtgatcgaacattcaggtgtttattgaaactcaaagctatcggttcttatatttggcactgatggtgatatttagtaatcttattcttacctctcattttgatatgattgcagtgcattcattagctttactaaaggaaaggcccgggcagcaggcattatatgacagcgtatgtcttggtcaggagcgtgcaaggacacagctagatttatattgggaagatcattattgaacttattgatggaatggataatcccaacctgcagtacacaatattaagattcaaagtcacaattactgctgtttcagtcctaacaaaagttcaatctttcagctgcatcaatcccaaggaaaattcaattgctaaactaaatattagcaggatttacaacttaatggatcatatagggacatgcatcataatcacaacgatttactaatgtcaaaacacgagcataaaactgtaaaagatcaagtaaatcagcagcaaagctttcaccagacagaatgataagaaccatgctatactgaaaagtaaatctgaggagtaaatactagaaaggactcaataataggtgggtggaaatatatttttgattcctaagaaatgtatgataatagaaacctgatagaacatctgaaattcattattcatttagaaaggcattgtacaatattaaaacaggatatccttagaatatccaaaagccaactgcaatacttgcaaagttggtgaaactcttttccgtattttccaaaatgtgtttagcatggcacaggagcaagtactaggttgttcagaaggttaaattgaacttttaaaaggttaaatgcaaacacaagatagccttccaacagccatctcaagaacaattattccacatgcaaaatgaggtacttgtgcagttatactcacagtagatacagtaattctcttaggtgaaagctggaatggagagcctatcaagacttggatagcttcaaccaaagcagtatagttgtttaatggctcccccattccctgcatataaagcagaactataaggtaaaactcctctgcaaggtaccaataagcaattcttaaaaacacaaattcaaaattgttatctgctaatttctgtcaaatggaatggcatgactatagaactgggagaacagttcattaataagaacaatttaaactcacaaatatgcaccaaaacaagctgatgtaccatgcattcatgcagtgtggtggttttctaatttctcagatgggaagccatctaagcatctaacccatgtaatggaatacaatacatatcctttctaccttaatgaagtaaagtgggaaaactcacacagcaagcccgtttttcctatggaagacataaaatctagcaaaaacagtacagaataaatatatatatacataggcaatacttcataagcatagcatggcttgccttgccatggcctgtatgaaatccagtgggcagtacaaataaaaccaagcaaacaactgaatgaacagtgtgaggccactaggtctggatgatgaaaacatgatggcactcattgttgcctttttgcacatccagtggactgtgcacgatttccttttgaaaagaaaattcaggcaaattccaacagcttgaaattttatattaccatgaaaacaacattccgaatctgagaataacgggatgcatgaaccaactgctccacaatttctcctgaagacagattgcttttgaagcccatcgttcctgtagcacagaatctacagcccatcttgcatcctacctgtgttaattttagatgcaaggtcagtgtctatcaagtaagccaccagcttcccaaggataacttacgttgtcacaaatatagttgcccacaggacgacaggtcatcagaagaaatattggcaatacatgaagacattaaagaatgattttcacaaaacaacttgccacccaatgtgcaaggcagatatatctacctgtgaggagacacagagggttgagcgcacgccaccaggccgaggcttcccgtcatacttccccaatcgcgtgtcataccgcatgatcactgcttctacagattccccattctaggtcatgaaattgaagaggaataagttgatattagcagaaaaggatcaacgaaaaaaaaatcagacaacagcagtaacaagacaacaaccaaacggaagggcaactgacagttgacaacttgacatgcatttacatgtttgttatcagacaaaagagtaaccaagttcaagtcaaactggagctgcaaaatatactcagagtttaatttatggttggattaaaatttgaaaataacctacctaatacaggacacgaactcattaggtcataacccttacattgaatcttccaagctttgcatcgagagcgcaatgataacctaggaaactataaatggcttcccaagggagagataaaagtgaaaacacatgctagaccaaatccttcgtttctaatgtacagcttacttgagatactcatttaaattcagtccctaaaagagtggcgtgccaattgtgcaagtatgcgtgaggccttctgttcatatccacatgcattcaaatggatttaaaatcaatagagcggacgtttcggaaatacccagagcaaactgcccacatacatcgatgctattaggtgataagtgctagcaggttaacagcggtaaaaaaattacaaaccctaaaacatcttgcagacttctcctgatcccataatcaccattagtactgcatgttcaaaccaccgaaatgtgcaatctacaaaatcccccaagtttgagcatacagcacgaaagtggcacaatctaattcaattcaccttgagtcggataaggagcttggtagtggtgcggtccttggactccgcggcggtggtgagcgtcgacgtggtcggctggaacttctgccgaaggagcgcgtacgcggccgccgggagcgacgggacggcgtccaggtcgccgcacctggggttctgcaacacatacctgcacgcgaagaggaaatcaccccttcagaccaagacgaggtttctatctctcggatgacaaaaaaaaatcgagaggcacagagacggcgagcgcgtagggttcgaggggggcggcggaagggcgcgtacttccagatgagagggatgaagtgaggggagatgccggccgccgcgaactccgcgcggatgtaggcggcgtcgaacacggagcggcgcggcggaggcggcggcggcgacgacgaagaagacgacgacgacgacgccattgggattcgggaggagtggagtggggggaggggatgcggcgggggggttggaacttggaaggctggggcggacgatgcgctgcctccagcagcgtgggttttgggggtttcttgcagttggaaatgcttcgaaatgaaatgctgcccagtaataatatgggctgccaactgaacagctgttgatagttgataagagataaaataaaaaagataaaagataagagtagcggactacagatttatagccagctacagcacagactctaaaacacaatatgtatatgataagtgggataatatattttttttgcggggaaagtaggataatatattaatagtgtagtatgtatttgtagataattattatatgaattgactataatttagagttagtcgttatctatactattaaatttgctcttagtgaagcggagaattaaaaacctgaatataagaagcagtgtaatatataaaaaaaagtatcgactgattgctacatttgcagcgtaaattataatttatttcttcattttattatatttgttgcgttcaactttaatttttttttatcaattaattatatatttgtgcattataatgggccatacaattgaaaataggttaacgcctgaaacatggataaagcataaagcggagtttttttttctgaattgctaaccacttttccttttctttttctttaccgaattttctttttttaggagcagagcaatagctgcttctcttttctcttttcttgtgcgctgcgcgtgaggaagatggagtgggaaggaggacgactattcttctatgttatgagacaaaacacattcaactttaaaaatcacaaatatttaaatataccatgtaatcgaaagatgtgttattgtgggatagatatattcatattaaccaatgctgacaaatatttagaaacatttcctaaaagagacacatgttttgtattacaaaattttaagtattacaactctcaatatcgcatgttaatttatcagccactaaaatttaaattatacaacttaatttatacaattgagtttaagtagttttatttgtcggtctatttttgtgcattgggttttaaactacaaataatatatagagtgaattgcacccacggtacaacaacttagcaggtgggtgcgatatagtgtaagaacttgagaattaaacgtccgagtacaacaacttgacaagtagttgtgttctactacaagaacataacattttttttgagaatttaacaatttattattttggtgcatcaacttggtaagtatatgctagatgagtttttttttacgatgtcaatataccattagatagtaatcttatggatattaccttataatattaaaattaatttttatgaattatattgcacatagtagcacaatttatatccaattacctttaagattttttttttgttttcttcaccttctcaaatatcaatcgaaatataataatttctacatccagtttaattattttaaaatatgataacttgttttaaaatatataacaattaccccattaattattttaactttttttgtttacatttctacaacttatcatatctaccaatcagagttacttgttgggttagtatagaggtgcatgtaaccaatgtgaatccttttgatcatggtggcattttccattcaaatgaacatcgaagctatttgtatgacaagttgaaagccacctttcgctgaagagataagctaatgttttgtataccaaccaaacacactaaagataaagattaaatgtttacgtaaaacgatgtggtattaatatatgattaatttagttttaattattacaaatttaaaaaacagatcaatttaatattttagagcaacttttatatagaaagttttcacacgaaaccgtttagtattcaaaattttatccaacttttgttggagaaaagaacatacctaacacgttgcaaagagaaagaaatggcgaatatgcatatgtatatacgtgggcgcatgtaccatttcaatcgcccagattgcttcaaagtccataaatgatagagagatatctatgtcagactcacagggcatatgtaactaactctatggattttactttttggctcaacaccctgctctcgacgtttgctcgggacgggaggctatgaaatagttgaaagcagatgcaacattaaagaaagtaaatccagtagccttaagtcataccgaacactatgtcctaatagtaagggatttctttcaacccggtggtaagccggtggtacccggagaaaacgttgcccgaaggaagggactaaacccatctgttcaagtagtagccaagtagtaccgaaggagtatctccgagttaaggagtaccaaatacgagaatttccaccttgttgaagatatggtggtgctacccgaagacttaaatgaatagccatcgctgttaagaacaaccgagatccaatgagaatttgcgatcgagctttaagcagtgttttagatgaaaatgaggtactattgagagaattgtcgagcttggctgatcataacactcccaaaagtagtggaaatgacactaaccctagcccgaaggaaccgtagaaaaataaactacgataagtatcgagagtagaagtcgagaacaactgtgtggagtagaagctgggatagaaagggttggaattctcagcaatcagtggttgatctgatcagtaaacttttggtgagttcattggtatcgggtggtccatttcatcctctttcggcaaaggaagttggactttagttagctaaaaaaacaataccagcagcctgtctgtgccctttgagtctatagccgccaaatctaaagattccttaagttgtcgtacggcttctttttcttcttttgtcaatgatcggtgacaatgaatgctatgaatgttcgcttccactaatgtcgtctaagaattgtgaggtgcccatagcttcccggaaagaagaagagtcattgtcgtttcctgaccgatatgaatgcacatatttaccctcgcctcggggaataccaccagtagagtctgcagaaggtgtcgtttaggagagatgctgggctctagatatgcgagggagatacccaccctcggtcatgacctgagttgaagaaggaatctattttcttggaagcaacaaaagaactccg

SEQ ID NO: 58264 - DNA, 6278 bp, Oryza sativa
tcaccgaccggcttgccttcgccgccgccgactggtgtttccgcctgcacggctggcctttatgccgccattgttgggcgtctacgtcttcaccgaccggcttgccttcgccgccgccgactggtgcttccgcctgcacggctggcctattatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccagccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcatggctggcctttatgccgccgttgttgggcgtctacgtcttcaccgactggcttgccttcgccgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaagaaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtccgcggctagggtttcggtggaccgggcgcacgggcggcggttcacgcgaacggacggccgagatcgaaccgatccaagatggacggccgagatcgatcgggtccacggcggctcacggcagacggggacgatgacgtcagcgatgacgtcaccaccggcggcggcggctcggcggctcgggctcgcatgctcgccggcgaacgacggcgcggcgacgcgaacggagagcaccaggacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacggcgacgacttggcgaacccgatggtggcgacggcgaccgacgacgacgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttaaataggtgcaaggaggcggcggcgaaggcccacggcgaccggcgacgagaaggaaacttcgggttggagggagaaaagaggaatccgattcaaactcgaatccaccggtttccaaagaaaattagccgatgtttccaaaagagaaaaggaagaggagatcgagaggatcatttgccctcaaacaattcggccggagaaggaaagacgcggccgaatttggaaggaacggcggcggcttgcgctagggtttcggccggcggcggcggcgcgaagacgaaggatctgacaagcgggccccacctgtcagcgacagcgagagagaggagagagcggcagcgacctgggccggactgggccgagggaaagagagagagagggttttgggccggctttcggcccaaagccaaagaagacttttaaaacctttttcaatttaaattatttcttaaatgtaattccatttactaaaaatacttccttagctcaaataaatcccagaaaaatctaggaattatagaattaagcaaagtatttaatgaaattttatctggcccctttttatattgagatttagcaaattaaaattagatcttctcttttaagcttttaaaatcatttctaataattccttttaaacaacaatttataatttaaggatttttaaacaagaaaagctcttaacaattataattagatcattaatgatcaaataattactgaactgttctttgtattatttaagaattgagctctgaaaaatccgagaaaatttcagagagttgacttaaccatggagaatttaacaaaaattaaatccatccatgctttagatttaagaaattttatttcccacattttacttcacttgtaaattaaagaacatttaatataaattctattaataatttattaaataatttataaatcctgaaacgaaaatcaggatgtgacaaactaccccccttacaaagaatctcgtcccgagattcggaacggctagaaagaaaaagggataggtaaactgcagtctatcttattccataactccgataattattataaggctttgaagaaaactactgctgccttgaaactggtggctgagttgtaacacttgaagacacaactcttgaagacgcaactggcactgcattggctcctgtgacaacaatgttgttgacctgaccttgcagctgctgatgcttcggcttcggacactctcttgcaaagtggcctggcttgtaacagttgaaacatacctgctgctcccttccactactgttattcacttgagactgatcctgctgaactggcaccagctgattagcctgctcgatgttaagttcatcattagtctctaatttgatctcaccaccgatgttcaacggttgcgactgtccttgaccagcggaaaaaggttcaccaatttggagtggcttgatacactgcctctggctactaccttgtgcctcctggaatacagtcattctccttttacggttatccatcctgttcttcttgtcttcaagtcgaattgctttgtcaaccaactcctgaaaatcctcatagtcatgagagatcaacataactgatagctcatcctttaagccttccaaaaacttctcctgcctttcctcgtcagtacgcacatcttctggagcatagcgagctagacgattgaactcatgaagatattccatcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtgcactggagcagttccaacttcttctcaatagcgtgcagccaatcgcctgcttccactgggttggtagtgctagaaaaggtaggtggcctcacacgaagaaaatcagttaacttgttctgcggcggtggagcattgtagttcccttggttgagctggttctgcatctgctgtatcatcatgttcattaactgagtctgttgagccagaacttgagcaagagttgggttcccttcattattattgtttccacttccattagcacgagtgttcaccatctattgcagataggaggagataggaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaagcaagcaacaagcgttctaccctactaactattcttcaaagacactttggcggcataggttctaaggtaggatccaaacttcattccatcttgaccacttggcacttcggttcttcctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacacatcatgttttcggaaaattagtccttaaggtttgaccatttggcttatcctacagtcgagatggctctgataccaacttgtcacgcccggaaattcactagtaatttccgaacttatttgtgcataaaatcctcgtccaggaatcagccgaggtacacaaattgacaatttaatatacagattcatcaaattaactaaaacgataaatacttacttatgaggcacttagtcctcaccaagaagaaaattgcagcggaaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggatggcataatatcggctcatttgcaaaagcagcatttagcaaaatatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaatgtttctaagcagggctaagcaatcacatctaatatctagctgaaccaatatataaagctcaactagtcaaattataatgacccaaggtatcaaggattaaagtaatcaatgcaaacaggccataacaaaggaataggttcacaccacccagtgacattcgaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaaactatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgag

SEQ ID NO: 58265 - DNA, 13373 bp, Oryza sativa
cggctttcggcccaaagccaaagaagacttttaaaacctttttcaatttaaattatttcttaaatgtaattccatttactaaaaatacttccttagctcaaataaatcccagaaaaatctaggaattatagaattaagcaaagtatttaatgaaattttatctggcccctttttatattgagatttagcaaattaaaattagatcttctcttttaagcttttaaaatcatttctaataattccttttaaacaacaatttataatttaaggatttttaaacaagaaaagctcttaacaattataattagatcattaatgatcaaataattactgaactgttctttgtattatttaagaattgagctctgaaaaatccgagaaaatttcagagagttgacttaaccatggagaatttaacaaaaattaaatccatccatgctttagatttaagaaattttatttcccacattttacttcacttgtaaattaaagaacatttaatataaattctattaataatttattaaataatttataaatcctgaaacgaaaatcaggatgtgacataaacataggccattttaggcgtgcacaaatcaaactccaaccaccttgatcggtaagtgagcaagcttctcgtccttgccttaccaggaacccggtttgtccgaccccgccccggcgttcccaactattggcatgcgaggtttccctgaaccgtctagttacttagccagggtgtcccattccaccttgtggttgcactttggttatgttcgatgagtttcccataggaatcggtccttatatgcgaatacgggacagtgccacataggcacaacccccgcatcgcgacttttcacaattcattttattttcaaacacaccgacaccacatgtcgggttttgaaggcttcacaaacccatttcccaagttttcgacaagcaacggtgtatgtgggatatttgggatacgcgctcagagagcacgaataccaaggtaccacaagggtggagcgacaaggaatcagggtagtacaacctacagaaattagtgcgactactgggtaggtccgtcggtttagcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccacaactatacgcaaacaatcgaaaacctaaacaaaggaccaaaagaaagatcctatttagactaattagtagtgccattaaatagatctcaattttacgggattactggaggttgagcggagtcaatcggatgagcggttgggaagatatggattttctaaggtttaaggattttctaatcaaaggagaaaggatttaataatttattaaacccctttctggaaagagaattgaaggagggatgtaaactagacttgtttcggtggcattggcgcggcccaagggtcgaaggaggctcggccaagccattgggccgacgcgggcgcaagcaggcggcccattagggcgcgcgggagggagagggggcggtccggtggaccgagcccaccacgcggggtcccgggtggggcccatatgtcggcgagacggtgcacggtggaagcggcgcacgcggggcgggcgctagggttttgggtgcaccggatggatcgaggcgcggcgggcccacgtgcagccgcatggcacaccgtggtccgcgcgcacggagggggaaacggaagggaggggccgaccgggtctgttgactcggtcgtgccgaggtggcgccgacgtggcggcagccacgcgggtcggcggaaggacgaagacgaggccggccgggatggacggcggacggcggcggcgttcgcaggagcaaggcgcgacctcaatggaaaaaggaagcacaccgggggaaggggagagacgagacgaagcgagccgacggctcggattcgccggaggatggccggaatccggcggattgtggcggcggcaatcgctggcgagcaaaggggggaatcacgacgagacgatgagggttcgattcaaagggggtggagcatctccggggttcaaggaatccgtttccggtgtcggatggggcggagaatcactgaggagggctggcgacgagcagcggccttcgggagcggacgacaatggcggcgaggctgtgccgggcggcgacggcgctagggaatggtttggggaggtcctagggagctcaaggacggtggtggcgcgaggtattggcgagagggcccacggcggctcacaggcgggcgcggcggcggcgaagcagagcaacggcggggcggcatgtttaaggggacgagcgagcaaccgaatggctcggggcttatccaagatgatgcagatggcgagaatttgggcgaggagctcaccggcgtgcgggaacggtatcggcggcgatttggggatggaaaggggtggaaggccgatggcggcacgcgaccgagcggcggcgcacggcggatgacgccgaggcgagtgcgccggggaagaagagagggagaggtggcgcccggagctcctcgtcacgcgttcacgctcgcaccggctcctccggtgctcggcgacggacgacgacgacgagagcgggacaagcggcaacaaggcggcgatggtggttcggtggtaatggcgctacagcggtggagactgaagcggggaaattgagaggagggtctcggctttataggcgaggaggagaggtcggtttggaggagggaaaccgacattggcagtcaaggggtgcaagggcgacgagctggcggtcgtcgacgcgtgcagccaaggcggcggcaggtgatgacgccggcggtgtcgggcaaaaggaaaaagaaggaggaaaggggcttggtcccttgccaaaacgagaaaaggaggagggagagtgaggaggaggaggagagggagggcagctgcttctcccactcttggacgggtgcggcgtggagtggcgggggccatggatgacgtcgacgatgacggcggcggtcggtttggcatggagcgggggcaaggcggcagcgcgtggcgtcggcggcgcaagggctgatggcggcggcgaccggccggtcggccacctcgcgagcgcgcgggggaatgggcgaaggcggtggaggttttgggcggcgacggcgggaagcggtgtcggcgcgagagagagaaagagagagagagagaaacagcgagagcgagagagagacagagagagcgagcgacggctctctctctctctcggctcacatgcgtgcaacgcacgtgcgagggggggggagatgatgggctgggaggggagatgggccgggggaggagaatcggcccatccaaaatcacagggaggtaaggtagacttttacagagaaaactgatttggatagaattggggagatttagggtttggattcgaattcaaatttgatattcgaactcgagggtttagggatgtatcaaggggaattcaaggagaagtcatgggaaagatttaaaaggaatacttgggtatttgttctcgggaacatagggtggggtcaaggaaaggattcgaggcgggatttgaataattctggattcgtagaagtatttggcgaggattcaaaggaagggattgactttcggatttaggtttcggaaacttgaattggaagaggagatttgaggcggaggattttgatttcgatgagagggaacaacgggattaaattgagatccttggcacaacttagactcgcacacaaagaacgaaaattttcgcaattaggattttgccgaattagtttttaacgcctcacgaaaagcggagcgttacagctccgggagcatggcgtcctgaagagcctgctggccgacgacgacgaagcggcccggttcttcagccgcatcggcgaaggctgcgccatcgactacgaccgccaggctttcgccgacctgtacgaggacttgcgccagtactgcaactcgcacttctactaccgctgcaggctggcgctattcgacctccggcggaactacttggggagtccgtggaagaccatctccctcgtggccgccgcctcatcctcttcctcaccgctacgcaaacttacttcaccgtgtttcctgccaaaaattgacagccatgagatgatgtttaagtgacgcaccaatttccccaaatcgatcgggccttcactttgtccatgcttttccagccagaaaagaaaacaatgcaaaagtaatatgatgcacgagactgctagctcctcatttcgttttatctccaggataaaataaaaacccatttcacataggagtatgaaactatcacgtacatactcaaatgttcgcacttttctttcttttttcttttttacatgaccaaaacattcacaataactggggtgaaaacgatcggaaacggtaggaaccggtagtatgtctttgaaaacgatgctcgatcagccggcaattaaccatatttatcatttaaactactcagtatcgatattaatatgatgcagaaagaaattagaaaaaacaaaatttaaaaatagcaaaaaagggtacggtcagaaacggtaccccttaaacggaaatggcgcccgatcgatcggaattttttccgtgaccgttttcacccctaacaataaccacaggagatggttattcctgtcttccaaacccaaaaaggaacaagactgaaaaatgcaaaacaatacacagttgtcttacatgctcggtcctcggatggccaagtagtccctcagcgcataaacttgaaatacaggattactagaccaacacaagtagtgctatgatgaaagctatgatccacttgttcctgtccatcctcctcagtcctcaccatggcccccatgatccttctacgtactcttcccgatgttgtcatccacgttatccaactgcaatgtcaagaaagacatgaatggcaaggtaaaaacaaggaggatacactcaggcctaaggccatgtacagtaatcaaacatgatttatttattttttttaatttggcgctttcattctggctccaggaagacaaggaaacatggtttaactgctgaacaacataatgctactgtgatctactccctccgtttcacaatgtaagtcattctagcattttccacattcatattgatgttaataaatctagacatatatatctatctagattcattatcatcaatacgaatatggaaaatgttagaatgacttacattgtgaaacgaaggaagtatatcatattgccgacttgctggttatataccatagcttatctaagttgctataagaaagaccttccaaaccgttgcctcacttctttaattctaccacagaagttatccccgttgaggcaccagtaatggctgtaatgtaagcgaggaatggaatagcccaactccccaaggcaaagcataagtgactatgtatacaaggacttgatgatttaactgcgaactgataattttctatctaccaaatcaaatagaaacatcaaatgaaaataaattgcaaaaataagtggaaggtgtccatgacgccatgaattggtacgtcagtaaaatacaggaaaagcatataaccgcaaggagcctatatataggagcaggtaagcatcaagcacgtacaatatctaatttatataggtgcagaaaaggcttataatacataaagagttcataaaaactcttgtacatgtatacatatttacctgtcaattaagactatatataatgaaaactatcatatccaatacagaacagatttatgtaggcatgatttcctttaataaattgcatacaaactgtatatcatctacctatctattatattattatattataaagataggtcgaaaaggattcgttttggaagccgagaaattattagattttggtggaccaaaataaaacagtgcgattgataatagagatatagatgagataattccttatataccactgaaaattggtcggttcctgtgtatgccactcaaaattggctcttcctctatatgccactggctcaaatttatatacccactcatgccactcccgtatgtttactgtgcattgattgttaactatggagtacaaagacgtatttgccctttcgagttttagacatgtatatgtgccaagtgctacatgtatacataacatgtacatggtcggcgcagcgggcgcggccggcagccgatggaggaggagcgcagcggagaggagggtcggcgcgatgagcggtggttggctgccagcgggggaggagcgcggcggagagaagggccggtgcgacgggcggcggttggtggccggcgagggaggagtgtggcggagaggagggccggcgcgacggtcgacggttggcgacggagaggagctaggcatcgggggcggcagcgtcagggaggaggtcacgatctacgagctgcgaccccccatccccttctcccttatccctctccttccccagccacgggcggcgagctgcgaccccatcccccatatccttctcccttctcccttctccctccctagccgtggcagaagatcgcggagcgtgtcgagaggaagaccggcgagctgcaaccccatcccccatcccccatccccttctcccctctcccttcctagccgtggccagcggtggtgaatacaacaatgacgccgccgccacagcctcgccctatcatgcccgtcggcgcacacttctcctcctcgcccgggtagtgctggctggcccctcgtgatgaacggctggtggcttccactccaaccggtagtgccgccgcagccaaggccacctcccaccgctggagtggcacccttcccaacgtcgtcgatggtgccccttcctctgcctgatgcaagaactattgaatatatgaatgattgcaggcacataatttttagccaaaggttatttcggtcatttatgccaaaaataaaactgacatgtgactagatcctaacgtcaatcaatgcacagtaaagagacggaagtggcatgatagagtggacaaatttgagccagtggcatgtagagaaagagtcaatttttagtagcatataagtgaactggccaattttcagtggcatataaggaattctaattcaatcaagtactatttattattgtatataaaatatagttacatatatgaaatagaaattaatagttgtataacaaataaaatttaattagaatatgcaaaattgtgcgggaaaatttccaagttgggatatcagttagtaaataaatgggatatgcaaaataaaaatggttagctcagacagggtcacagggaataactaatagtaagtagttacttacatatcattagcatgtatcagacgtcttgacctgctccgtcttggagtagcccacatgcacaggccatcctgttgaccgattccatcacccaaagccacacaaatgcacttcactgaagcttaggagaaacttccctcgaggggatgttctctcgtttgcttaaaaaccatttaaacggttatgaaaaattctggaaaaatttaacaatattcatacaacacatatatacaactctacaaaatcttaagtccaaactcaactcacacgtcgagatataaaaaagacaaattcagcatatgaatagtagcgtactgtttatatctaaatttgtcttttttgtttctcgatgtgtagatcgaatttgaatttgaattttggtggactagtaggtattattatactttacattgttaatttttttttagattttttcataactatttgcatcaaatttgaaagaaaaatgtatacgagggggatatcccctcgagagattagaatccactcccggagcttagaccaaaccaaatgcagcacacacatatgcatatgcatgctacgatacccggtctactctagcttccatgcatcacccgagccaccatgcacttgaagccttgaaccatagtgctcatgtgcattctttcctttcagttttcttcgccaataccaaggcttgcacatacaactcgtcaagctcgttacaaagacctctcacaagttgtcctccacctctcatccatataagaaccgaaaacagaatcggctaagacagatttggcagctagaggcgtaggcggcggtggtggctcaatcctattggatttgagaaatatatcgagtttggttgccaattcgtgaatgtgttctcgtgttcattgtgaatcttggggtcactaacaaattctggtatcagagcctcttgttccaaaactctctcgatccggttataaaattctagagaaggattgtgattgttcttcggatcaaatcccgcggaaaggcaacttgccttcttttggttgactagatttgcagtatgagcgagttggttaattctagagcgaccacgctatatcaccgagcaagcggcgcagatcacggtgcaggaagggaaggttgctttgcttctcaaaaccatggaggagtatgagaataggagggttgaagcggaagagagggcgcatgtggatttggtggacattaagaaggtgcttgaggtgaggctacccgtggtggagaagtggatgagtttggtctgcatatcaagcgctttagcagaaggttgaacaattggagaaaaacgtgtccaagcaagggagtgattcatttcagggtgatctgtcctcggcagcagcaaatccaatatcaccatggcttgcggggaagagagaaaacatgtttccttctcctgttcttgttcactttggtgggcattcagggtcggcggcaccagggccacggggcaggggcgcaggcgggaggtcggcgcggatggcggcgctcatggtggcacgcccggcgcagcggcgcgcactgcggcacgctcaggatggagaagaggtggaggggaggggggagggagtgctgtttgccgtcgtcgtggatctgggagctgcttcgttcacatcctcatgctcgacctcatcatctcctatggcgtcttcggccagaggaacgccgacttcgaggtggccgccgtggctgccaccaagaccgtcgacgacgagtcggtggagtccttcgtcagtcgtcacccagatgatgcacagccctttggtctttgaggagagagtgatggcggcagtgaagctaacgccgccggcaaggagggcgtccaggcgtggagctctctgtacttcccagacgatcccctcatcgtcgtcgccgatgtcgtcccccacgcctcccccgcactgccgctgtcccccacacctcccccatgcctcctcacgggccatgtgcgccgaccgccagcccacccttgcgcgccgctgcccgccttcgcctccgctgccagccgcccgcacgacctccgcgtccgccgccggccgcccgcgagacctccgcctgcatcctcggtggcgccgtggcctgtgctgctgaggagaaaatttacatttagccattctcagggtggggtttcgccagaatgccatcgccaaatgtggcttcattataatgccatcttcaaacgaccccatcttgccatactgccatttcaaccaattttgattatttgcaaatattttccactgttttgcttatttggtttgacccaaatgcgcttgcctcagccgtggggcctacttgccaggagcgtcttccacctccgtccgccaccatccttccctctctccggtgaactcatgccccaaattgatctccctcctcagttgctctcgccccaaattaaatgcaaaaatcagttcctctcgtcctcctcatcaattcccccaacaaatcccactcaaatcggcttaactccgtggtggattttgaagtccctcttcaatggcgagctccaccatagccagcgtcgatctctctccccgacgaggttggagcgggcaagcggctggacgccgtggagtggagctggctgcggctgcacgcacgagcaggttgcctcgacgaggagctccgccgcgagtcgctgcccacgtcgaggagctcatcggagaagggagtgacgccgtggcgcgcggtcaggtcgagcgcttggtgcgccacgccgccaagccgaaccgtcgtcctcgtccacgccgacgccttccccgtccccagtcgcgccgccgtgccgcctttcccgttcccggtcaccgtcgccaccgccggcaacctacgcgcgaacccggtgagctacgccgtcgagctggtgagggcgccgaagggcggcgtcggtgccatccccggcgtggccagctttctcatcccgtaccggttcggcgacggtcccgagctgcgccggcgccgcccaccatctgcaacgaagagagcaagaggtaggagaagagagatgagataggatccaagggtattttggtcatctcaacaagaaaaatcattaaactgagaagaaatggatgaaatggcattttaacgaaaccacttttgggagtgtcgttccagcgaaaccccgttttgacagtggcaaaatgtcaattttctcgctgctgaggggagggagaagagagagagatagaggtggggaactgataggtagggcccaccgacttttttattaaaagaattgctaactgaattatcccgtaggaccaaaaccagcgcggattgagacgggggattagttgtctttgtatagttggggatgaaaaatgtccggttttgtggtttatggggtaattcgtattttttttataaaaaaaatggtatggctaactatcgcagtgtaatactgttatatcggtcggctggtcgctgcatgactttagatttgcaacggcgtccggcacgaaacttgcgagaaagttaattacatctagtgacgctcacctcacctgaaaacctggaaagacaacgtgtgtcgttgcttaaattttctgtttgatcaactcgagaaatgcatgctcataaggatgtcaaccatcgaggacgaacgtggttagatggatcatgactgtgcaattgtgcatgttgtacatttctattctccaagttgcatgcatgacttattgggtcgttctttttaccccgtaagggtctctttgatttgtatgaaactagtgtggtggtccacgcagattacgcggctagcattattatattttctctcatataataacatatatgttttctcaatgtaatattcaaatatattaaaatgacaacataattttaattttgtactaactttacgaaactactaatgtgtaatattcatattgtattttatatacgtgttagttattaattatttttaatatcaaattttagttatttgtaaattatattcctatatggactttagactcgtctttcaatattttttatttaattccaaattttcgttatctgtaaattgtatttctaaatagactctacgctcttcttccaatattatttatttttaattctgaatttttattatttctaattgtatttctatgtggactctaaactcatctttcaatattctttaattttgaattttgaattttagttatttgtaaattgtaatatttttatatgaactgtaaactttacttttaattttattatgtttattctgaattttagttagttttaaattcctatatggactctatactctacttctaatattctttatttttaattccgaatttctattatttcttaattgtatttctatatggactctatactccacttctaatattccttatttttaatttccaatttttatatgaactccaactctacttttaattttattatgtttattccgaattttagttagttttaaattcctatatggactctatactctacttctaatatctactattataaaaattgaaaatgtttttgccggtattttggtaagttatccatgtatgagtcggttttaagttcgtttgcttttagaaatacatatccgtatttgagttggtttgtaagattgttcacttttggtaatacagaagaaataatataagaaatctgtttaaaaaaactcgcatgctaacatgagacgatcggacttctaactgcagccgattttctaaaaatatatatatccaagcgaactcccacggtgaatttcatcttaactaaaccatataacaataataagataaaaataggcttcacccgttgcaacgcacatgcatttttctagaattccttatttttaatactgaattcctattatttcttaattgtatttctaaggactctatactctccttctaatatttcttatttttaattctgaatctattaacttattaaaggaatagaaaaaggagcctccacgttcgctctcatggcctagaaattctcatattaatcggagaaaaaaaacagagtccatatagaaatacaatttagaaatagttgaaattcggagaaaatataatgatgctagccgcgcaatccatgctagtttctattatttcttaattgtatttctatatggactctctacttctaatattacttatttttaattccgaatttctattatttcttaattatatttctatatagactctagtctcctcttccattattccttatttttaattctgaattcctttttttttctgaattgtatttctatatggactctatactctacttctaatattccttgtttttaatttcgaatttctattatttcttaattatatttctatatggactctatagtctgcttctaatattccttatttttaattccaaatttctattatttcttaattgtatttctaaatgtactctagtcttctcttctaatattccttattttttaattccgaatttctattatttcttcattgtatttctatatggactctatactctacttctaatattccttgtttttaatttcgaatttctattattttttaattgtatttctatatggactctatactctacttctaatatttcttatttttaattctgaatttctattatttcttaattgtatttctgcatggactctagtctcatcttccaatatttcttatttttaattccaaatttcaactatttctaaattgtatttctatgtggactctatttttctttttctccgattaatatgagaatttctagaccgtgagagcgaacgtgaaggctccttttctattcctttaataagttaatagatttggaggatttcaattctattgaaaaaatttctatggaatgagtaatcctattgagatttggagaaaagttagcaggaggt

SEQ ID NO: 58266 - DNA, 6970 bp, Oryza sativa
tttttctcccctcttctgcaggaggcggacgagctgatcgtggggctccccgtctccgccgacgggagcgagacgccgcagtccaacaaggttcggagcgtcgtcgggaggctcgccgtccaagcggccgacaggtgcgttgcattgcgtgtggctgcaaagctgcagactgcactgcactgttcaatgttcagtcagtcagtgtggttgccctgcatcaatatattagaagaaaaagagtttttgttacacaacgcaattagccggaccggcttatgctaggggaagggagaaaaggcaaaataaaaactgaaactatgaaaagacttacgccggcaaaatgcaactccgaaaggttgccctgcaatgtgcaatgttcagtgtcgtgttcataatcatgcgtctatctgaaaatgtgcaggggattgcgggtgtatctgcaggatgagtacgggacaacgatcgacgccctcgagttcatgatctccaggtaaatcatggctacctgaatcctcgctgtcgtcgtcctaacatgttctgtaaatttcagtactagaaagcattgttcagagtctggaactttgtttttcaggggagtcaagaggtctgcacgtgatgtcaaatctgatgcgtattctgccatggtatttctatgtttcggaatgcttcttcagacttctctccttgtggcagtttctacctgaacttgaccagttttactttggttgtagatgattttggagagatatttctcgtcatcaggtcaaggggctaagattgttcttcctaaacaaccacaactacagagcaaattgttagagaagtcaaggcaagatgctcaagtttaggaagccgtgtacgttctaatctctccaaccatagatagcagacttatcacaacagcgttcttgttgttctaccagctaacttcaattgcgtagtacagtattttatatagtcttgttcgccgtactcatatgattaaacgaagggaggatgacttgttgacattctgccaatttatcaaaattacaagtttcgatcaaaattcttcatttgctgtttcaaatcaaccagatgtaaatcgtgcaacttgcccgatgataaatctcgtggtcagttctgagtctggatttcgttgctagtagacttcttgttcagatacttgtatgtcacttaataataatagcattatggtttccaagtccaacaagattgtatatgcgtagttttcatagagaaggaatttgagagtaaactgctctaaaactcagctttggaaagaaagaaaaaggtaatgtacaacaatcccccgtcccattccatgtgctaaacacgcactttacccatttgagagtatgactgatctatctttactgtatctgcatcaatcatggttgctgcaggcatacattgctgctgacacaaagtagaatgcctgagccaaaatcgtcagaatgaatcaagaattagagaatgtgattctgtccaaatgaagatgcatctgaatctgtacaaattgaatcaaaacagcttgctgaattcggtttcctgggccggttcaccaagccgagggaagaacggttccctctcgagcatagtctgcaacgagtccatcaccctcaccagagacgcccacaagaacggcgcagaacaaaatgcgtacccgaagattgccagaaccctcacgataccaccatggtaccacgggaatgccatgacgaagaacatgccaataatagctaaccagggcgtgagcacagcaagcaatggaagcaagaaggcattgctcacgagcactcccaatgccaatgcaccaaacaggtacatggaccagcccatgaatgggtgaaccgtgcgtgggattataaagaacgggatggcatatgcaattagcatggccacgattgcagacatcttgatcagcccctgcaccatggcattttgcttctcgggccgccggttatagcacagttttgtcatcccaggctttgccaacctggtaatggttataatgactgcgtacatcaatatctccatcaggatcactggcatttcagcggcatacctgttgatgtgaacatgcaaaggttaagtgaacagtaaggatgaaagtggagtttagagtctgctcaagcacattttttcagttcagttcttgtctttactcacccaagatcatcccaccgttgcttgtgccaggaaaggcccagtggcaagattggccatgaccaccaataccaaggtttaaaccaaggggcgctggggaatgtgataacgctgttgggcccacaagggacatgccaatgcaacttgagatctgcattattccaccaaaagggtgtcaaagataatctttgagaggcaagagcaaaatgaaagtgagaaatgtataacagtagtactaacagtagtaggatgcatccatctgataaccaagaggaaggcgatatgtcccgttgagcttgctgccattctcaggagggtggaacattggtctatcaagcaagtctgggtagcagccgacaagaaacccttggtcagcaccatcagagttggcacggccaatctctaggtcatgaagcatgcctttgaagacatccatagaaggctgtaaatggaaaatgttgccgatgtcagattactgtaacaggaaatagtaccagcatcagattacttgtttgccactacatatgtgtgagcagaagatattttcaggtgtgacaacttaacactgattatttattaatgacatgctatttcatcgtagtacttccctaacggatactatattctaatgaatatggaaggaaaatatccagtctgtgacctgccaatggctaaaatccactgtacagattggcagaatacagctcatatttcatcaaaccctccaaatggccaatgcatgatcaatccagtggtagtggctcaactgtcatatgacccattaccaatccaatgccaccatcaacacagctgtaggtatggtcaaatttaagaaacacaccgtttttactctaatgaacactatgtaacctggcagaagcaacttattttaatcatcaaggcaacagaatctcaaccagcatactccttctgtcccaaagtaacccaacctaaaataagatgtgaccaaacctagtacaacgaatctggacaaacctcctatccagatttattgtattaggttagatcacatcctattctaggttgagttacagaacaggtggtacagactagaaaatactgtacaaagtacaggaattgcatcatcgtacctggagcacgaaaagaccagtgtggaagtagcaagggttgatgaaaacggcacagaactgtccacactggaagagctcatcggtcttctgaaggaagatgttatcggagtcgatcatgacgacgcgctcatagtcaaccagggtccacgcatagagcttgttcagcgtcagcttaaacctcctgttgatccctccaaggttgctctcataaggattcttcatattctccaccagcaccactctcatgccatcctcttccctcctgtttccattcacaataaaaaaggtgtcaagttccaaaaaaaaaagatcacatgaagatcttgtaataacaaaccacagcatggaaagttttgaacaagaaatgtgattgcaaccatctttgttcgcattgcatgttgtctgaaacgttttgactatgacaaagaagccattgattcgaagtttcgaacaaatcatttgggatttgaccgtccctgagaatatccatcggtgcaactgattcattttttcaaagaaaggaaagttgaccacattaattgaactagtactccttaccaaccaaggcaagcaaacagatagtcaaagttccaaagccagcgcaaccgtcccaaatcacaactatttttcatattggcatatatagcgactagccagaaagaacaagtaactaacggtaatgtaatcagacaagaacatcaccagttgaaaccgagcatatgcagtgcacatctcatatcgtcaaacacattgagaaaatccgatacactaaaatattaatcagataggaagcttccccttctgcaggtgggcccggccccctcccacgaaaccatctactagtattaaatcctagttgaaaaatacccgaaatgccctttccacgtcatcttcttcttcttccttgttcccaactccagaggaagaaaagctctctcaaaaacagaaacctccataggaagaaacgcggctttattgattaattaagaaactagcgtgcgctggcaatggcttagcgagggtaattacccccgcgtttcgacgattagcgatggtgaggtgagcatcggagaggcggagagagagactcacattgcgcggacccagtcggcggggacgtcggcggaggcgatgaggacgcggtcggcgtcggcgccgatcctggcgagggagcgcatcatgacgcgcacggcgacgtagaactcgtagtccctcggcgtccccatgtacatcatcgccgcgtacgcgtgccggtgcctcggccaccggccctgcgccgccgctgccacgactccactctccctcccttccaactcctccttcaccgccgccgtcgccgacaccgccatcaacgccgccacgacgacgaccaccaccccccaccgccggcacgcagccggcggccaccaccccatccccgtcgactccaccaccaccacgctagctagctgctgcctggacttggatcagacagagcaagggtagtagtagtagtagtagagatgcggctgatgcttctcgagttccttcaaaagcagaggagagaaaaaaaatggagaagagaggagacgaacgaggaggaggggaagcggccggcgcggcgtttcccttatttatgggtgtgctcgtggaggggtggggcccacacgtgcctgacaggtggggccggatcgggagtgggcccacccccgcagcgacggctgggtgcgcgtggccgtgtcacgcgcgcgcggatgagaaagagagagagagagagagagaaaaagaaggtgcagcaaacgctctgtgcgccgcgcggctcgtgaaaggaaagaggaaagacgaaggcgaagtaaagacgcgtgcggggattggacggctcggattgacccgttcgtcgcccccggccgacctcgtcgtcgtcaacacaaatgctacacacgcacaacggcacgagctctccccttttttatcagcgaatcagagatagagtgtttcttttagccaaaaaaaaagggaaaaaatacgaattactattttcttctccttttttgcggttaaaaaaaatgagccaattcagaacaaaaagaattgatgctttggtttggtacagagatgtgtgtgaaaatctttcgccagagatccgcatcatcagcatcggtgacggcatattaaatggcagcggcaagctaagcttcaattaatcaagctgcaaatggagtagtattaaagcttatgttacgcagagatttagccaggctgcaggcttagtgcacgtaaacctgggcttatgttattcggaaaattatttttctattcccatgacgtgtagacgagctgttcaacggctcaacctctccaaggctttgcttctcttcaggtacatctacgatcaagatatttaattttgttgctcaatgtcaaatttaaaggagagaatcgttctctttgtacgtcaccgtccggcagttgcataatctctaatagcgggcagggaatttaatcgtacaggaatcagttgcaaactctttgctgtttgctcttcaatcaatgtaccagccgcaaacaaaattgaaatattagaatttcaccattaaagttgattattgttatctttcatcatgctttatttcttacattgacctttagatcactaaaaacgtactccatccgggtttgtaatattttcattttagataaggatgaggtcaaactttagaatctttgattatgaatcattttttaaatatttatcttttaaatattgtaactatatgtatagattagtcttaaaaaataatttaataaaatcatatatttgttagcacttttatactccctctttccctaaatgtttgacgccgttaacttttttaaacttgtttgaccgttcatcttattcaaaaacttttatgaaatatgtaaaaattatatgtatacgtaaaattatatttaacaataaatcaaatgatatgaaagaattaataattactttttgaataagacgaacggtcaaatatttttaaaaaagtcaacggcgtcaaatattttatgatggagggagtacatattataaataaaataatgatcaaagttgtttttttgagaccgtactattgttcaaaacgacaagtattattaactcagagggaatatatatagaaattttatctttagattattttacttataatcaactgtaaacgacacaaatgacggcttttagataaggtagtatcggatatagtcagaggaatactttaatattttgggttgagctattaaaggtggcatctatcattgtaaagaaaaagcatatgcctcattggtctgatcctttgcttgcccctttccattagagcaagtttaatagtatagccaactgctagtttcaattcatctatagttaatttaatagcttatccatacaatagttatatactacactattaatacctggtcccatctgtcatacacatattgtattttggagtccgtactataactggctacaaatctgtagcccgctgctcttctctctccttatttatctctttaaaatatgtctgcagctggtctatagccagctattgtacctgctcttaattccaactgaaacgatccaattgaaacctcacacgtcaggattaattaaacccgtttctatcgtgtgctgatgttaactcgctccatgattcccctcccacccc

SEQ ID NO: 58267 - DNA, 5650 bp, Oryza sativa
cacttggaggaggacttagagccatggaagatcatcgaggacgtccaagtcaaggtggaggcccaaaccaagtcgacgtcgggtgcaattcggagtccaggaccagtctgcactaaaacgggtgcccaggtcgcatacatgctcggattggggcgttctttatatggatggaaagctaagaagatacctttccaatggttttggtcccacgtccaaattctttccgagtcaatgggaattgaccgaacaagttggcgtccagaatctgtcccagtgctgcgtcaccgtatttgggcctttggcccgtgtatcgtgttggaacccattagggttgcgtcgagaggggtttgcacgaccctaaactctatatatcagtacccgccaccatctttaggtttttgggttttgcttagattaatctgtcgagaacagtttcgcagctagatcggtttgtaagaccccaactcgtgagcttaatcattcatctgcaattttggttgttttctatctcgttcttgtttgtgttcttcgattggcaaacagggattagccttctcggcgaggtcatctgcgtttcgacacgggtgataaccagaggagacatggtgctgcgattgcggggctcaagagcgtgcgcgttcaagaagccggatcgatttgtgtcgctactccgcccaaatcgttgtttatcagaacctttcggaagatcgggaaccctagtgcacatcagtatgttatactagttctagagcacaacataaaacactattctggtgcagaatctggatcataattcaagaagggctacttacaaccttggaggagatactcaaaagaagcggtactatattaccaaatactaaaacaacacaaaatcaaatcatattagacaaggccactgcataatcctttgaatgtatgaatgaaaatttctttagcaaacagaatgttgtaaaaactactccaaatagctttaaacaaccaaagtaccaaaatagagtaaaactgttaatcaccaaatgacagaaatttcaccgcagataaaaatttctcactttcaattgaagaccagtggtaaactctatctggtgcgcatttccaaaacactagaaatttcttgtctagagatggtgcaatcaacatctcacacaaacagataccaaaacaagtgtaagttcaagaagaaattaatgattagtcgatagcacataaaaaggaacaagaaaaaacaaggaattgtaagaaaacggctagccatgtgaattatacaagaagatttcagaagccacaacaagcgttggtttgttttcataattattaagaagcctagagatcagtagttaatctgcaaggaaagcggtagttaatctgttatactagttccagctacacaacatggaatactactccaatatggaatcatgatcctcggcactttgatttgaaaagtggcatctgtaatctgtttactccttccgagaagctacacaacgagaagtatactagtactcctatacaacactaatactaaatactaaacacaaaatctattgacattgctttgcaagacagtaccgttgtacaatcctatccaaatcaaaacgcaaaaaagcttcctccacgaatatgagaaactaaataacgacttcaaacagcttaaaacaaccaaatcacaaaactacagaaaattcaccccaaatgtatgtttctacaactttcaagtaaagatcagaggcattttttgggtgggcgtcaaagtatcttgtttatctccaaaaccctagaaatccatgataccctatgaaactaagtacataagaatatcttatccctaactcaaaattaccgcttaacacatgattgaatggtccatatccttcagaaaactctaaaacacaagcacataattcacatgaaaatttgcaggctaaatccaataccgatgatttcaccgaactatagaatactcactttgccattcgctcaggaaacaccgtaaaatccacagatcctgaattgagagagagggcgaggggaggtagagcaccttccagagcgcgtcctaggcggtggaaaacccggaaccgaagaggaactcggatacctcggcgacgagcccctttctcgcatagcacgtgcctggaaacggcgtggtcgcggacgacgacgaaaccgcgcggccccactcgaggagagggaggagggagaacgcgccgccgaggaggtcaccgcacgccgtcgagctcgaccgacgcgatgtcacccccacaccttatgcggccgtccaccgacaggagaagcgccatgatccggtcgccgccgccgccgcctctggcactggcacaccgctcctcggtgggggaggcatgcaaggggcggaggcggccgtcgccgccgcagccgcgtggaggtggccatcgcggtggccgccgcgggctagggtttggttgatttgggattcgcccgatttgggggaagagacgaggcaagaagagattgagagaggaagcggaagggaagggattgcagtgcggagtgggacccacctgtaagcggcggaagcgcatggcacagggcgcgagttttgaatgctacggggggcaacgcggaatcccgttctagaagctaggaagcatatgggccgaaacctatctaaagggctaaagggaggtgttatttcggcccatagatatgttagttgaaagtttttgggattttggattgaatgaacttttttatagttcaatatgaatgtttgaggacgcaattgaaagtttcatatgatcttgagttaaaagttgtatgatttgattataaagttttgtagctttcaagttaaagtttcgaattttgaattgaaccttttgtaaattgtaattcaagatgaaagttttttaggctatggcgtgtatgatgtgagttgaaagttctgtgaaaatactactaaaagaaagaacaaaaaaaagtgtgcgctacgaggtgagtgtagctcaactgattaggtttcttgtgatggaaccagcctatcagagtatgcgaggtgtgcgtgtgtgcattcataggggtaagtgcgtgcgatttgtgggccctacgtttgtattgtgtttcaaaaaaagagtgcgcgctaaggtaacatgtgcattagtttgcaatctccgatatcatgaggccataatgaatagagtatataataaagtctttcttgtaggggtgtatttacattaagatggacaagagtaaaacaacagagaaaacatatgtatagagagaaaaaaaagaaaacaagctggagaagatcatgaaagtgccttctggaccatatataaaaaaaagattcaaaggatttagtattaaaccttagcactccactactcttctctatagaattctgagattccatacgtccactggagtattttagatatgccagcgacaacgacatgtcagttcatcatgatcacgcataaaagtagagtcagagtcaagagaaaaatgtcttaagttatcaattgttgaatgcctaatggaatctccacttcaagtaaccaagatcaagttaattagaccaagatgttaacataaactttgttttagtttacgatgtgcagagaccagaagttatcacttccatcgcgtcaaaaggaaattgaactggcctttcgaaaaataaatttgaacgtctcattcaggtgtgcgtgcggccgtgtaaagtccttgtccagcttgtgaacacatcatcgaaaaaaggaggaggaaaagaaccacgtcgcattcgaacgatggattttttacatcaaaatacaaaaacttgacatggaagctgatgtgtatgtcagtgtttctacctccttttttttcttctttttgttctttgttctaactagaaccaatgcagcaaagcttgtgtatatatccatcgccttcgcgtttttgatttgtaggtggggtggcaacgtttcattccattgcagaggtcagaggtggataaaggcacgccgctgttgacagtgctacctgggcccagtggcagtcgcacacccatggctctccattgcttgggcccacagagaacgcgagtgaaggctgatgccctagttttttggttgataaagtgatagccagggtttacaatcccgaccaaaaccagtcgaattctacgaattttcgatgtttcaacatggctcggtattaagtttcgattgtaatttcgaatgttaaatagtagatttgggttgtgtttagtttccttcaaacttccaaaaattctgtcacatcaaatgtttggacacatacatgtagcattaaatgtggacaaaaaaccaattgcacaatttacatgtaaattgcgagatgaatcttttgagcctaattacgccatgatttgacaatgtggtgctatagtaaacatttgctaatgacgaattaattaggcttaatagattcgtcttgcagtttacgggcggaatctgtaatttgttttgttattagtctacatttaatacttcaaatgtgtgtccgtatacttcaaaatttttacacctaaacaactaaacacggcattggtcaaaattcagtcgaaatttatcgaaaaccgtgataccgatggagctcgaaatttagtggtcaaccgataatgtaaaccctggtgatagctatgccaagatttacaagcaagctaataaatagcgttagcggccttttgtaggatcgagatgtcaactagagggggggggggtgaataggcgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcaatgtttagcaatcctagggtgatatgatctcaagtttgtctctagaaatgtaaattgcacaaatataaatgcgacaatcaaatgagactaggagacaagagatttttcaccgaggttcggaaactcgccggtttcctacttcctgttgaggcgagcccaactccaccactcaaccacgaagctaccgcacgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcagagaggtcaccgggcaactcctccacaagccgtctagaaggcggcaacttccaagagtaataagcaatgacccggcatggagatgatcaatcaagtgccacactagctctacaatggaagcaatgcacttgactcttggctagatcaaacctctaacacactagatggatgaacacaaagctcaagtgggtgtgagagaggtgcaaggggtgtatgcaattgaattgggtgccaagagagcccctttgctgctggagggggagtatttatactcccaccaaccaaaactagccgttgggggcgaaatcctccaactttgtgttctgccggtctgaccgggggtatgcggccggccagaccgtgctactctacaacggctagcgctgtcagagggccccatcgggctggc

SEQ ID NO: 58268 - DNA, 15892 bp, Oryza sativa
  unsure (1)..(15892): unsure at all n locations
tatgaatataagactgataacatgcaacctctgtaccaaaatgtaagaattcgtcacggccgaaagatcgatgcgccgatttggctcctagagacatagttgcaccactagttgtcgtcaacaatctcgtctaaccactgtgaagtgtgatgtctttttgtgctatggtctagccaactgttagtttcttccatgttaaattgctggtatgcatcccattggggaggcggcattccaagtgtgcgcaatcgcaaccacagccgatctaatagatattttaaaaaataataaaaaaggcaatatatttacatataacatatattgttttctcttgagaaatactcctatatagattcttgtgggggcaatgatgataaggaaatgcgagaacaatgtaagttgaaaccaaaatatattgtacatatataatgaaatatccactgcatatttggtatgtagctacatgtgtatacctagtatctgattagtgaagtacactatatagcaatgattttaatcagaaactatagagaaatgatttctgagaaagaaagacattgggtgtaattaagaaatcatattattgattgggaccttgtggggagccaaggcacagctgctagttcccctccatctgccactgtctgcaagctgatctagtatatatgtgcaacaaaccattggtcaaaaaaaaaagaaaaaaaagcgaaagcgattaattaaagttgaaacctaaatcgtcgtataacgaatggttgatatgatgtgtagtacatttgataaatctagtacaactatatgtatatcaatttatgtgatagtaactagctagctagtactgtaactgtaattaacaagagtgacacgaaaagatctatatatctcagatcgtacagttagctagatcaatgacgtcaattaactatatatataactagctgggttgtaactatagatagtagaagaactttcagctatatatccagacagtacggccactgcataatgagtagtgataaaatgccataatcttctccagcaggtgacaaaaaacgcatggctggcaccgatcgagagatcatgtcaaggctaaaaagctttagctcaacttggttcatggaatattcaggttcagacaaggcgagtcattgtcgcgtatcaaaaaccggagccctacacgatcaaaaccagcatcacggtggtcaccaccacgaagaatatgcatcagaacacaacagtacagtacagaagaagggagatagctagctaggttggaatggtcgaattagctagcaaagcaaattaacaagcaaatggcctgattaatcaagctcgtatccgatctcttttgccacccgtgaacccagataatccgcggctgatttgtcgcatgttatagctcgcttcctcgaactcgcttgatccgtgtggattactcggctcgatctgatcagctgtagtagtagcttaatttgttgactccatgctccatccatgcatgttcagacttgagaaattcttttctttttttcagtaaagttgttcagaagcaacaaaatgtgtgagaccgtccgtgtggctgtcaggctgtgctagctgctagctgatggtaggcagatcacggtatttctgaaatcaaatggtaattaaacatttaaacatatacgtgcacattgattgattgattgaacgtagattaattactaagcaggttcacatgcgtgcatgcttggccggcatgggtacccacgacgaacttaaaattatattatacaaacaatatgcaccgatcgatcgatgtcacctcctgtaatgcacatcatatcatcccgttgatctcacatgcatgctccttgattttttttttttgaggacagatcaaattgcattgcattgatccggcttttgggagaaagccaaaatgctccttgagatcatttcagcgatgcaattgagtgagtacttgaaagtctttaagtctgaaatcaagtggctaatgcaagttgacgatgaacacggcatggcaagccatggcagtactcgaattcgtcgtcgtcgctttgctctgtaatatgatatgtcgatatgatcgaccaacggatgctcgtggtagtgttccagccgagccctgctgctgaccacaaatgcatgcagttcttgacagcgaaaaaggagacttcttcttttgagttttgacgccttgcgccgacgggtgagccgccgccgccgccgccgccggagaagacaaggcgtccagcctcggggcccacgagggatagtacacgggaatcggattaaacgggccgaatccgccagtttgggccagagtaaagtgcgccaccgcgactccgcgagcgcgaggcctcgtttggacaatggcccaaatgctggcgcgtttgcttgtgtgggctgggaaatttcgagcaaaatctggcccatatactatgatgggctggggcttagacttttacctatcccgacgagaccagagttaggccgggcggaatatatgggccgtgttgcgtgggccgttgccagatttcacgggccgtgcagccatccggtatgctttgaacctggctgaactttttccaatttatagacccatagtttcgcttatgcttagacttgtaagctaaaatttaaattttagagttgaaatttttagttttcccatcttagtttgttttacagcattttaaaaaaaatcgctaagaatgtttatataaaacttttgcacgcaaattattttttatcggtaataagcggtatacataagcataaacataagcaaaacaagtactccagtaaaattgaaggtgaaggagcgcagcacaaaggattagacaaaatcaaagcattttctttctgcattctgtgagttgtgcagtttccgaactggctatactgtcatagtgatagctaagaaatttacaggaaataatggcacatatatatatatatatatgccaccaatacagttcgtaattaaaggttacatcaggaaaatgaatactgattcctccttgcatgatcttggatgacagaacggagagaaaggtttggaattagctgctggtgcacaatcggctgtcctgtaatgggagataccctccgtcctccatcaagccaggatctgatcgcatcggtttcgtaggtgaatccgtctgatgcaatgcaaggctccctcataacctcctgccattacaatgcaaatgatcaaatttctatttcaattcatcacaagtgacaagtatttgtgttaatctacacaaggagcagtgctaagttatgtgcagaacttttcattgaatacctgaaggattgggcagatgaagtatgaagggatgcagcagtcttcatcgaaaggcgactgcatcactgatgatggagaaaatgatgcagctagcttcctttgtatgagcaacgtctccggttctctgacacagttctcatcatgatcaagatactcttgcagcggcttaattatttgcccggaggcctctaagatcaaattgtctgaaatcacttctttctgttcctccatggttgtgttctgatcattcttgggtagatctctttcttgttttaactgtgcaatttcttcgcttgctctcagaagtgcttcttccagttctttcctctttttaacctcctccaagtacagctcctcgtattctttggcctgtaaggttcagagttctgatcaaaattctgaagaatatattcatatgaaatctggatgtttttttttctaagtggtctcgtttctgaataaaatagtcaaaggacaacgaattactttctgaagagatgaaactacttcttcgtctgctttctgccgtctgtaagattctcttaaagctctcatcattaagttgtcagctgctttgcatgcttctttgatctcatcgtaaaaacccagttccgattcattgttgtcatcctaaataattggaaaaggaaatcaccatattatgtcatcactcttacaagacaaaatattcgaaaccataagatggcattgcaagatcagaagaacctgttcctggtgaagtgtcaactgcagagcatcgtgaccagtatcaggaatgaaaggcgtatgtccaggtgcaatttctacttccacgccactatcatggaaaatgaatcagagatttttgagcttcactattcagtaatcatcataaatcgcaaaattactactaaaaggtttttaccttgtacagattaaccgttctttgcagacaaaccaaatcttgcatgatgggtcagctctctgcataatttctgttgctgtcctggatgcaggtttgtccatttttctgaaacagaaaacaacaattattggtcagctctctgcataatttattttgtcttcaattacaaaataaagctttgcatttcaagtgttatattttcttagaagaaatatttaccttgagtaattcctgtctggggcagctgaaattactagcttggtcactccatgcaagttgattagttcaacaagaccgtctacaacattttcgttctcaatgactagcttctcacatttcatctgaaatatacagacaatgaaaaaaaaactgtcaataagctgtagttctaaataaaaaacgggtgtcaataacaagccaaagccatcttgagataatgaattcacaggaattaacagaacccgtcacaccttcatcctcaggcattgattgacgtagtgatctaattgcttgtccaccttgtcacgctcagccattctgaacaagctcacttgctccggattcagtttactggcatggaacttgactcccactgcgaccaaaacagaatcaatacaacactagacagattatagccaaatttctcagtcttctgaattgaaagggctaagaggagtcacaaacccatgaactaatccatggtttccatgaatttttggccggacaaccatacatataaccatgaaatctttcagaaaaaaaagaagaagagaagaaaaacaatcggatgatgcagttacgtactgacggggatcatctgcggcggcacatgaacatgcgtgacgacgatggccgtggcccggaaatggccgagagcccacgacagcgtcgacctgccggacttcgcctccgccggcagcgccacgaacaccttctccggcgccgccatcgaccgaccttctcgtcaagcttagctccagttaatttaatgttcagttagcataagtacaaagctagcaagaacacgcggctttgggcgtacagaccggagactttggatggtgacaggcaccatatgcgaccgggaggaagaagaagaaggcaaaattaacagtgacacattaatttggacgacacggaaccgcatggagatttccaattttccaccaaaattaagtgatgattaattaactagcgccaatatcagcgtcatcgatagccttgtcattgaaaagaaaacttgcacatctcacagtcgcatcgttatataatttgtcttgtgccttgaccgtctccactgatcggttacatatactactaactccatattttaatgtatgacgccgttgactttttatctaacgtttaactattcgtcttattcaaaaaatttatgtaattattatttattttattgtgatttgattcatcatcaaatgttctttaagtatgacataaatatttttatatttgcacgaaatttttgaataaaacaaatggtcaaacgttgatcgaaaagtcaatgacgtcatacattaaaatgcggagggtgtacaaaattaatctgctgcttcggtttcaactaactgtttgaactcggaagggccgaagcacacggcaaggaaaggaaagggatttggcgggtggcaccgtgcacatcctgaacccccacagttcgttcaggtgtcttttcccggcaaattaattattaggattattactcatctgaataagtcccattgaataaactcctaatactttggtaatgacgttttgaaactttaatgaaatgatatcctccggcatcgtgaacatcgtgataacttcgctgattttttttttctttctttcttttcgctttttttttttaaaaaaaaagattatttgcacatgtgatgtgagaaaagatcagcggcccagatggcaagatgtgctaggcccataggaaacaaagtggcccatatagaacgtgtcacgtagcccaacattttcacggcccaaatttatatgggcctaattaggccgtcaggtttgtgcactatccggccgaaattgagtgggccaataccacagttccgtcatggttcgccggatgctccagcgtccaatcgccgccgccttcttccaggtcactattgcatatggagatacgaattttaatacgagtagttcagaaataaacatctaaacatcactgacttaaatttgtacattttatactgtaatcgagctgaaatacggatagaacgtacgtaatgcatggtgcgaataaactgtggaatgatgacgattcgacaggctagcattaataattaacttaatccatatatggttaaagaaatcagcatgcttatcacattaaatcatggagcctaaatcatgaatgtaagcatgttacgtcgctaccttaacttatctggtgcggactttgcagtttgcagtactctcttccagccattttgttcacacaacgatcgatctgtgtgtgttcatcatctctaatcgtattcacataaatggtagtctgatctgattaatattctgatggtgtgattaattaatataatcctgtaacgtgatcctggggatcagatctcagctcccgatgcaagcagctagctcaattaagcccataatttcttgtcttcttgtttctagctagaggcagtacgtggtatcgatcatcaagaacgtactcacagctggtgtactttcttcggaatcagaactcagtttttgttcgttagcgacctacttatatagagccaaaaggaaaatcggttgccacatgcatgtaagtgtgcaatccagctaggctacaattcatagatgtcagaccatctaagaactagttttaacagcagagtcaactattaagtataagctaatattacagataacgtttataatagatgaataataaggttatctctattttttctcctctctttctctcacctatgtatttaatttagttatcttaaattatgaatagttaactattacattagagctaacacaacttatttttccactatcctcccctccctgtaagttttatagttgacttatagcctactattaaactatttaaactagatcttgagcttatacttgctagttttacaattcttgttatttaaacaataacacaatcttcaaaatatatatttaactatatttttaatattatatataataaataaatatatttgtacttattttagcgccccacatccaacgttggcccactgcccctccatccccatggtatcggcaccgttttaattaggtgcctatttgcttgtctaggttcaccgtccaccgtcaaaccgtcatctctcacggccatccctctaaacccacccgatgatctgcctcctcctcccacccccaaccaatcctaacttgggaccctaaaccattactccactgccattcgtcgaggttatcggagatgtaggagaagggttgccagatctagtgaaggagttgtagtcattggagcacaaatcgtgtaggaaatataatcctgtggtaaaaaaaattgaaagattttgattgaagcaattccaattaaaattacaacatcaggcaagcaatataagaattttttttacaaatatacttattttttcaataatttacatttatatatatgcatacaaattttttgtaaaaatatacccatcccgcagaacgaaaatgcgggatcgcgacggtcccgcagcttcaaaacacgggaccgtcggtcccgcggacggccgcgcggcactgcaacggtcccgcagctccataacacgggactgtcgcggtcccgcagctccaatacgcggcaccgtgttgccagcgatttttatactgtgcgcactgttgaaacactgtttgggtactgttttgaaccgtgcgtggagcgcttccgcacattcaaactgcgggatcgcccatgaatattgccaaacagtacgaaaacagtactaaacagtgccgcgcagtataaattttctggtatatagcaggcgcgtggtagaggatgggaacgcgcggtcccgctcaacgactacgcgcgaccggtgcggttccgtgcatcggcgacgcgccgcgcaacggcgatgcgggaccgtctcgggaccacgcgttcccgcgctgcttctctccgagccacgagagcgagccggtgccgcgcttccgcgccgcgggagggagacggtgccgcacggccgtactgcgcaaccaccggtcccatggaatggcaaggcggcactgtctcggtcccgcatccttgtcatgcggtggaggtatatttatgcaaatattttttatgtagatatataaacgtaaaatatttttaaaagaggtatattttcagttttgtttcagcaatataatgtatcactttagagactcagaagaaatttttatcggcagatcaaacatttccacatatttcaacaaatgcaactggtcaactcgcttcaattccccgtgatgagtcggcgatcgatttccacgaatatctgttctctcctggcaaaatcttgtcctatctctcgcgaacacctggcccatgcacctacaacaaccaagcaatcattcatcatgcatgcaactagcaaccgcaaatacatccattctagccataatccggctataaataccagacgcccaaatcaaacgatgcaaagcaacacaagccgaccgaagcaaacatagctatagctagcacacaccactagctaattaagctcgctcgatcacttcatcagttagcaatggctatcaccaaggtcgctcccctcctcgccctcagcctcctcctcttcgccgtcgccgccgtgcacggctgcgagccctactgcggccacggtggcccggtcatcccgacgccgccggtggtggtgccgacgccgccgtcgtaccaccgccatggccgctgcccgatcgacgccctgaagctgagggtgtgcaccaacgtgctcaacgggctcgtcggcgtcaagatcggagccggccccgacgactgttgcccgctgctctccgggctcgccgacctcgacgccgccgtctgcctctgcaccgccgtcaaggccaacgtgctcggcatgaaactcaacctcgccgtcgatctaagcctcatcctcaacaagtgcggcaagatctgcccctccgacttcacctgctaattgagctcaaaccgtgcgtgcagcatgttggatatcatgattcatgagtttgatctttcatcccgattcccgacgcagcgttaaacattaatcttgaaataattctcttgtttactcgattcgccatttgcagctcgttctatattataatgtaaaattcttgaatcacttggttgttgtatattgtaacgcccattatatatagtagtattttttgttctcacaaagataactgccatatagcttacacgttcaccttaagttctttcttttctatccgtgcataaaaacactcgcacgatatgtgataatcatgggcgatgcggcaattcttgacctaactgttcctatttcctcaagccggtccacacatgttcctagccatgtgggtcctgcatcatggtagtctcttttggcccaacatgtcgcgtgcatctcgttttgtttgggatgttggcgggctgcttcctgttttggctgattagaagggttactaagttttgaatcctaataagggtaaagaagagatttgtacgtgacattgatgtgacatgtcatgctggcatagtcatgactgataaataggacccacttaaaatttttcatttttatttttttctttctcttttctctttttcctttttcttctcttgtttctctttttttccctttctcctccttcctctcaagaccatcgccgcatggggtgcttaggtcacaaagaaaggagaagaaaagaagaaaaaagagaagcagaagaaaaagagaagaaaagaaaaaaagaaaagaaaatgttttaagtggatcccgtttgtcagtcagatgactgccaatcacgtccatgtggcatgtcacatgagtgacatataggattttagatgggttgtgacgatctgggacttagatgacacacttcaataagttttgagatttatatttatattttaagagtttaggaatctgaatgacacaaaccatacaagtttaagaaccaggtgtggcaagatgtgcctacctaggtccacttcaaatagagcagctagcccatataacaatgtgtcataacccaaccaatatttccaaaacatatgaaaagagaaaaaaaacataaaagtagaatataatactcattcaattcctatgagattgaaacactggaaagtttcaaattgtttttgatgggcacacaggaaaaacacagaaaacatataggaaattgtaacatcccggcctaggacttaataggattaatagaatactcatatcaacaagttgcaacttcttttccggaagccaatctccaaaaaactccagggttaagcgtgcttggcctaaaattcttcccgggtgcacacgagtgaggacaaagtgtgcagaaaagacatgtgttggtctgtgagggcagtctatgacctatgaaagctatcagatataagcgggcctacctaggaaagctatcagatgtaagcgggcctggcctgggagaggcgggtcgttacagaaatagaaagaatgaattgagacttcaggctatttaatttcctccaaaatgtttctagaatagcacatttcatatgaattctgaaggaattattagtagaaatcaatccgttgttttaaaaggctttataggatttttatcatagaatacaaatcctgtaaaattcataagtttttctctcttttttttgaaagggccttcatgtctataccgtggagagcaaaaaaaaatttgagttaattgcactttggactaagaaaatttaacaaagttttactttggacaaggggtgaagttatattcactttggactagataaatttacaaaagttttaaattggaccacccttttttttgntttttttcccccccccaaaatttttccacttttttcccccctttctttgccttgttttctctattaagcagctgcgccatggatctgagggatgatcaagcaaagcaccaggattccttctctatgtgctctgttccccagcttgaagaaccatcaaaatcaagactggttttagctggttgctgtacctgtctcccgcaagctcgatgcaatgatttgttctaagctcagatgaacttttacggggaaaaaaggttgaagtcaagcagctaaatcaatgagtaaataaatcaagatcagatggaatattaattggtttgttgtgttgcgggtaagcccgccaatgaaatcaagaagtggcaaacaaaatagtggcccaatgtgcagtagaaggtaagaaaacctgaaccaaagtgaaaatgttagatataacctagtccaaaataaaacacaggcaataataatcggcccaaagtgcaattcactcaaaaaaaaaaatttatagctagcttagctcgatttgcagagcacttgacatactgactgagtgactgatgacgtaatggctcgaacaaactgtacacacgcatgtggaatgacgacgatgattcgacctgatgctagtattaattatttaattaaacccatactgttaaacaaattagcatgcttagcacattaatcatggagctagcctaataatgcatgttgccacctttctctgatgctggctagccattttgttcacatcgagtcagcctgttcatgtgatcgagtattcataatctgatccataatagtactattttgacggtgtgattaactaatataatcttgttcgtgatcctcgggatcagctccacaaagaaatatcagagtctaaactaaccagacaaagttataacgaccctcactttgcatgcatgtatgaaaaaaaaattagtgggaattcctcgcatggaattaagctcctatgatcatattgtcagtagcgaaggctaagacttagctgttctcaagctagatccatctttaggtacatccagctagccaatacaattcacggaggccatcccggctatgcgtgtacaaatggagcatattgactctgccagctcaagtacctaaaataatgcaggagagaggaatggatggatggttacgtatgacacgatgtatgcaaaattacaagtccatagcaagcatttcagaaagcattatattcagaacaagtattattcggcagatatataaagcacacatccatatattaatgtcaacaaatgcaactggtcaacttgcttcttccccatgaataatcgaattaattaaacgagaatatatgttctctctcctggcaaaatcttgtcctatctctcgtaaatacctggcccatgcagtacacaaccaagcaaataaatcatcacgtacatgcactacacaaccaaacaattaatcataacggatgcaaatattctactccctccttcaaaaaaaaaaacaaactctgggtttccatgtccaacgttgactatctattttatataaaaaattttataattaatatttttattgttgttagatgataaaacatgattaatattttatgcgtgacttgtctttttaatttttttaacaatttttttaaataagacggacggttaaacgttgaacacggaatcctaagatttgttttttttttgaacggagggagtaagcttcagctagttcagtacgtgtatagttccaaacagcaagctcgactcgatcggctataaatacctgacgccccaagcaaacgatgcaaagcaaacacaagctgaattgaagcagcctagctagctaattaacaccactagctaattaagctcgctcgatcacttcatcacttagcaatggcttccaccaaggtcgtcgctcccctcctcgccctcaccctcctgcttttcgccgtcgcggcgcacggctgtgagcccaactgctccggcggtggtccggtgatcccgacgccgacaacgccgtcgtacgaccgccatggccactgccccatcgacgccctgaagctgagggtgtgcgccaacgtgctcaatgggctcgtcggcgtcaagatcggagccggccccaacgagtgctgctcgctgctgcaggggatcgccgacctcgacgccgccgtctgcctctgcaccgccgtcaaggccaacgtgctgggcatcaacctgaatctccccgtcgatctgagcctcatcctcaacaagtgcagcaagatctacccatccggcttcacctgctaattgagctcgatcgtgcataattaatcttcatgcgatgacgaggattgatctgagttgcatgataaattaaagattaatcttgaaataattatattgttattcacttctacatttttgcagcccattctacattgtaccttactttatcattcttgaattacttaattgttgtaagttgtaacgcattatagcaatgttgttctccacatgataattgttatatagcttgtcctccttaatttctttctttttcatgtatgcaaaaaacgtgttcgtctcacagcgtttatctataccatctgtataattgacccacaaagtattaatactcaacaaagtaattattactactcttaaaacctaacatgcaagtatatcatatcaatccactaaataactaaagctcaagatgcaagcaagcatagcaattacatctataattttttacattctaaatcttaacattcaagcatgctaaatcatcatcccacatcactttcacaatatatcaacatataaatttatctatcatttatacaatgtttaacatatattcctctacatattccgtagcaaaacatgggacgtcatcgtatatttagtgataatggcgagtgaaaatgattgatctgtatctaacgatttcctcaaacaggcacacacatgtaagccatggggctaggcatgaatgcaggccttgcacgtaccatgctcgttttcggcctagtacctgtgtgcctcgtttcaacacaaagcacattcgacgtattggtgaacttctggttccgtcctattaaaatagtaactaagcttggtctgtctaaaaagggttagaaaagatgaatgacccaaatgacaagatgtgtctaactaggtccacttcaaatagagcaacccacagaacaatgtgtcataacccagtctttgcacaaaaaaaaaaacaattttatgtctgaagttaattgcttctaagccaactacaagaactagattataagctattaccgtccccagattctagggttaggggatcgtggctgggagagtggccttactctgtgttcccaacacagctgctgcgcacgaaaacgttaacggagcggtacattagaacgtgattaattaagtattagctaatttttgttcaaaaatagatcaatatgatctttttaagcaactttcgtataaaaactttttacaaaaaacacaccgttgagtagtttgaaaaatgtgcgcgcggaaaacaagaggagggagttgggaactcatggaaatgaacgcagccctgatcggctttacaagcatctgaccctaggaacaaattgtctttaattttctaaatgtttttcttcaattatatcgaaaataaaaaaaataatggttacattgtcgcacagctaattttcaatttttcagggtacgcaacatatgtcctacgggaaaaattataaactttagatgtcatgccgcaaatcttgcctacatgtttatagtggtaattgagcaaaattcctttgtatatgttcgtagactgcagaacacttgcatatgggatatgctgaaatactgacagagaacgtaatggttcgaataaacagtgtggaatgataacacgatcggagacctgctagcattaattaactaaaccgatatggctaaagaaacaagcatgcttagcacattaaatcatggagcccaaatcatgcatgtaagcatgttacgttgctagctacttaatttgtctggctcggacttactctcttccagcgattttgttcgatcaccgatctgtacgtgtgttcatctgtaaacatggataagcatggtagactgatctgataaattaatataatcctttaacgtggtcatggagatcacagctccgattccagtagccaaattaattaagcccataatttcttgtccaccatgtttctggaggcatagaggtcaagaattcacagctggtgtacttaatttgttcagaatcagaactccgttttaatttgttcattaaagacctaagagctaataaacggaagttaaaatcggtcgctacgtgcaggtaagtgcgcgtgcatggtcagctgggctacaaattttcatggaggtcactatgcgtgtatatatagagtatacattatagtgactctgcttaagctagctccgatccggccagtagtagattaatggtggaagaaattaaggaggctatgacactacgatatcgatgcacatttaggcaaaaataaaaactctccaaggcatgcaactatgtcagaaatgctcgatcagaacaagtattagtcagcagatacaaacacttccggccatatatt

SEQ ID NO: 58269 - DNA, 64898 bp, Oryza sativa
tgctagtactaacaacagtttggacaaaagaaaaaagttcatgcgttttttcaaaggttaatactcatggtttttgtcaaaaggctaactcaggaatttatagcgtgcaaactaaatttcacattttttgtcctaatgtaaattatcaaaaatttcaacgcaacattctcgatgctactactaaccaaattttgggccgaagaaaaaaaaatcttgcatttttctgaaagttaatactcgtgggttttgcgttttttttccaaaggttaatacacacgagttttgcgagaaggctataactcacgaatttatagcgtggagtctaaaatttcatgaaatgttttctcctgatgttacgatatggtccatatgctaatactagcaaatttttgggccgaagaagaattcttgcattttttttacaaaggtttaatgcaaaatttaatgaaaattttaacctgattttaatattcacaaatttcacaaacaatggtcccgatgctaatactagcaaaatttttaactatttgttttccagaggttaatattcatgggttctactcgaatgctataactcatgaatttatcctgatgttattattcaaaaattttacgcgcaatgacctcgatgctagtactagcgtacttttggggcagtgaaaaaattcatccattttttttcaaaggtaacactcatggtttttcctgaagaatataactaattaatagcgtggaggctaaattgaatgaaatttttttgtcctgaaattaatctttacaaatttcacacgccattgtctcgatgttaatactagcaaaagtttgtaccaaagaaagaaattcatatgttttttccaaaggttaatacttatgggtattttaagaaggctaactcacaaatttacagtgtcgaggctaaatttcatgaaatattttgccctaatgtaaataatcaacacattttaacgcggcattcctaatgctaatacaatgtaattttgggccgcaagaaaaattaatacattttttgaaaggttaatactcacaaattttgtgataagcatatatactcacaaatttacagcgtggttgctaaattttatgaaatttttcattatgatgtgttaataatcataaatttcacacccagtgaccctgatgcagcgtggttgctaaattttatgaaatttttcattatgatgtgttaataatcacaaatttcacatccagtgaccctgatgctagtactagtgaaaattattgaaaaagaatttatatgttttttttccaaaagttaatacgggttttgctggaagtctctaactcacgaacttgtagtgtggaggcccaatttcatgaaaattttctcccaaggttatggtacggtataggtgctactattaacaaaaatttgggttgaaggaaaaaatagtgcattttttcaaaggttaatactcatgggttttgacccaagtctacatctcataaatttatagcctcaaggcaaagtttaatgaaaattttatcctaattatagtattaaaaaatttcacacacaacggtcccaatgctaatactagcaaaaatttgagccgatgaaaaatttcttgcattttttttgcaaagattaatactcacacgttttgcccaagggctaatttgtgcttatttgaacgtttgttccaaatttcacacaattatcttaatgccaatactagtgaaatttcgagccggcaaaaaagttcaacagtttgttttccaaaggtacacaaataactcgctgccactaataatttgctaatgtcacccatgttaagattttaaatcccaatgaagagcggcgtatcaacagtaaagctgaacaacaaatagcccaataagacgtactaggctgtaaaaaaaaaaagacaaacccagacacacatatacaagttcgtagctaagattggttttttttttttgtaacggaggggtagtattgtaaaagactaggtccatctaatcctaacggcataactagcgcactcgagccccatactcccatggtctcgccataaggccagcaacaaaatacagccagtttattcttagtcgtcattgcatgaacaatccctcatgtttagtaaggtacaaacgggtaccatcgacgaagcacctgcaagcatatccggtaaagaaaacgggatatcatgagaatgagcagactccagacataattagcttatcgatcgcagattcaggcaacactaattcagagtgagcctcaaagtccaaaaagagaacgatgtttcatgcaagtcacgacggcaatatattgaatgaataggagggtctcaggcactctactgcacatgtacgataaagacaagctccatttatggacgatatattcaaacataaagatacatcaagagaaaagtggtcaaaatgacacattcactaatcaaatcatataaatacacactgagcttaaaaggaacaacatataaatacaaactgagcttaaaaggaacagcaagttctgaacgctcaatactaagaatacacagcatacacttgtatagatggaatcatataagagctagcataactgcaaattccgttctgatgaaggtgaatgatacctaggatcatccatgaaagcaataaaatgacatttaaacaagaaggcacggttcaaatccctactacaaacacacagagcaacttctggtcatataccagacatcacacctgcacaactaacgtaaccagtcgtaagtgcgaaagaacaaagcagatttgttgtgggttgggctaagtgatggtcagtggttcaggagagaagatcatcgctcgagaatcagggggcgagctctacataaagataaataatacagttggaggagtggaaatttatcttgcttgcaataaataatacagttggaagagtggaaatttatcttgcttgctgaaacaagacaatcaattccactacatgcgactaaaaactaacttaatccccaaaagctacagcagaataagactctggattaagctagccaataaatagcaaaagaaaagatggggaaggcatcatcagtcataaagaaagcacctgaatactcaccaagacatgcaaattggcaaattagtaaaataaatacaacaccatgcagcttttgaaggctcctaacagcaatcaacacagtcccaaaacatgaaagcatgagggcacatgactacaaattggtaaccagaccgataaaaagtactatcacacgagctatatttgctttttaaaacaaaaaaaatgttcttccagctaatgacgaaggatatagttgccattaatattattgtcacactcacatactaatacaaacagacaggtgattcagtattgctctcataatcatccttttcagtcattgcctcacaatcaacatacattgcagcattgctttaatcaaatagaacttctgtcttgcaaaggagacaatgagacacaaggatctaaactaaaccagttaggtgtcattgacataacttgcatgtatgaataacataaactccacctgtccaccaaacatgtgaaaagagcgttattctaatacaccaaataggaacaagataactcagcttcatagaactaaaaacaaaaagtcagcaccacgggaaaacaaacaaaaaagacgtctggatgtaaagggttacattggttcacaacaaccaattttcatatgaagggaggcaaacaaaaccaactacaagagcaaacaacgtagggcattccctggagataattctatgataagggcactgagaagttaattatggaggataacaaatatcaacagaaaaatcttctttttcggggcagactatatgcagtacagataagcaagatagaacatccaagaaactcttacaaacatacgaggcaaagtaggtatgcaagtagactgacccacctaccgcactttctgcacatggacctataaccagtgacaaggttccacccagcatactagggcaatggtaggcgctaggcggcatcctcccgcctgctgcacaagtattaacaggtaacctagctcctaggcagaaacccagctcacacagcgcctttctgaacaatactcaatattagtggtaaagcaagcaaaggattggtatctgggttggtagaccaagcccggttgcatcccaacaaaaatcccaccaattaacaaaattccaaacaaactgtaaaatcttaacaaaacagtgagtaaaacatcagccatgtaccaacaaatttatgcaaggcaacagggtgcaaaagaaaaggtcagtgcaagtacaacccaatttacatatatgaaaccagtgttgttaaggcagtttaacgcgacccaccactgccttagcgccatagcgctgaggcataaggcgttgctttgccatatgagatggttgaggcgtgattagtggagaacatggtagagaaattaggaagaagaaagggggtatttggtaaaaggcccactaagccaggcagccagcccaccaaagcccaacataggtcttcatacccacgtgttctatacttctgtgccctaagaggcatcgtactccaccaggcaccagcctccatgacgagcagataaggcaccagccattgcggtgaggaagaaggtgactgcaagccaactagggttctaggatgagcttacccctatcttcttttcctttttctactgtttttttctctaaggccttcttctttcccttacatatatgaaaagtcaaataaaaagacaagacaactgggagaaaacaatactgtgtaaagggacgctacattgattcacaagaaccaatttcatttggaaggaaggaaaacagaaccaacttaaagaaacatagcaagataggacattcccttttctttctctctctctcttttttttttttggggggggggggcagaaagaagtagagaaaggattacagcacttgttcagctgctaaaacacaacctagaggtaaaagaagatagctatgctccgattgcacaaaactttgaagggaccaccaccacagacaatacagctctagagataggccagagatatttctggtaaggacactgaaaaattaaatatggacaaaaaaaagtacattttcagagccatctattagtaacatcatacaagaaactcttacacatattagtagtacgtatgcaagtgggatggatgacccacctactcaatctctgcacatggcctatagctatcgtacggcatctttatgaacaaagccagatattagggtaaagcaactgaatgatcagtgtgtgggttggctgaccaagcccagttacatacttgcatcctaacagaaaccccattaatcttatccaataaattccaaacaaaccggatgatgccgacaatactgagtagcaaataaaaggccaaagggcagatgctaccaattgtacaaatacagcccaatttacttatctaaagtatgtttaatcccacaaggaacaaaacaatgaaacccatatccctcacaaacaacacagtcaacagacaacattgttgataagaaacccaacgaatctaagagaatacaaggaaacccaacctaaaccaaatagaaaacaatccatctctaaaacatccagattggaaaaaagaaaaaaaaagaaatacatcactactgctttactttaagcattttctaatttttatcacctaacctaaacaagcaagccctacaatcaacggcatgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggaccatgcaactgacgggagatatcgccgtcatcgccatggatgcgggagccagtggtcgggtcgtgccgtgcaacggacgccccccgttcaccgaacaaacgctaaccctaggtaccccaaccccgtggattacctgctcgaggcgtcgccgcggagggggagacgaacgaaccgcacgacatgacggtaatcgcaggttgtaatcgtcgatgccgccatcggcggcgggtggtgggaagggggacggtcatggcggctcgtggtcgtctagggttttcgatggcgaggcggatctagaagggagggggcgatgccgtcggtgcgagaggaggccggaggggaggaggaagaccaaaccctaggaaggaaatcgccgccgaatccgcctcgccgcgccgcgccggccgccggcgagaaggggggagagagagagaggcggatcgatttggggattttttccgagagggatgattcgggaaaggattaatgggcttcgttgtgggtgggttagccttgtagcctcggcctgttgggcctcgaaatgctaggttaccccatctgggccgtcgatgttagatcggacggtcgtcgagtcggatacccaccactatcccagcacgcggcctgggagccgcacggccgcaacccaccaccactcccgaagcttctctcatggcggccatggccgcggcggcgaagctcacggcggccgcctcctctctcctcctccggtgagctctcactctctctcttccttcgagtccggtctactgcagcagtgttagtcaagcagatattacttctaaatatctaatccaatctttttcttacatgtctcttgtgcacaggcgctcacccttgctgcggcctcacggtctccgactctcccgccgcttcgctccccaaaggtgtggccgctttcatcagagatctgacttatgcccatgtttcttttgcgaatcatttttggaaatttggaccaaggttgggtgttactactggcattcaacttttgggcaactttggagcagttttctcttgtacttatggatgcttaggagacttcattctatctttagagcaatcaattaccagatgattattaacagaatcaatagactctctacatgcccattggcctgttatatgtgcatgattctagatttagttagccatgaagggtcaatcaacggagtgtagtgtgctctattgtttccaacggttggtactaaaaaaagtataagcaatgaacaaagggttgatcaccaaatagcaattaccgaatcccaattagttatattgctatttgatataaactcaagtctgtaaaacaattaaatccaaaattaaacaagtgcctaaacaatatggtggcatttagatgtgtggtgggtttacggtaatgctatgaaatcatagttctctcccatcgtctacaattgatggttcttgtctaatattgagtccgggtgcttttcccttttcctccagatttgtgcgccacattgcttcatcgacaaatgaagaagctgctgctaaagcagcagcagcaacagctgatactggaggaccgaccatgtaagctttctcattttactatttcataatcccttctgtggcagtggcactgagtattcctctttgtttattttatggaagttttgacaagatcattgcaaaggaaattccttctaatgttgtctatgaggatgagaaagtgctggcatttagagatattaatccacaagcccctgtgcatgttctagtcatcccaaagataagagatgggttgactggactagacaaggtatggaatgttgttcactagtgtttgcgagaggaattctcaatctctaaaactgtgtagcatggcagtatccatgtacttcgttatgtgcttatcttagtacaagccgatgccctttttaactgcctatggaagcaaaattgttggtcatgtactcatgtcttctttgagcaagccttccatcagacattatcacctcatgttggaagaacatatttttaggctgaaccaaggcatgtcgaaattctgggctatcttctatacgccgcgaaaatagtggctgagaaggaaggtatagctgaagggtaccgtgtcgtcataaacaatggacctaaaggatgtaagcactcccatgccacatctcttttctacttactggggtttgcacatgttttcacttttcagtatacatgctacacatcatccttcaacgtattttcggtgttgatacccatgctcatgcatgagctcttttccaccgccatatttttcagtatttatgctaatactgtatcatcgctctgtccacaggtcaatcagtctatcacctgcacttgcatgtactaggtggaaggcagatgaaatggcctgctggctaattaaccaagtgggatgctttctgtactattgcctaagttctcttgtagtaagacaatatgatcggttgaagtaatacccgcattggtgaatggtgttttctatccatctgtaacgtctttgttgtcaatgataccttcacaacagagcccgtgagaatgctcaaagaatctgttagtgagattgtctggtcgttctgtaattacttgattcgagcctctaaagtttacataatcgttcggccacaatatttatttgcaatacggatcgagggtaataagctagattcttcgtgctgtaatgtagttttgactttctcaaggcaaaacgatcgattgaattgaaagaacagagttatcgacttgtctaatgatgcttgttttaatgttttataaatctgattttgttattcaaactggaataatatagctggaaaacgggtggatcacgtttcatgcagctatctccagaattgaattcagaagataaacaaacccacaatccctgagctgcaatctcaatacaatcaagtcactgtcacttaatcaaagtttaaacaaacccaatcctccacctgtattcagatgataagcaaatcaagagctgaatttcaaatggagcacaaacggaatgatcaggacactacaaaattttcatgtctgatttgcaagaaaaatgtttcagcttattacattccttgggactcctctatccagaataatataatgtggtaggagaggcgagatggctcattgtcatgatggtgagttgctgcatagtttcttgaaatccagcagttaggggattgatcagtgtttgccatcttcttcctcacaaaacttcttgtacttctcatcatccatcagcgagtttaactcacttggatcacttatcttaaccttgatgatccatcccttctcatatggacttccatttatctgtgtaaaattgcagaagcaaattgtcaactgaacatagcagtgattactcaaaaattagtctagcaagggtagcaattgcgactcacaaatcctggtttttcacttagttcatcatttacttgaataatctctccagatactggtgcattgatatcactggttgctttcacactttcaaccgcaccaaagttcgttccttgtgatactgtggaaccaacttctggaagctcaacatacacaacatcacccaaatggtcctggaattgaaacaggacatattaagccatcacactatcacagaaaattctattttgaggaaaaatgctgtaatgcatgtcaataacacgttgaagttatcaactcagcaagagacccagtaatatagcatattgaaggctgataaaatgctggtgcagcttgcaaatgtatcaaactgattacctgagcatggtctgtgacccctatggttgctgaatcaccctcaaccttcacccactcatgagtatcagcatattttagatctttaaggactgccaagcaggaaaacaaatatgcattacttattagagtgataggctgacagcgaagcaatggatattgtattcatttgaaaagtttcagtaaatgctccaatcagttagatacgctagagggatgcagtagcagtacactggaaaaatctaaaaagatgttttgaagaaacataaaaccaagttgagaaaacaaatatggcacaaggtgcatgaccaccttctcttgggatcacctatttttatttctgaaatagaaacaactataaccactacatatggaatagaaatgtaatccgcatatatgttgtgttgcctgtgtaatctagcaagatgtaatttgcagtctagtaccaatttttggaagccctacactgtaattccataaatcatctgcacatttcatcatctcaaattctcaataaccaaaagggtaattcacatttcagtcatccaatcggtgcagagtcttgcctatgaactaatgaacaccccaagaaggaactagcaactagaaagtctagaatggtgcatcaagccatcaaaaacaaataaccctaacattagacctaatcctcctccctgatataaacgatcgacatgcctcacaatgaactatcgggtcaccgctatactttacatacgaaagtctcctgcaaacgaactgcgcaaatctgtgacgcgcgcacacaagcagtgaagcaaaaacatcacaaaatttcagatttaacagcatacttcctcccgaaacccgataattagggtagaaacagccgagtcaccccgtcccaacgcgcagagcctttgatccccaattccccataccacaaacagtacacaactacacatataatacaggcaaaatactaagcaggagggaggacaaaatggcaaagcaggagagggggcagatgccataccggtggagaaagccctggggaaggaggagatccgaaggtaggaggcggtgcggcaagcccagagcgcccttgaggcggcggcggcggcggccatgatcgagcgagctgttccaccgccgagctcttcgagtggaccaaccccgccgccaccttggagagagaaagagaaaataatgggctttctcttaatgggcttttgttagtgggctgtagtttaggcccatgttgaattgggctaaactgggttggttaccagtttgcctctgacagcttgaagagatattggaaaaagtacaccgaaggtccctcaacttgtcatcgagatacaaaatcgtcccccaaccacaaaaccaaatatgtgacatccctcaacttacaaaaccgtgggactacctatacatttgttgacaagtttttctccaaaaatttgacagatgtaattatagtacaatcgtagtgtaattacactgtaacttatatgtaattacactgtaacttacatgtaattacagtgtaacttatatgtaagtttcacataattttgaatcgttagatctattacaagatttgttttggtgaggaagaaaacaaatcatagcacacatatgtgaaaaaaaattgttcccacgacctccattttaccgaaataacatgttacagacagatttttgaaagttagatataagttacaccatagttacagtgtaattacatgcaagttacagtataattacactacgattgtactgtaattacatctgtcaaatttttggggaaaaatttatcgacaaatatatagcaaaatcagaaaccgtttactctaggtccttcggtggttttgaccctggttttatccgacatggcggctgagtcagcgtgggacccgtgtgagcccccacatgtcatactgtccacgtcagctttctctttccctcttctctcccttcctcctcctcctcctcctctctctctcttctctcttggcatggcgtgcatcgggtggggaggagaccgcgccgctcgcccacgccgcccgcgccgctcgcactcgccggccgagtcccggccgtgccgctcgccctcgccagcgccatgtcaactttcagctgtcggcgagtctgccgagatgagcggcggctggccctctgcagcacggggccatctctctaccgccggatgcactcaaggacaacgcccccgctgcccctaccgtcgacaagctcggccgcgcgcccgtcggcggccggcgcggttgggctccatgccacgggaagctcgaccaccaccatggccccggcacatcgccacacggcttgctgcgctctgcggtcgacaccggccgccatgttatggggcatctcgtacgtcttggtgaagcagttgcccggcggtgaggacaagtctccatctagcaccacggtgattccattaatgctcattcgcacacgttgcatccccagctccatcccctgcagtctctgcatggcctatgacaaggcagcaaggctgttgccgacaagctcctttgccgctgaagaaacccaccacaaccgtgatgccgctcccgcagctcgacggccacgacctcgcgccgacgtcgtggtcggaggtcagcaaggccctggaggtcatcaagcctacgctcaactccaacacgacggagaacgccaagagcccgcatggcaggcggtggagacgtggcgccgaggtcgtgtcggcggcaggaggatcccccgtcgtcgtggacggcggagaggaggccgacgcgatggcggtgggagcacgcggataggaggccggcgcaacgggcagcctttggcggccggctgctggtaggggggagcacagtggagaggaggccggtgcgacgggcggcgggcggtggccggcgagggaggagcgcggctgagaggagggctggcgcaacgggcggcagtcggcgacacggagcacgacgacgactcggggtccctcccgtcgtccctatcccagccgccgcttgccctgctgccgctcggactgcccccgtacttagccgctcgccctgccgccggagttgggctgagacggggcgccagcagcagtcgtcaccgcactcgcctgccgccaccgcgctcgcctgccaccgccactgccaccatgaattggctcaagctcggttgaccgccggccgcccgtcgcggcgccgtcctcctcctctcccgcttcgcctcgttgacgcccgcgccttcccgccacccgcgacgcccgcgcctccccgtcgacgcccgcgcacggccgcggcacgcccacgccgtggagctccgctgggctgccgttgtcgccgccgccgaccgccgtcgcggcgccgtcctcctctcccgcctcgccccgcccagcggccgccctgcatagagagagagagagagagaggaggaaccgaggaagaccgaccggcctgcacagaagagaagagagggagagatatgccctcatcgtttggcttttcttttaataagccaaaacggcttattagagaataaaaataaatttgtaggtaaaacttttatatatgtgttctcggtgacttaaaagccaatgctgaaaaagaaactacgttgaaaatatctcaaaatcaatgtcaaaattaagtttgaaaattcaaaatttggctttttctttggctgaataggccatccgatgggagccatagatgactcagcctaacatgtagggtccacatgggtccatgctgactcagccgccacgtaggataaaaccggggtcaaaaccaccgaagaatctactgtgaccagttttaattagttgagggatgttcggtatctagttttaccggtatctggttttgcggttgagggacgattttgtaactcgatgacaagttgagggaccttcggtgtactttttccaagagatattctccaatagaatattcttctcctctgatcccacgaggaacgttctctagattgcttaaaaaccatccaaactgttatgaaaaattctaaagaaatttgaaaacgcttatacaatatatttatacaactccacaaaatcctaggtctaaactcaactcgcacgtcaagataaaaaaaagataaaaaagacaaatttaacgtatgaatagcaatgtactattcacatctaaatttatctttttttctcaacgtgtaggttgaatttggacatgatttttggtaaagcgatagatattattataccctatattgctaaaaaaatcataattgtttactactatttgtataaaatttaaaagaaaaggtacacgagaggatataatcccgaaggattagaatccactcccctctcattttcgctttttttttagaattggtccagaaattaagggtcatttctgtacgaaaacgtaaaaataacttaaagttacattaagtggttaggtcgtcattatcgtcctaatgaaattattgcgtactccctccgtcaaaaaaaaaacaaactctggtttccgtgtccaacgtttgaccgttcgtcttatttgaaaaaaatataaaaaaaattaagaagataagtcacgcataaaatattaatcatgttttatcatctaacaaatatgaaaatactaattataaaaaaaattcatataagacgaatagtcaaacgtcagtacggaaactcagggtttgcctttttttaggacggagggagtactggttaggtcatcataacagctcattcccactatatatatgtagtacatttttcgatctattccgggtacacgatcaacagttcgcaccttgattgacgctaattttagcccaaaatactcccaacaagaaaacaaaaagaaaaaatgaaattactacagcaatcagcctcgggaagcagcaaatttctcataggaatttcactgtaaacaacacgttgaaaccaacggcgccgaatgtgcaaaattatcagcagctggagatcgatcgatcgaactcatcgaagacgctgtgcaagcaaggacagtccacagagccggatacgagtgcgtacatcacactgcagctaagctgagtagggcatcgagcacgcgctgaacggcagcatcacgaggggcgggtgggcgcgagcgcgagagaccatacctagctgcaagccttgacgagtagtatcggagttggggacgacgaaccataacagtagggatgaagagggtcccagacgaaagcctagcccagtgttcactagaccagcaatgggcacggtcatactttcgagcgtggtaacctttctggcgacgctgtcgaggtgcccctttgcccttaggcaaggatctctataggaaaactttgtccagttttttagacaggcagcaatgttatgctatcacgtcgcaccttaatgaagacgttgtttttagagtttccgtcctatggtgttgttgtaagtctagcagtgtccggtctcaaatagcattagtcgtttcgatgcttgggtccctttttttgtagcttgtgttcgtgtggttgagatgtagtgtggtttcagggcgtgcgtttttagtgcacgtcctttctcgacaaccagctgtcaattcaaactcttttgatcatccctaccaaaataagattcttcgtccgcttttggccattggcatcaggtgccgcgtcctttatgcaccggaagatagcttaatcattctttaggccccttcaaagaaaatttataggaattttagaggatttcatttctatagaaatgtttcctacaaagtcctttgaatcaaaggaatgaaccctatggaatcctatgaaattcctatggaatgcctcttcccgtacaagttttggaggaattttaataagatgtagaacctcatagaagaaatcctttgagtttttatctctccttaaattcctgtgtttttcctgtggtccaatcaaatggtcattcctatatttttcctgtgttttgcaatcctctgtttcacacttacattcctgtcagaatcctatgtttttcctattcctccgttttcttcattcctgtgattcaaaggggcccttaagcaccaataatactacttcagaataacaatcagtagtgtactggtgtgtttgttttgttgctccctttcttcaaagattacgacagattaccagtattatattgcgaagaaagaggaaatgccttcatttagtggaatcaagatcaaaccggacccaattaattaattaattactccctccattacagaatataaaaattttaaagttggacacagttattaagaaaatagttagaagtgaatgatgtagggttgtgatcggataagtagtggagataggtgagaaaaatgaatgacggagggttgtaattagttagaagaaaatattggtagagaagttatattttagaataaattctaagagataaaatttgttatattttggaacggagggagtaaatcggactaataaaactacaaaatgtaacaaacacactacctcacctaaagctaaccaccgcaaactgaactagcaagctggaagaactctgcaaaatttgctacctatcgacctcgtcacctccgctgtttgtttgcagtcattcgcagcggcagcgatggatgttgcggccgccgcgggcgtcgttggtgggttcttgcaggtcgtcttcgacaagtactacggctccaagctcgagcagtgggctgctcgctcgggcctgcacggcgacttcctcagcctcaagaaccagctccacatggtccgtgccatgctcgaggcaggcggcggcggcaacgccccccacaacgactccctgcgcagcctcatcgtggagctcaaatccgctgcctacgccgccgacaacgtgctcgacgagatggagtactaccgcctcaaggagctcgtcgaggacaccagtggccgcgacggcggcgcaccgtcgtcgtcggctcgccaggtggtcggccgcatactggtgcctgcgcctctcctgtccaatccattcaagcgagccaggacgggcgccgacgaagccttgcaagggcagggcgctgacacggacacccccaacttcgatcaggatgcaatgtcctccaagatcaaatcgatatcctgctgcctcgagcagattgctggcatggtgcggaggatcatcgagctcgacaagttggtgtcgatggcgagcttagggcatgtacaaccagaggtggtggtaagtctgcggcagacaagctcctttcccactgaaactaagttgtttgggagagatgagtctaccaacaacatcataaaccttatgcttagaacagatatggagtctaggtacaataacttcaatgttcttcccattgttggcattggtggagttggtaagactgctcttgcccagtctgtctacaatcatcaaagagtagttgattcatttcaagtgagagcctgggcatgcgtttctgatactcttgatgtgcgcagagttatagcagatttgatagattcgatcgatggtggccaagaaactcccaagtttcatagagtgcctagtcttgatgcaactcagagaactctactgaggaaaattgaagggaagaggttcttgattgtccttgatgatgtgtgggtcagcagccactgggagaagctttgtggtcccttctccgcggggatgtctggaagcatggttttagttacaacgcgacagagaaaaatcgccaaggccatgggcacatttgacagtttgacactgcacggtttacatgataatgaattttgggctttcttcctacagtgcacaaacatcacagaggaccacagcttggctcgaataggcaggaaaatagctctcaagttgtatggcaaccccttggctgccaagaccatggggagattcctttcggaaaaccacgaggaggagcattggtgcaagtttctgaatagaaacatatgggaactaaaacaagagcctgacgacgttatgccggttttgttgttgagttatcagcatctccctctaagcttgcagcgatgtttcacctattgtgccatatttccaagaggctataagttcactgagcaagagcttatatttgcttggatggcacaaggccttgttccaacacctggagaggatcagacattggaagatgtaggaaaggagtaccttaacgagttactcagttgctcattcttccatataatcgagagtggccactacatgatacctgggttgttacatgatcttgctcaacttgttgcagaaggggaattccaggcaactaatggtaaattccctatctcagttgaggcttgtcacttgtatatctctcattctgatcatgctcgtgatatgggcttatgtcatccactcgattgttctggtattcagatgaaacgccgcatccaaaagaactcatgggctggcttgctgcatctaaaaaatttgcggactataatgttctctgcctcttcatcaatttggtctccaggttctgaggtagtctttgtccagagcaattggcctagtactatcagactgttgtctctgccctgcactttccgaaaagagcaacttgcagcagttagtaacttcatacatttgcgttacctagacctcagatggtcacgccttgaagaattacctgaagccgtatgcaagctttacctactacaagttttgaacataaagcactgtccgtgccttcttcatttacctccaaggatagccaacttattaaactttgagcatctgattgctgatgaaggaaaacatttactcacaggagttccatgtgttggcaatatgacttccttgcttctgttggataagttctgtgttaggaaaaccaggggctttgacattggacaactgaaaaggttgaggaacctaagaggtttgttgaaagttcagaatctcgagaatgttgatggcaatgaagaagcagcaaaggctagattgagtgacaaaaggcacctaactgagctgtggctgtcatggagtgccggttcttgtgtacaagagccttcagaacaataccacgtcctggaaggtcttgcaccacattcaaatgtaagttgtctccatattacaggctataggggcagtactaccccatcatggcttgctagtaatctcagccttagctcactagaatatctttatctagattattgttctgaattggaaattcttcctccactgggactcctccctcaccttaggaagctgcatatagtcaatatgcacgcgctaagaagaattggctctgagttctatagcagtggtcaggtggtggggtttccatgtttggaagggctatttatcaaaacaatgccagaattggaagactggaatgtagatgactccaatgttttccctagcctgaccagtttgactgtagaagattgtcccaagctgagtagaattcctagttttctatggagtagagaaaacaagtgttggttcccaaagcttggtaaaatcaacatcaaatactgtcctgaattggtgctgtcagaagccctccttattccacgcttgccttggctccttgatatagacattcaaatttggggacaaacagtgataaatttgcgtggtggctgtcttgaggtttctgaaatcaatgctaatactagctcaggcccaataaatgctgttctacaattgcattggctaaaacatgtgtctagttttcatatttgggcacaggacagtctttctgtacacccctgcaagcaaaagacagaaccatcagcatgtaattctgaacacatggtaaattctctacaaacatcagcagagaaagttgaagtcacagggtatggtattactgatgaattattgtcagcaattttggagaatgaaatctgtccttcaagtttatctatatcagattgtccacaaataacatctcttgatcttagtcccctaagatcattaaaatctctggtaatacacaattgtgtatcactaagaaaactctttgaccgacaatatttcactgctcttagggatttggaagtgaccaatgcatcaagttttgctgaagcatggagtgaactgttaggatccagatatgcagagtggggtcaagttactacctcactggaatctcttacagttgacagcaccttattcctcaactcccctttgtgtgcagtgctcacttctctgaagaagctaacaattcattcggatttcagggtcacttccctctcaagacaacaggtgcaggcacttctactcttaacctctctgcaagatcttgggtttatacaatgctgcaatctacattctcttcccagtgaactgcacaaaatatacactctcaagcagctcgagattgattcatgcccatgtgttgagtcattgccaaataatgggctgccggaaaagcttgaaaaattgatcatcagaggctgcaacagaagattgtatacaggtgcatcaatgatgggttcaactagcaccaaagtgcacctagtagatagatgatataatagatttaggttcatattagtcggcgaccacgaatataaatagctcgtgcaagtgcacagtaatcaagtagtctacgtagtcgcttttggatgtcaggctatgcaacggtattaatcaaaagatttattcacctatttttatttctgaaaactgttatagatacaaccgtttcgtatggaacaaaaaggcaacccacacagatgttttcatctgacttgataattcctcttaacaatctaattaccatgacatgcatcctccatacattcttagatctcgataccagaatcctccaaataatagctttactttttgttctgatttgcacacaaaagtctcctccaaacgaactgcacaaatcttgacgcgcacacaagcaatgcagcaaactcatcacagaaattcagatttgacagcatgcttccttccgaaacccgatacttagagcagaaacagccgagtcaccccgttccaacgcgcagaacctttgatccccaattccccataggccataccacaactacccaactcggcaactacacgagatacaggaagggataaaatggcgagacgggagagggggcggatgccataccggtggagaaagccctggggaaggaggaaatccgggaggtaggaggcggcgcggcaagcccggcggcggcggccatgatcgagcttcgagctaattccaccgctgagctctgcgaatggaccaaccccgcggctccgagtccttgaagagcgagaaggaataagttcacttgaggtccctttaacttgtcaacgaatccaattttcatccttcaaccagaaaatcaaatacaacgggtccctcaactatcaaaatcagtgcaaagcaaatccctcaacggttttgatggtggttttggctgatgtggcgcctacgcggccggtttgacttagtacttgtcataagtggcggtaatgtggcacgggaagcaaaatataaaaataaaaaataaaaacaaaaatgtggggcccacatatcaatcagataaaaggaaaaaaacagtgggacccaccatcctctctgtacacggacgacgggagaggagcagccgacgcgtccttctctctccctcccggccatccttcctcaccggcgagcgcgcacggagagggaaaaaggcggcggatccgttggtagctgcccgccgttggtgttcggtttggatccatcaataaccagcccgattcctcgcacccacgcaagatccaaaacggaaacttagacggcacgcggatccaaaccgaataccaacggcggaggaagaggcgcgcagtgaaagagagagaccagcggatctaccacgctcgccatgcgagaaaaagacggcgcgcaacggcgaactctgatcaaatcccaatcaatagccggcccgattccttgcacccacgcaagatccaaaatgaaaactcagacggcgcgcggatccaaaccgaacactgttagatttaattgggtaattgatccatttaaatcaaataaattccaaggctcattatgctaggaattatgctaggaattcatgtgtattcattttcttatgggatatcaatgggatgaagagtttatgagaattaatccatttgactagggaattggtaacttatatcaattactcctaattgatggatggttgatggttgtgtagtggaggatggttcatggctagttgatgacaattagttgctctattcctcttcctattccattggtaacctacatcaattactcctcattaatggttggttgatggttgtgtagtggaggatggttgatggctaattgatgagaattaattattccatgactcttacccttcatcttccattccttctataaaatgagaatggatttgatctccctaagaagaagtgagacacactttcatccatttccaaggctgttgctgctacaataatcccatcccgacgagtgtgtgcacacgcgttgggagagtaggcctccgaaaccatgcaaaccatgcactgctacgacgtttgcacggacgggcgggtgatcaggtttttggggagcgcaaggcgcgactactcattgttcgtcaatgtctacttcatcttcaccaacatgtcgaacactggagacaacggcaacactggagacaaggagaaggaggctcccgacaacaccaacggaggcaacactgcctcaaactctagcggaggaccattcttgggtataaccttcttacattatttcaattagaagttttactgttaatgttcatcgcaatgtcaacattgcgttattatgtgattgttgatgcttattctacgttaagcatgctcatgttgattacattcacctctatcactggatcaaatcccattgtaaatatcatgtttaacaccaacggcgggaaacgaccagtggatccgctgccttttcccctctccgtgcgcgcttgccgacgaggaaggatggccgggagggagagagaaggacgcgccggtcgctcctctcccgtcgccgtggatagagaggatggtgggtcccactgttttttccttttgtctgactgacatgtgagccccacattgttgtttttattttttatttttatattttgcttctagtgctacatcaccgtcacgtaggacgaggaccaagtcaaccggccacgtaggcgccacatcagccaaaaccaccatcaaaaccgctgagggacctgctttgcaccggttttgatagttgagggacccgttgtatctggtcttccggttgaaggacgaaaatcggattcgttgacaagttaagggacctcaggtaaacttattccgagagagaaagagggagaataatgggctttctattaatggggttttgttaatgggcagtatttcaggtccatgttgaattgggcttaactgtgtaggttaccagtttgccactgacagcttgaagagatattctccccccccccctctctctctcttttcgaaaatgctaatggcgatcgattgcccctagcgatcaccctcctcctccatgtggttttcttttttggcactgtattacttttctattttagtaaatttatacacctaaactttgtacacctcaagtttacatatctaaagtttatacacctaaagtttagagacccaaagtttataagtcaaaagtttatatatccgactcaaatttgaatttaaattcaaatattttttatatatagtatttctatacatctaaagtttatacatataaagtttatagacccaaagtatataagtcaaaagtttatatacccgattcaaatttaaatttaaattcaaatattttttatatatatagtatttctatacataaatttttctaacttttttttattttttttaaaaaaattatggtgtagtaggaagagaaaaaggggaggagaaaggggggagaggagcgtatagggggatgggggtgatcgccggccattagcaacgcccctctcttttcccttttttttagaattggtcgagaaattaaaggtcatttcggttagaaaacgtaaaatatgttaaagtttcattaagtggttaggtcgtcattatcgtcctaatgaaattattgcgtactggaacccaatgtgattagtcaataacagctcattcccactatctatatatgtagtacatttttcgatctattccaggtacaagatcaacagttcgcaccttgattgacgctaattttagcccaaaatactcccaccaacaaaacaaaaaaaaagaagaagaagaaattactacagcaatcagcctcgagaagcagcaaatttcccataggaatttcactgtaaacatcacgttgaaaccaacggcgccgaatgcgcaaaattatcagcagctggagatcgatcgatcgaactcatctaaggcgctgtgcaagcaaggacagtccacagagacggatacgagagcgtacatcacagtacagctaagctgaatgcatcgagcacgcgctgaacggcagcatcacgaggggtgggtgggcgagaacgcgagggaccatacctagctgcaagtcttgatgagtcgacctccatccatgcatggcgctcgcaagattttgtctcactgccctaccgaaattgccactgatgatatacatatagatggatggattgacacaatgccagaagtatcgtttgagcacgcatttttctttggtcagaagatattagttcttgctggtgtgagaggctgaagctgccagcatgatctggtccatgagttgcactgctgaatatattgaattcagccaggagctgctactgcagttctgatctcgatctgcattcgttgttctgagctatgtatggatttgatcggtttgaaggcatccatgtctttaatttcatcgatcagatcatgttgcagcttcactctctcactaccagcaaaaccatctcatcggggctccagtcttcgatcacaggttcgtaattgtcttaaggtaggttgctgatcgatgttatcttgttttgtcatgcaatttgtttctgatccatcgagctgttgatctgtagttcttttttgactgtgatttctcagcaggtcatcactataagctgacaagctatatgatgcaaccttttcccgaacttctatggactatggagaaaggaggtcagtgttctttgttcctgtaacgattaaactattagccatatacttctcattttctcttgaacatggttttcttctttgtgtgcacttgatgatttgatacagtacgatatattgctatctaatctcacaactgttgatacattctcagttggaactctgagcaattttgtcccccatttcctcctcggacacatttactacactgctatatatacattttcacaaaaaaacaatgctccagggacattgttagttcatctgaacttgcttctgcagttctacatctgtactgttaagtgtttcaggcaacatcacgacaggagccataaatcctttcagctacatctagggagcgcaactgctgtcctcgacactgtgacaatattctacagagaatgtgattttcagaaaagaaaaaaaaatgcaaagcattggccattggccgcttgaaatggtttttgttttttagagaaagcattggccatatgcatgtgctcctacacgattttagcgactccataatcacaatgtgtgcttctcatgttcatcttccggaaagcatcctctttccccaaaataatagctaataataaaatgactcatatcacattggattaagcattgctatagttcctgtgaattttaattattgagaggacatatcaaatactgtatgacatatgtaagaggtgtcatatctgaagccctgaaacatgtggtgtgagcagctttgaagtgcaatagtacgtaggagtaccacaatttttgttcctttttatcaaccaaaacttaatagcagtagtacagtctaagcatgaagagatgtcggtgaacacatgggcatgtagcctgggggacacgaccataatatcgtcacaggttagcgtaacacatctacatgtgcaaatgtgatccttgcctccgaaaggccatgcagcgtccatgctgcattaactctgacaacatatgataagattcttctatttgtgattaacagcgacacagatcgtgccaggtttcggtccagtatcttgcacattggaaaagcctactgcagaaaactaatggcagaaaaggtcttgagaaacagctagccatcctcacgttccatgacatctaattgcaacgaattcatcatcaagttctattcacaaagttagctttggatgatacatagaatctgaaagcaacataccaacgcccaaaaccaaactggcagcccagaagcttcacctgagaaggcttaaaacagtatgcacagtggcatttgtctccatacacaacatgtacaggtctcattcataacagcaagagcgatattatagcttagtgtaaactgctgcaactagaatatggcaaaatatagtacaccattatagtttgtttgtgccgggcatttctctcatgccgaggacgccaaaagcttattattattcactgtcatctagcaatacctgaagcgaagcctatttcaagttcaaaggtagcagacgactgactttgcattcttacaaacttacaccaaggtccgaacaagaccaccgcaaaaggctagggaaattgcgtcatatgcttgccaccagtcttatgcgtcattaagagcaaggactcctgggagggtcttgccttccaacagttccaagctcgcgccacctcccgttgaaatgtggctcatcttgtccgccaacccggccttctcgacagcagcaacagaatcgccacctccaatgatcgttgtaacacctttggcggtgatatcagccaatttcttggcaattgcctgaattgattaagaacacatttagcttcaaacacaaaaacctgtgctgataaatctgttcaaaaacagtactcacatcagtgccagcagcgaatttctcaaactcgaacactcccataggcccattccagatgacagtcttggtagtatccaaagtttcactgaaagtcttgatggagtctgggccaatatcaaggcccatccaaccatcagggatagcagatgctggaacagtctgcatatggtttcatattgtcagttctacaggataactgcagaattgtagtcgcaagtactctctgatattgtttgtttgctgaatccatttaccaggcaactggccatacagaaggcgaatgctgaatgcagatatttggcatatgacgcagtgaatttaagccatgatttatgaatgactacttcaaaagaacattgccatggcagcaagttcacatttacaatgttgtgctactgaaaaaccattttcatatattcaactatgattgtatgatgcagtgaaatgaaattcttatgcagtgccattcacgaggtaatgaacaaaccttgctctctgcatccgcagcaaacttatcagctactacaatatcagttggaagcaatagggagactccctttgacttggctttttcaataagcgaggtagccaattcgagcttgtcttcctccacaagagattttccaacagcgtatccctgagccttgtaaaatgtatagatcataccaccacccagtatgaggatgtcaacctttgccaaaagactctcaatcaccccaatctttgttgacaccttggatccaccaacaatggcagcaaatggttttttggggttggcaacagctccaacaagatagtcaagttcctagattggtgaggacagttactacaaaattttaaaaggattacatatttcaaaaaatctcaaggaaaaacagcttgaattcattgcggatacaatttaaaagacaatatgcaatttggcaaaaagaatgtagttgatttcaacatgtcttgcaacttgtcactcaagtactgctgcaagccatctgctgcttgcaacttgaaggagtttcattgttctaaatggagtatatcagtaagtaaacaccaaacgaaattatgttcaccaaacagttatgtcaaaacagttcagatggtgaaaatcttgagcaatgcacaaagtaaggaaacttgtgcaataccttctgcatgaggaaaccagcaacagaaggtctcaaatacttcgtaactccctctgttgaagcatgagctctgtgtgctgtgccaaaggcatcatttacataaaggtcagcaacagatgccagcttattggcgaattcagggtcatttttctcttcctccttgtagaaccgaacattttctagaagcagaacaccaccatctggtaaagtggcagccaatttctggacttcctcaccgatgcagtcattggccatcacaacctacgacaaggacatcatcaaaacatggaaatataagatggtctaccagtttgtagtaagcagaattgcagaataataaatatgatttatccttttatagcatacatcaacaccaagaagctcagacaagcgcggaacaagaggcttcaagctgtacttcggggttacaccttttgggcgaccctgaaaagacaaaattgattgcattacaacagaggacaagagaaaacaaaaaggggggcgaaagaacattatcccaagcatagaaacacggttagctgctgcccttttttgaacatacaatttcagtttcatttgccattttaacataacccaattatatggcatggggatttttgaggactactgcactttaaacatgtggctctttctataaccaaaatgttacagaggtggattttgcatttgacttacacaacataggagaaccaaagtttaaagaaaccgtggtgcattacagtgattttgtaaaagggaattgtgcctcttgcaagcaagtgttgggcattgatggaaaccattaataggtatttgtatcaaaattagatatacataataacaacacaattaagtaacaaatgccacattctggtagtaaaatcgcaagataaataaaagatcactcaaaacattactctgtgaaatcatcgctcactgtaatcagtctaaaaatacagtattaaatttatattgacaccttaacctcctatcgtaaccatgaatctgcacatagttaccacttaaaattcactgtgaacctatcaccctttgatgaatcataaaatcgatactgtttatatagcatgtcacatcatccaaaacggaccaccaatctcacatatcacacaacctcatgctcaaacacattatagcaacgtagtaatcctcaccagatggctggccaggatgaccttggcgcccttccccatcaagaacttgatggtgggaaccgacgcgcggatgcgggtgtcgtcggtgatcttctggctgtcatccagcggcacgttcagatcggcgcggaggaacaccttcttccccttcagatccgactccgtcagggtgcccacgctcctcttgctcgccatttctctctcgcgtcactacacgctgcaccaaatccgaccccgaaaatctcaaaaattcgcacgacggccttgcaatccataaatcggagcgatcaggggagatgaggtaagatttacctgccaaaaaaaaggatcgaaatcggtggcaaagttcgtcgccgctcacgagattggggtaaaggagagtttggatacgaggaaggcacgggaaggtgctgggcttttctttatatcgtcgttgcctgcagttgtgccacctgtcaggctccttgatacgtgtgccagtggcatgtggagccagacgaaatgtgggtcccactgcacgtcaaaggttttggacctttcggggtttacgctttcggcgccgtgggttttggatgaaaggatttgttctggtatggacgagtggacgactcagattgtactggagttttgaacaatttttttcattaacaactaatatgagacggtgccatgatttatttacgggatagatctcaatagaaaactgttgaataatggcagcaagtgattgagttaaaaaaaattactagactaacatcatataaaatattaatcagaaaagaaaagaaaaataaccacccgagcagcgtctatacaaaacctagaagaaaactaacacaaaactcatcactagactaacaaagaagctacctataacatactctttttataacaaattatactccttttataacagattgatggctttgggcatgcctttctagtaaccattaaaataaattatccactagagtaagatatagacgtgtttaattcgtagtagcacttcagttaagtaagtttgactaacatatactccattactttaatatttgacttgccaacttaaagtactttgagtaagccacttagccacaatatttagctagaagtctctacttcacttttctgtcaaaaattgctggcatatggttgatttcttaggttcaaaaattgcaaggctagcaccctgtaaaacattaaccaggaaagaaaaaaaccaccaccaccacaccaagcccgatagtgcctatataaaacctaagagaaacctaacaccagaccagttaccgctaaaccaacaaagaagctatcttatatgttgtgaactatatgatcaatggtggattttatacgttgatggacttttcatctatagttgctatgacacaagtggatcccacctttacactcttgagaaattatacattagacatgctctcactacatcaagcatcctagtgattttcatatcctgagaaattatcctacaattgtttgctttgtctgatctattccctatctccctcctttttatatcgtgttttttctaaaagtcaacttcttttagtttgactaaatttatagaaaaaactaatgagacataaatagcagtatgacttaaaaaaagtcaaaatgttttttcaatatgaaacggagtatgcattgcgagtctgcgaccctaataaacaatatgaaagggagtacgcattacgagtctgcgaccctaatcaataacatgaggaaaggtcacatatatagaaatttttcgcataaaatacaccgtttaacggtttgaaaagcgtgccaacggaaaacgagaaaaaaatatgtatctttataaagttagaacgggccaaagtaaaaatgatttgaaatgcgagaaagataaatattttttttaaaaaaagttaaatgctagaacaataaataaattaaaactgatggagtattgtaattgggaaaattcactattttcttcttcaaatctcgagctcgcaatactcaactctatctaggaacgttgttctatcccgtacatgttccggttacagaacagttaatttgtacctcagaaaaacagccactagaaggtcattcagagcagaggggcagctatccatgagaagcttgtaaccctccgttgcagcgactgcgtggaaattctcctgagaagccaagatgaactcgatgcacctagccttgagcttggtacatccatggcgctccgccagagccaacgccatcgcggcggtgtccacgctaatgccagcgtgcaccttctccgcgcagatcagcatcagcctctccacgccgtaccgatccgcggcttcgagaagaccatacgccattgtttcagcctcgacgtcgtcgtcatcttgctccggcaaagtgtcggtgtagatgaagtggagcagggtcctgaagacctctgcctccatgtccttgatctcgatgctctgcgagtctttctccttcatgtcgccgaacagctcggccatgaacaccggcgacctcgcggcgagcacgcacctgtgcgccgcgacaggctcgccggagacgaggaacgtgatgtcggcgccattcttgctcgtcagcatctcgccgaggtgcttctgcaggtcggagagaggcgccggaacgcttgccgccgcgttcactggtgcttcgagcagaacggtgatcgcgcactcgatcagcaaggagtcgtctggttggacgtatctgtattcagacgcatagctcctcgacaccaagaacatgtcctttggttggccattggagaagatggatgtcactatcacctccttgaaagagctggatgcggacgcggcggtttgattgatctgatgatcatcgacaaggcggcatctgaacgtcgccgacacggtgcgctcgccgtcgctcgacaaggtgaagcgcagctttatgtaggggccggagttgcgggagctggtgccgtggtagtaagcggccgggaagacctcgatcagccagtcgtatccgcccacggcgatcgtacacgacgtgaccaaattttgcctgttcgcggtcgccgagtacccgttgatcctgagcagctacacgcgccgcgccgcctgcgtgaggttgatggcggcgttctccatgtctctgggctcaggcgtcgatcgagcgttaactaccggctatatatatatcccttcgtggatttcaaatcgaaacgttttatcactagatttacaaagagacataacttgttacaggagtctgttttagtacccaccatctacaattaataacaggtatagttcgcaaaagcaaaccagaaatatacaaatgtttcggaaacaaggtaaacaacaagggctaaaccatcaatccctaaaaatttcaatgaacatccaactaatttttcgttttttctccttttaatttgtccccttgatgaactgaacttttagacgagccggagatttgcaatgatattgcaccgccgcagtgtcgacgaattcttatgggattctacaaacggacaggtatctgtggaggttctgagcccaaaaaaggagagggctgctacgggatcccgttgcaacaggatagacatattaattattctcttgcacgagtatcataggtatcagatcctaggtattacaggtgttgggtaacaggtatcacagttatcgggtactatgtagctggtaccacaacaggtatgtcttatagaagagtatcccgttccaacaggataccgttgtctaggttttctgaaaaaagaaaaaaaaacctccattgaacattgaaaaataaaatttgagcttgtccaatccatactgtcgtggcagccagcgatgacgtggacatcgcgtcggccgaatccttgatgtgggccgcgtgatcctcggttgggccggggatgtttcgttcatcaagagttcaagacctgctgtgtccaatctgctgtcattaacacgtaccggtatattattatgcaggttcaaaggaaaataaactccatcgtacattgaagagcaaatttctttatgagaaatgagaaatggaataaatttgatcctgagtcagcagttcaactgtgcaaaatcaggttttgcaacaaaacaagttttagcacaaaattttcagaaccaaggtttatcattgtttcagatctccctgccaaaactgaccggcaatgagcctgaaaactgatcactgcattgtgcctctccattcctaaatgtcaatctattttccccagagggatttgattctttgaaggcgagaactactccaatatgtttttctgaaccgggatatacccgtttcaattacagattaaactgaaatgaaaggccctacacagacagagtagcagagggattagacagggttgcgtctaattactacgaattgcccactgcagaagagaaccgtatgatcatgggcatcacacaacagatccaatggcaaaatcacaaaagaaaaggatagagcaaacatataagcaaattgaagatttgtttgctctcagcaagtccgcagcagctcatcgccagcatccaggagcaacttgaaatcttctctgcttattacctgcacaataggaaaatttttgctcagatgccaaatggcccataaataaatattaagaacagagcgaagctagtgatgattctgaaaaaaaaaaaacaggttctcctgcttaaagaaatgtttctgaaaaataaacgtactgattactagtggcaacaggcatgttctcatagcctgaaaggcttgaaacgcagaagcatatttctgcagtgcagtagtagtattgtactaacacgtgagaaaaatacaagaatgaccaaggtaatactagctagtactagtgagtagtgacaaataatgggcttgtacaaagtatgcactactccatgactgggaagaatcaatcaaaacttctagcacaaacagagatgatgcattgccaaatcctagagaaaatttcacaatagaacagttcagctatgacatctctgatacgcacgtacctgcattttaattctttcttccacgggcaaccttgacaaggtcagtcaacaccgagggacagctcgcctccagatgtttgaacccatcagtggccaacacagcatcaaggttttcagccgtgccggcagcaatgaactcgacgcacttggccttcagatgcgagcagtcgtgctgctccgccaacgccaacgtggtcgacaccgtgtcgacgtcgatgcgctcggcgagcttgctctcgcagatgagcttgagcctctccagcccgtacctgtcggcgccggcgagcagatgctgcgccatcgccgtcgccgtcgacgctgcctccgtctcctcgccatcacggtggtcgagctctggaacggtgtcagtgtagacgaagtgaagaatggctttgaagaccggcgcctccatgtccttgacctcgacgcgctccgaggccttcaccttcatcgccccgaacagctcggccatgaaaaccggcgacctcgaggccagtatagccttgtgcgcggcgaacgactcgccggacacgacgaacgtgacgtcggcgccggtcttgctctccaggagggcgccaaggtacgcgtgcaactcggacgacggcgccacggctgcattcgcgctgtcgcccgccgctgccgccgccgcggctatctccggctgttctcggagcacggtgatggcgcactgaacgacgtaggaatcgtctgtgagatagcccgacgcctccagctcgtcccttgccatgaacacggcacggggcgagtagtcaccgggcttgtggaacttatgcgacacggtcttcatctccgacggcctcagcttctgcgtcggatctaccaagcagcagcttagctgggccttcacactgccgctgcctgtgcggggcgcgccgcgcaggacgagcttgagcgtgagcggccggtcgcgcctgccaacccagggatccttcggccgcaggcggatctcccagtcgtgtccgccgacgcaataccgcctggaactgaagaactcgccgtcgtccatggccattgtcaaggagtggcccacgatcttgagctggatgtcgttggagcgtgtcacgtcggtgagctttcccatggcgatcgatcgaatcgtatggctggactggacgtatcgtggagagagggctaggtgaggaagcgagtggaattgtttttcttcagtagctgagtgcttttgtattagagcaagtttaatagcatagtcctccaattcatctatagccaatttaagagcttattcatacaatatttacatactacactattaatatctagtcctacctgtcatacacacactgcatcttggagtccgtgctatagctggctataaatttatagctcactgcttttctttctatttatttatctctttaaaatatatttgcagctgacttatagtctgctattgtatctactcttatactatatcggtgtcgttcattaaagtgagctagtcgatcgttcgatggctcctcgggtagcgcttccggaaatgaacaggcgaattcatcagaccgagttccctctttaattaatttggataatttgaccgatggcttcagtgcaggatagaaattgattccccacttgtggcatgatcgaccaatgcagcgtttacactctaaacccctcccctcgtttttcacgtgtatgtttttcaaactgctaagcagtgcttttttttaaaaaaagtttttatataaaagttgcttaaaaaatcaaattaatacttaattaatcacgtgtgcggtccattttccatgtacactgtttgggtcgggaaaaagagtgtcgaacacagctatgtatgtatggattgagatgtacaacagcactggcaagaagtcaagaacaacccacgacttttcgaacacacgagcgaattattcgccgttgctctagtaatctaatactccatattaatatccctccacaccgtaacgacaaaaatatttttgtaattagcttagaggggtttctaggtccatcaaaaagatgattataattagagctagtgttgtatgttggtcaatttaacattgttgtaatgataaagttttaatggtaaataactatctaaccctatacagcttatcttcatgtcttcctactggctccacttttgatttacgatgttaccacagaaagagcatgatactatgcacaatggtgcttgtcagggttacgggtcaggcatatcccctacccttcgatatacgatacgtatcgacatggcatacccacgcgcatgcggatatttcctttatgatctaaggaaacctttcacgaaatcaatatacgggaaaaagtccttttcggacaagaactgggttacctacgtatcgtgctaggtctgatatgttcgagtcctactcggagagtaccagacttgcgatataaaagggaccccccggggagggcatagatcatcgaatctcagaatccacacagcctacgaagccggagcctatgaggagccaagtcgtcgagagctagtcgaatcgactcgactacaatctcgccggatctgacaagttccatcttttcctttgtaacctgtgttttccaccatataatcccacatcaactggattagggctattacctgtcaaggggcctgaaccagtataattcttgtcttttgattgctcgatgtcgtactacgtagatccttgtaccagcgtaccccaataccctctatatctggtctacgggtatcacccgtcgacagtggcgcgccaggtagggggacttggtactcaaggttctactactatgccatcaagcttcgtcgataacaatgtcaacaccagctccagccaagcattctcaacttcaacaatgttggtatggactcaagtcggtgaaatcgtcttcccggtttacaccacgatgccaatctcaaccggtcctccaatgactgaaaacgagaacgcagtggccacaaaccaagacggctccatgtcgaaaaatccacccgttgaaacggagaacggattaccgactacatccaaactcgggaaggattctgatgcggccaagtcttgtcccaccgacataaatcacgggccgacaaagatgacttccgaagctatcaggtcttggtgtcctatccacaaaaccaagaaacatacccttcaagattgctgggtattcatcaacgtccgtgctgaaattcgcgcctgcaaagaacgtggaattcaatgtatttctccgactcgggatgtctattgtcctatccacaagacaaagaatcacgatctctcgagctgcaaagttctcctcggcgccatgaaaaccccgtctcctaagtcatacgtccccgctagggataacggcaaggaacagggagcgactccagcctcagatcgattcgttggggtaatcgatctcgatcctcacgaaccatcggtcttacatcccctcgaagactacgggtcatcgacaacaagtgcgccgcgggaggtattagttatcgatgacgttggcacgtcagcgcaagccaacgcagaagcggcgaatcaatcgactactctagtccagcacatcagggctattcaagctatactgagggaaactccttacgatcccgttctgaacgacgacctcgagcgttggacagaatgattacgggagtcggtgactaacctcagcaatgcgttcaaagaggctgctaccgcagcacaccaagatcagccaccaatcggcgacgccaatggtgaagatccggagcggagggaattgcctcgacaggctacccctccacctcgtggcactggcgatcttcgagatcaaattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcatcatccgcgtcctcttcatcgtcagacagacatccacgaaggtcacgcgaccgccgacaacccaccgccccagcgctgggtgtagggctttcggtcgttccctacgtgatgtccgatggcctgagagattccgacccggggccattgaaaagtatgatgggagcaccgaccccgaagaattccttcaagtctactcgatagtgctttatgctgccggagcagatgacaacgcattggcgaactatttaccaactgcgttgaagggttctgcacgttcatggctgatgcatcttcctccctactcaatctcttcgtgggcagacctgtggcaacagttcatcgccaatttccaaggaacatacaagcgccacgcgatcaacgacgacttacacacgctaacacagaactcgggggaatcattgagggaatacgtttggcgctttaacgagtgcagaaacacaattcccgaaattatcgacgcttctgtaattcgcgccttcaagtccggtggtagagatcgctacactacccaggagttggcgacaagacgcatcacaactactcgaagattattcgagattgttgagcggtgcgcccatgtggatgacgcgctaagacgcaagaacgacaagccgaagactgggggagagaagaaaccagccgcagacgcctctgagtcaaataagaagaaaaatcgcaaaaacgggaaaaggaaagctcaagcggaagtcctcgcagcagaatacgtgaaccctcccaagcgcccagacccacaaggcagcgatacaaagaaatcatgatgccccatacacaaaacggacagacattctctggaggattgccttgttttcaaaaagtcgctcgagaagcacatggcgttcaaaaaaggcaagcgagtacgtgttatcgagaagaacgaggagacatcttctcacgaatcggattctgcgtacccagactccgacctccacgtctcacacatcttcggcggctccacaacgtactcctccaagcgggaatacaagaaagcggaacgtgaagtctgttcgacatggcagggggctgcacccaagatgaagtggtctgagcagaggatagagttctcggatgaagaccaccccaagacctctgttatcccaggacgatatccgattgtggtcgaacccactattcggaacgtcacggtagcgcgagttctcatcgacggtggcagctcgatcaatctcctcttcgccagcactctagatgcaatggcaattccgcaaagtgcgttgacaccaaccgatcaacccttccatggaattactccccaatcatcgtccagacctctgggcaagattacgttgcccatgaccttcggccaagccaacaacttccgaacagagcagatcaccttcgatgtcgctgaattcgatacagcttacaacgccatcatcggaagaactgcacttgcgaagttcatggccgcatcccactacgcatatcaagtgctcaagatgccgggaccgaagggaacaatcactatttaggggaacgcaaagctggcggtgcagtgcgacaggcggagcctcgacatggtcgaacaaacgcccaccccacccgccacgtctgagccaccggagaaagtgagcaagccaaacaaggcgccgaagccggacggcaccatcaagatcgttccgctctccagtgctaaccccgacaagactgtcaaaatcggggctacactagatgagaaataggaactcgcgctcatcaccttcatccgcgataatgccgacgtgtttgcttggcagccgtccgacatgccgggggtccccagggaggtgattgagcacaaacttatggtgtgacccgatgccaagctagtaaagcaaagactgcggagatttgcaccagaccgaaaacaagccatacgagaagagctcgacaaacttctcaaagctggcttcatcaaagaagtacttcatccagcgtggctagccaacccagtcatggtgaggaaggccaacggaaaatggagaatgtgtgtcgatttcacagacctcaacaaggcgtgccccaaggatcactttcctctccctcgaattgatcagttggtggattcaacagccggctgcgagctattaagcttccttgacgcttactctggctaccaccaaatcagcatggcaaaagaggacgaggagaagacagcgttcatcacgccgttcggggtattttgctacgttaagatgcctttcggactaataaccgccgggaacactttccagcgcacggtccagggcgcacttagcaaccagcttggcaacaatgtcgaggcttacgttgacgacatcgttgtcaagaccaagacaagtgactcattgattgacgacctgcgggaaacgttcgacaacctccgacgatatcgcctcatgctcaattcagagaagtgcacattcggagtaccgtcgggcaagctactcggattccttgtttctggtagaggaatagaggcaaatcccgagaagatcaaagcaatcgagaacatgaagtcgcccacaagactcaaggaggtacaaaagctaaccggatacatggcagcattaagcagattcgtcactaggatgggagaacgaggacagcctttcttcgctttgttgaagaaacaagacaaatttgtatggacacgggaagccgaagaggcatttattgcactcaagcgctacctatcaaacccacctgtactcgttgctccccaacctaatgaagaattattcctttatattgccgctacgccatattccgttagcactgtcattgtagtcgagagagagaaagtacatcgaccagtttattacgtcagcgaagctctccatgatgcaaagacaagatacccacagattcaaaaactgctctacgcagtcatcatgacatcaaggaagctacgccactactttcaagcccacagagtcacagttgtctcctccttcccctcagcgaagttgtgagaaacaaagacgttgtcggccgcatcgcgaaatgggtagtcgagctaagccaatttgatatccactttgtgtcgcgaacagccatcaaatctcaggtactcgccgacttcgtggccgattggaccatgccagataacaagtcagacaaccaaggcgacaatgagacatggacaatagcgtttgatggcgcactcaacagccaaggagcaggggcaggatttatcttgacatctccctccggagatcaattcaagcacgcaatccacctcaacttcagggcaaccaataatactgcagaatacgaaggactactcgccgggatacgagctgcagccgcacttggggccaagcgactaatcgtcaaaggagactctgagctagtcgcaaaccaggtgcacaaagactacaaatgctccaaccccgagttatccaagtatcttgcagaggtcaggaagctagagaagaggttcgacgggatcgaggtccgacacgtctatcgcaaggacaacgtcgagccagacgacctagcacgacgcgcatccagacgagaaccgctcgaccccggcacctttctcaacgtcctgacgaagccatcggtgaaagaagttaacggtgagtctggcccgagcacccccaacattagctcggaggtcaccgaggcagaacgtgacgttgctgacatcgaaaccacagacgactggcgtaccccattaatcaaattcatcagcagcgaggaattgcccgaggacgacacagaggccgagaaaataacccgtaaagcaaagatctactgtatggtcggtaacgatttatacaaaaaagcgccaaacgggatacttctcaaatgcgtctctaccgacgacagcagacaactcctcttcgacatacatgaaggcatatgcgggtcacacgccgccggtcggacattagtcggcaaggcctttcgacaagggtttttctggccaaccgcccttaaagatgcatgcgacatggtccagcgatgtgaagcctgtcaattccacagcaagcacacaaagctacctgcacaagcgctccagacaatccctctgacttggccgttctcgtgctgggggctagatatacttgggccattcccacgaggacagggcggctatagattcctatttgtggcgatcgacaaattcaccaaatggatcgaagcactacccactggggaaatcaaggccgacaacgccattaagttcatcagagggatatactgcagatacggactaccgcaccacatcataaccgacaacggctctcaattcatcagcgccgacttccaggattactgcatcggtttgggagtcaaaatatgttttgcctcggtctctcaccctcaaagcaatggacaagtcgaaagggtaaacggcatagtactacaagggataaaaacccgcgtctacgacagactcatgtcacatgacaaaaaatgggttgaagaactcccatcagtactattggccgtacgcaccacaccgacaacatccaacaaggaaacacccttcttcctcgtgtacgggtctgaagccatgctctctggcgagttacgacatcaaagtacacgagtacagaagcattccgacgaggaacagcgagacattgatgtaaaccttctcgaggagcatcgtgagcgagttgctgttcgagcagctagctatcaacaagccctccgctgttatcacgagaagcgtatccgagcacgcatactttcgatcggcgactatgtcctctgacgagttcaaacccaagcagggcaaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacaccgtacctgtaagcacccttacagtatcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgtttcaaggcctcatcgatacgcctgccgatgccatcgagttgggcacaggccccgttgagccacgagatgtacccggtcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaagtaccggaattatcgctagtgactcgggctacccgcgctgctgaacatcctcgtcaccagcatctctacaatcgacaagaaaaacttccgaaatcaacactgaacaaggatggtaatcatacgcccgaaagcaaccagagttcaagatttgcaaattataaaaaatacaagaagtcctactcttcaaaaagggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggtgaggacggcctctgccagactacgaccctcagcgggatcgctaacagggccgcttggcgtcgcctcccgactcccgaccacgggcacgacatctgtcgacaccgtggcaggggatgcgctggacgttcctctggatttggcccgcgcagccttcgcccgcgcctccctacaaataaccacgaatcaaaactccatttgaatagaagacacgagaatccaaaagtctgtttactaacttctcgccgatcgtcacaatgcgctaacgtcgcggaggtggaggagacgcgtcggaagcctgcaagacaaccaatgtggagtgagaataaaccttccttgctacacaacatagcgacgaggtgaaattaccgagggagtcgctgccttgcggcgatgtccgagcacatacgagaatttcctcgccttggtcggagctttgccatcactggtggtagcagcgtcagacgcctccttgacgaccttctccttcagagatgccgccacctgatgatccgcgagcggtccgacggggacatcagtcaaaggaagggcctacgctaaatcatatcataagctgatttcgagcagagaaggcgggacgctatcgaatgaactcacattgattgcttcgtcgcgctccgtcgcacccttttcacaaaggggtgcggggatgtcgctcgccgtggtcgggccgctgatcatcacctgaccaacacactgctccacggcttcgctgctcagacctgtcaaaaaggaatcaatttttgataagttgaagagtaacgcgagtacaagcatgtctaaatgaatgcgagaaagataccccgaggagaaacccaggtcgcgtcgtctggcccggaatagtcataagccggatgggcccgagcctggagcggctggattcgcctaccgatgaagtctgcaacgacttcatatcccaataagccctgttctcggagatcatcgatgatgtcgataaacggttggagagagggggtcaaggagggtttggcggtccagaccggaatcttgtccggttgttcctcgggaacaacgaggaccggatttgaatccttgatttcaaggtaaaaccacctgttccgccatttgttgcgagaagagggacattggaaggggacataatgcgacttcatgccatcacgaagtcggaacccgacgcaaccggataccctattggattccatccagcgcaactcgtagtaaaagcggaacagatcaagaaagggctctaccccaatgtaggcctcgcaaagatgcacaaagacgctaaggaaagcaatggaattggggttcaaatgcagaagagaaagcccatagaaattcaaaaccagcagaaggaattcggagggtggagggagaaacctgcagacaactgttgatataaaacacgaggcctgggagatctgcttaactccagtgcaggtccaaagctcgccttcggatgtatgagtgtgccagttgatttgatcctgcaatcaacaagagatagaacaaagaaaccgcaattaatcctataaatgatagccgatcggctaggtgctgatgacatatcatttatttcaagccgatgtcatgcgtacatcgatcggcaaatatcaataagcaattcagaactaaatctactcgatcaactgtagacattaatgatatataatccttatatcagtatatacttaaatcaagtgattgggatagatcggtcgccttgccgagacagtataaatcacttagattgaaatatatattaatagtaggattatatacattcataacatagctgatcaggtaaatctagcatgtatcggctaatactccgataccactctatactaagatattaaagcaagtagaatataccaaacataagcttaatatacttagatgcaataaaatcttaacataaagggcagatttaacgtatcaatcaagcatataaaataaaattagttaaatcagataagatcggctgaaactccgatattaccctaattggcaaccagaaagcaggctagagattgcaattctaagcacgacttaatagatcaaactcaactgatgcagcattaagtatgaaaagaagaacaatatctagataatcaagccgctggaagttttatagagtggtagatatatcacataatctaagttaacgtcattgtataacctaatcggctgccttccattagcagatgttagccgattataggttagataaagatattatcgaagactatatgagatatatgataactcgacgaattatatagacaagattagagtgtcataaagatggaagcactaatcctgagaacataagtcgtcatgacaagttttacctctttgttgaagatcgaaaccgatgtagctcaacccgagagcacgaactcgtcgaaataaaagtaaagcaaaaaagggtggcgatgcgccgagattgtattggatgtgttatctcttttttatatagggctcgggtctatttatacacgagaattacaagatacgtccataacggacacgactattatctctagcaaactctaagataccataagtctttacggcagactttttgcccaaacatatctctaaggaaattacatagaatatcctaattaatagatacaattgccttcccaggactctatccatgcatggcaatcaccttgaagcacatcaacttaaacccgatgacgttcaccgggtcatattatcggaatcagctgtatcggctagccccgtccaactcgaactctgccgatcctgaccttagctgatttagactgcagccaatttttactctgtctccgcaacgatcttcatcttggattccacttcgatctgatcttcatctccgatgccaatagtgatagaatttaccaaatttggtcgttaacaacaacataatcttcgatcgcaaccatgcgacctaagatgggctgaggattagtacctcctgctttcctctccgccttttcacggccaggaagggcgccgtcctcctggagcttctttagggtcgcgctggtggaagccgacttgccgagattcatcgctgctgaaagatcgccggagatggacctagagctggcgaagctagggttctttacggcagcggagaaggtgaggagtgctaacaggtggtgtgtttgacggagttggcggacttcaaaacgtgcacccaaaatccctttaaataagcgcacccccaacggtgcgaattccaaggaactgagagaaatccccgctggaaatttctaagtctattacgcgcggcagtttttggacttcagttcaaaattcactcgtgactgttgggcttcaaacgggatgctcgactacacatcaactccgcgattctcgcacccggaatgataacgttctagacgcccgaagtcgcgaatggtcgcatgagttcgtttttgagcaaaagtcggaggctactgtcagggttacgggtcaggcataccccctacccttcgatatacgatacgtatcgacatggcatacccacgcgcacgcggatatttcctttatgatctaaggaaacctttcacgaaatcaatagacgggaaaaagtccttctcggacaagaactgggttacctacgtatcgtgctaggtctggtatcttcgagtcctactcggagagtaccagacctgtcatataaaagggaccccccgagaagggcatagatcatcgaatctcagaatccacacagtctaagaagccggagcctgcgaggagccaagtcgccgagagctagtcgaatcaactcgactacaatctcgccggatctgacaagtttcatcttttcctttgtaacctgtgttttccaccatataatcccacatcaactggattagggctattacctgtcaaggggcctaaaccagtataattcttgtcttttgattgctcgatgtcgtactacgtagatctttgtaccagcgtaccccaataccctctatatccggtctacgggtatcacccgtcgacagtgctacacttttgaaatcggtagccaatagtctcttattccactataggtggcgtagttccattagaattgctagctaaagaacattatgtggtttaacgctagtccataataaagagaagttggagatttgtctcatcgccttatttctcattttaattttaattttatctttacccttttttattattaaacttatgactgtgtgtcttatgatagaagctggagatgtaatccattttcattatctcaaatccagtactccatacacgagtacatgtcggatgtaaataaaagcacagattgtgcactgcattagcacacccatcacaagttcacaactcgcgagtcacagatctaaggttcgttgctcgtcgtgactcgtgacgaagtagcaaacaacgataagaaaagagttctcaacggttggcagcatgcagagcatgcgttacatgacagcacaatctgcactacaagcatcgtcaaatccaagcatattctcgcaaatctgcttgagcctctccagcccataccgacccgcggcttcattcaagctcatcaccatcgtcctcggcagcaggggatcagaaccatcctctctccagtcgagctccatcaacgtgtcggtgtagatgaaatggagcagcgccctgaagacgccggctctcatgtcgtccttgacctcaacgcgcaccgacccatccttcttcctcgtgccacctttcaggacggcggcggcgagggacggcgacctcgcggcgagcacgcacctgtgcgccgcgatggacacgccggaaacgatgaactcgacgtcggcgaatctcccgctccgcagcagctcaccgagctgcaggtgaaggtcgggggacggctcggccgagttgatggtgttcttgctgagcaccgtgatggtgcagcgcacggcgaaggagtcgccggtgatgaaacccgacgcctccagctccctccgcttcacgagcagaacccacggcgagctctcgttcgcggacccgaacgcgtgcgactgtcgctcttctcctcggaagcatgggagcgcgtggtcgacgggtgcaccaggcagcagctgagctacgccttgatggcgccagcgtcgttgtcgtcgtcgtcgccgccggcgcgctgcgcctgctcgccgatgccgaggaagacgagcttgaaggcgacccagtagtgccagtgcgcatcgtggcctggggtgtagtggatctcccacgcatacccggccacggtgagacgcttggaagagacatgctcgtgtttggccatggctttcgtggccgagtagccattgacgttgaacttgtggacggcgcgcgcggcctgggtgaggtttgaggagggcgccattgatgcggatcccaggcaagctagcggaggcgaacgagcctgagcaaagggagcgttatatacagatgtctgcacggcttgggtgaacgcgaaccgttgtaccgctctcgagagtgtttcgcgaatcgtgcttgcgttttcccaggcagcgctctgttaaatccagagattttgagagatctttccgtttcaacgcgcccttctaccaacgcagacttgagactgactgtggaaggtacttgaaataagttcacttaaggtcccttaacttgtgaatgtatttgatgttcgtccttcaaccgaaaaaccagatacaacgggtcctttagcggttttgatgatggttttggctgatgtaacacatacatggctagtttaactctgccttcgtccttggtgtagatgatgtggcaacggaagcaaaatatataaaaaaataaaaacaaaaactgcgaggcccacatgtcagtaagacaaaaggaaaaatagtacgatctacatgttagtgggtcccaccctcctctatccatgccatggacgacgggagacgatggaccgccggaccgcgtctccttctctctctctccctcccggccatccttcctcggcggccggcaagcgcgcacggagagggaaaaagccgacagccgacgaggggggcggagacggtcgacggccgccgctcgctgtgaggggaatgccgacaagggcagagaggccggggggctgccgctcctcttctgcccactcgccggctgccgaccccctcgcaccgttgctcctgtccctccctctcgtcggccggcgcgcattgcctcctccctcgcagcgctcccgtcggacgccctctccggcagcgctgcgcgcgcagccgctaatctccctcccacccgtcggccggtgtgcgccgccgatgctctcccgccggcagctgcgtgcagctcccccctgccgctcctctccctccctcccgccggccggcatgcgtcaccgctcctctcgcgtcggaggtacgcgtggcgtccttggcgaggtcgtcgccgctccgcttgtgcctctgctctgcccgctgccgccgttgctccgctgcgaggacgagggagagcagagaggaagaagagggagagccgagagggcagggaatgacttgtagggcccacgtgggccccaccagtatttttttgtgtagctgacatgtgggcccacgtgggccctgctatttttaaatgatattttgtgtagctgacaagtgggcccacggttttattattttccaagatataattgccatgtcaatgccacgtgggacggagagctagtcaaacctgctacgtagacgccacataaaccaaaaccactgagggacccgctttggttttgatagttgagggacccgttgtatctagttttctggttgaaggatggaaatcagattcgttgacaagttaagggaccttaagtgaacttattccaaggtactttgacgcgagacgaagctgtggcccaatttgaagccggcgtgaggcccatgaaccaaccacagtttggccccattttgatggttaaaaaaggaataagttcatctaaggtcccttaacttgtcaacgaatccgatttttctctctcaaccgaaaaaccagacacaacgagtccctcaagtatcaaaaccggtgcagatgaggtccctcggcggttttgaggccagttttggatgacgtggtgcctatgtggctaatttgactcggtcttcatctgacgtggcgcttacgtagcaattcgacccgaaaaaataataaaacccgtgggacccacatgtcagtttcacacataaattaataaaaaatggtggggcccatgtgcgccccacatgtcattctcacccctcttcttcttcctcctctccctccatctccctctcttcgtctctctcccctatcctctctccaggtgcgacggagaggcagcggcgcacggcggccggcgggagagaagggagcggcgcggcggtggaggcacggctccggcagctgtgggcggaagaggaaggggcggtgggagttggccctggctgcggcagacggtaggacatgagctgcacaaccgaggccccgccggcgccgactccttattgatgtcaccggcgccgccaaggctgacgaggtggacgcggtggtggtggaggaggaggaggacggcggcgcggcgcggttccatgagcggaggctggtggtggtgtttgtgctgccgtcccagccgatgtgcgccacgtgctggcggtggtggtccgccgcgccgccaccctcgccgccgccgcctagacacgtacacaacatcactaataccaaactcctaaatcaccccgcaaaaaacaatcgacaagatagagcagaagtgaagaataagcatccaagactccaaacaacgaaccttggggcttcttgccgctcttgccgccgccatcgacgacgtccacgctggatccattgcggcaggtggagaaggggatcacgatgaaccggtccatccgccgctgctccttgccactattactcatggctagctagccactgctagctaagctgatactatcttggaatcaaattgcttgccgctttggctgaacctgtactggtacgatcatttttagtaaaagaaagggttaattaagaaatggggttcttgacccttgctaaaaaaaaataatcttggaatcaaatcaatgtctgctcctcgctggcgtgcgctgcgacagcggccagatgctgagcgacgggagcagcacctccgcggccttggcgactggtgccgcgggagcggcgggccgacggcggagcctccctccgcggccgacgcatgctggcttccctcggcggcggcggcggctctgggggcgtcctccgccatggctgcgggtaagtgggagagggagagatctatggcgtggagaggggagagaccgagagggagaaaagaagctccgccgccccttcctcttccgcccacagccgccgggccgtgcctccgctgtcgcgccgctccctcctctcccgccggccgccatgcgccactgcctctccgttgcgcctggagagaggatcccaatccgagagagagattaaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctaagggagatggggagagagaggaggaagaagagggatgagaatgacaggtgggcccacttttttattattttgtgtgtggaactgacacgtgggtctcatgggttttattattttttctggattaaattgccacgtaagcgccacatcagtgcctatatcagataaagaccgagtcaaattagccacgtaggcgccacgtccgccaaaaccaccctcaataccgccaagggaccttatctgtacctgttttgatagttgagggacccgttatgtctggtttttcggttgagggacgaaaatcagattcgttgacaagttaaggaacctcagatgaacttattccgttaaaaaatcacgcatgttttaagaggggaaaagtacaccgaaggtccctcaacttgtcatcgagttacaaaatcatcctccaaccgcaaaaccagatttcggtcgtcccttaattaatcaaaaccggtcacaatagatccttcggtggttttaaccctggttttgtcttacgtggcggctgagtcagtgtggaccgacgtggcacccacgagtcaggatgccacatcatctatctcattcctcctctctctctctctctctcactctcctcttctctgggcaagccggccggcggctggaaaggaggtcaccgggtgaggcgggagaggaggagagcggcgccgcgacggcggctggctgcggctgttccatggaggccacatctcgcgtcagcaacaccaacaaccacccggcggcgacggcgaaccttctcgttggcggcgacgacgcggccgtccacggggagacagccattgctcgcccctgctgccgccagcttctcctccgcctcccgcgcccggaacggcgacagccgcagcgcacgcatcaggcggtcgcagcgtttccatctcactgtttcagttccagacaaacgttgcaatggcgagcacaacggcagcaacaacaagtgagcagttcccaccggcggccatggggcccgtcaccgctgcgccgttgctggaagaaccgtcgtactaggcagtgacaacctcgaaacagctgacgatgcatacgacgagcagcacgagcgcaatgaccggcttggaagaagagcgctccatcttgttctgctttcgattgcatgttcaaagttcagaactcagagcagagacgatacacttgagcattttgctcaaaatggcaggatttatatagaattgcttcatggaattatctgtgaatgttgacatggtaaacatagtacatatgcacacaagtttgtccttttctctcgatcgtgttctgctcgccaggttgagttggggttgatctggacggctggtttgttgctgcatactcgtctgaaaagttcaacaagaagatgaggtgctggctttgattttattgctggtgttccttcctttctgcctgtaccccaaccaccccgctctcctcgaggcgcagcagccattcgcctaaaaggaaaccagtactaacctcgggatggtgatggccgcgaccgcctgatgcgtgcgctgcggctgtcgccgtctcggcgcgggaggcggaggagaagctggcggcggccgggggcgagcaacggctgtctccccgtggacagccgcgtcgtcgacgccgatgaggaggagagcatcccctcattcgccgtcgctgccgggtggttgttggtgttgctggcgcgggatgtggcctccatggaacggccgcctccccactgcggccgccgccggcagccgtcgcagcgccgctctcctcctttgccgcgtcgccccggcggcctcctccccagccgccgaacagtttgcccagagaagaggagaaagaagaagagaagagagagagtatgaggaggaagggaaagagatggcgtggcatcctgacatgtggggtccacatgggtcctacgttgactcagccgctacgtaggataaaaccggggtcaacactatcgaaggagctattatgaccagttttgattagttaagggacggtcgatatctgattttgcggttgatggatgattttgtaacttgacgacaagtttagggaccttcgctgtactttttccttttaagagatgtttctttttcgaagcattagcgggcacaaggacctgtgcagtcgtgctgaccttgggtgaagcatttgacagaagaattgggaattgatcctatcatcaacgttttcagaggaaacgagtagccgagtactccctccatctcatagtaggtgacgttttcgattttttatttataacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagtaggtattaggtaaacaccgtttggtggaccgaatatacaggtagcagagccgagggttgaagagagcctaaaaacttgctctgggtgaacaatgggccaaccccttctgcttctttgatccgatgctacattccgacgtttccaaaaaaaaaaaaaatcatgacaacgttgcaaacgccatgagaaaagagaacatactaatagcatcaggcatcaattaaatataatcttataatcatacgaccatttcggggctaattaaccacaacataattaagtagatatcgaaatgcatgtataagttaaagtaaagcttctcttggcaaaccagaaacccaccagctgctaggatggaggtgacggcactctggatccaatccatacggacaaacggcatcaaaccatgggtatgctgcctagtgcctacgtactactgaggatctttgagcaccgtgatgacgcacctcattcagaatcacaagctaaaatagccgggctcctctccagatcgtcctgtttaatgagcttaacccagtcagagctctccctggcgaggtgaaatttgcgtgacacagtttcagccctgcagtcgtgctggttcccgcttgcatcacgccaacgtgcctccgtccaagtggagcggtgatccatcaggcggcagctgaacgacgcattcacgcctctcgcccctgcaggtccaaggaagacgagcctgaacgcaatacggtaatcgccatgtgtgatgaacacctttgggtagtagcggatctcccactcgtaaccacccacggtgagtcgcctggacgggaagtcgttttcaccgccggacttggtggcagagtagccgttcaccgtgatgtcgtgaatagccgatgtggcctcggtgaggttccacgatgaaaatgacattgctgccgatcgattgccttgtttgtggtgggttcgcactacggctactgcgagcgtgagatggcaaggctcaagcaactccttctacgagtaccctatatgtagatttgtagaggcaagtggagactggattaatatcggaacgagaggagcgcatgcgacgcccgggttgaatgtagaacgcgaatcgtttggtcactctcgagctaggcgtttcgttattctcaccgacgggttctttccaagggattaacacacgcctaagagcaggtacaatagcagactattagccagctataaacatattttaatgagataaaagatgagagagaagagcagtgggctacagatctgtagccagctgcaacacgaactccaagacgcagtgtgtgtatgacagtgagaccatatactaatagtataataaacaactattgtataaattagctattaaattggctatagataaattagagccagtagttggctataccattaaccttgctctaagagcacccgcaatagtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatagagagcctatagataaccattgtgggtgccctaatactacatgcataatactacatgcagtcatgatgacctgtgaggctgtgactgttgggaggagaatgaaaattgatgtcaccggcaatccggcagtcctgcagacgggcagaaaaaatgtgtctgcaatgtgcagactctacttggtgcatactgtatgcagtacgtaaatttcatccaaatgccaaatctgccaccaaacgccttggcctcatatgccattcaacatttcatccagatgtactatacactacggtgccgttcttacaagtttgtataacttgaattccatagttcagactgcaacaatccgaaatccatgaaaagtataataacttaagggtgaattaacttaaattctaaattagtactacagttcatggaacagatacttcctataacttgggaagttctctgccgaaaatcagttgttctgctcagggtacccttttgactgctccagggaatcagttgtgttccatgtctcttagttgacgtaattttgtacaattgcttccgcacaccagtcgtgcactcgtgcttccaatgttatgcctggcgacaaactgccagtgacacttccacagttcaactgatgctacacgttggagcagatttcttcgtaggtattacctccttcctgaaaatataagggatttttgcattgccgaaatcccttatattttgagatgaaggtagtaacatgcttttcgtcttccacgagtttatatagcctaactgccagagtgtctcacgatataaacgtccttccatttgttgttattggtatttcatgacggtcatcgtccaaccacttcaacctgttgctgcggttgagcagcctatcccaccatgctgctcaggatttgtagcttcgaacagatatactgatctctgctctttccataaccttacaggtgaacagcaggaatgagttcatttctgcatccggaagttggaaactgtaatgttgggggaaaggttaaggatccgttaatcatgatatcaatatggatttgatagtttaatatacgtaccacgtggtgaaacccactgtcacatggggagcaggaacaactatccctgaatatatgtgcattctgcgtgcagcaccttcttgttcctgaattagccatttcaaggctcccccagctgccaagttagagcaggatagaagttacaatactttggaacacaacttcaccaaataacgcacttgaatatgggcagtttgcaactttgtatatctatcttacattacttatgttgcaactcataggactaatattagggtgtaacctagcaaatgtagagtgaaacccagattgacatgtggtgttaatagttaccttttttaataattgacataaccattctgagtgtccaggacgcagtacaggacattccagcccaacatcgcttgtactgtgtggaatccctaggctcttctcatctctatagctcatcgaaatcaatacttggcattattttcttcagtaggttgaatgatgacacaggtgtgtaacattctgcactgaactgcagcagctcattttctagaacagtaaaagcatcagcaaaagcctgccatacaaatgatcaaacagtagagttagtaaatatgcgcaatttgttaccaacaattgatgcttgaaggccaaacaaagttagtcctaatacagtatgaagactaaaatattgctttagaaattctgaagtttaccatacacagtatgataacccagaaaatagtaagaacaaaattccagaaggtgagaaaataaagatacaaacaacttaaaaaacacatactgcagaagaaaggtccaatcaaccagcaaagggagaattataagtaaccttgatacattggtgaatgcggaaacagttcctgcccacattattggcagggcaaagaggatcatcaatgtgtattggatcaatgctgcaaatcaagcatatggaaaaattacagaaggcaatagttgacagaaacagataaactgatacattgatatttaattttatcacctgtgacctctttctcggttcaaataaatgccacttccttggatagagatacgcatatggcgcggatcaaatacattcctgatatccagattactcactaattaaattccatcttagatgataattatattactactccaaaacgattgcaatttgcacaggataaatcgcatatgagccctatagtctttgaagtttgtgtcctcccttatgtattaaaggataaagtgtccagatgtatttttcttacccaaaaaagtataggaaatccatcaaaaggctgcccagattctgtcaaacatgaaggaacagatatgaaattaacttagaaggaaataagaaaactgaatttaactaagagagattgaaaaaatgactttgcctgttgttacaagttacatgaaggctgattaccaaaataacaaccggatgatacagaagcaaacgtctaataggaaaaagatacaagaactagtaatgaaatagagcatataaaaaacccttcttctctattcatgatttgcaacttacttggttaatgggccgaccaagatgatgctcatgctgaagaaaacgaacgattaacagtacctgcaaaggaagttataaactggaggattatttttcagtgggctctcaagataccaatattgatgcaaataatctggatttgcccttaattgaaagagagaaaaaagaaatggaagaaaggaagatcagcaagtatgaactactgtacaaaagtggcaaggtacaagcacaaattagttagctgaggaccgtactttactgggtctgttctttaaggctaagtcatacagtgctagataatactatggatagaaatgcatctgattaagagggttaatccagaaaaaaaaaacctaaatcaccaaatagtaaatatctgggactaatctactaaagttaaggagaaaaaaaatagctattcactcataatgtttttttattattatagcaacaatttgaacggtaaggtgtcagtttaagttcatgacatcattcacacctaagaaagttatccagagagtaatagatagccacgacaggaacagcaggtgttatgaaaagttacataccaaacaatatgaacttagaccaccagaatatgggtgatccaaactccggtcagccaaaaacttcttcagtattaaggcaagaggcacagcagcaggaaattgctgagttaattcacagacctgtaagtgaaaaaagaaggtgaataaatagacaggggggccttaggtctcatgaaacattgtttgatagatgtaagcttgtgatctgcaaactttcttactcatgtccttatgcacaatatctagcgagcaatgtgtgcaatatgtgcatatctcaaacctaataaacagctggctggttgctcattcatgtatatataagacttaatgtctaacaaaaccatgtcattgtggcatcaaatcctacacactatgaaaaaatcaaaatgttgtaacccattggttcttcaaacatattctttttctacaagatctcagtaaagcaaatacttatggcagattgtaaagaattattcactccgagagtaacataattatttcatccatatgatccgctaaggtgacagtatatagaacatttagcattcatttgagatgacatgtgacagttgacaagaaaacaagagcatgctgataattataactgtatgtatggtccgcatgtgacattttatgtactgcaataatttatatatgaatagtaaatacactttgaattgacatcatgcattcagcataatttattgcaatactaaaatggcaacatcgcacaggagccatggcaaagaataaataattagaaccacatacgaaaggtaatattctatgaatacaacagacagtatgacatataattgtacttaattatatacatatccaagaacctgtattgcaagcgcatttatgctataaattccttaatgcttatgattcattgttcaaagtctttgcatgaaggttgattctaaaactaacaaatagaaataaaacttattttcttcaaaatataagggtagatagtaatcttttttaacttaccaactcagttgtctggagtcctgtgtgggatggtgatttgaaacttatatcaagacgaattgactgcacaacattgccatcatccttgtttattcttgaacacattggcatgctgctaccttctgaactagagttgtcagaacgagaagggctcccttgatctccaagcacattgatggataattgttcgtgtgagctatccagaacagaagaatattcactggacaaatttgtgtcacagggcacttgagctacaagcatgatcacaggtatctgcaaatttaatgacatacgtatgaggaaaataaaaaatagctggtgagctagcaaatgaaggaacttaccgccgtgttttcaactgttttgagggaatcagtcctaacccagtcctggtttgcaagacaccgtgctgcatgctgaaacaaacaaaaagaagaagaagaaaagactcaatgtaaaatattttcttgaccgtggtctaaatattactgtagtaacgcgcatagtgttcagtaattagctaaaagccactaattcactgcgccacgaagatgcgcaggcaagaggaaaaaaaacatgtgcatcgcaagccatgtaacatgaaaacttatttaatatctagaacaattatgacgaattcactcttctaatagtagcatgttgacccccacacatgcattcttctaaagaatgtaaactaagacagataactccgatataattcatgcatttcctcctaatatccagtttcattgcattaataacttggcatccagaccttaagaggataataaagcgccattgtgcacaatacaatcaatcattaacaacccaaattcatcacaacaaagtaatttgctaaaattcgataatatgccatcgaccagtttagaatgcagagtaaacagcatactgatactagagaatgcgtcagtctgttagtcaaggcatcttacctggagacacgtttccttgatgccattcctgccttccaaaatcccagcttcttttataggttcctggaagcagccacaacttagaattgcacactatggcatgtaggcaggtacatttgaactaccagttacatgcataccgatagtaatgcaactcaccaaattacgaactggtggaagagaaattacaagatctacatcgcttgttggaagagccaaaccagtggcatttgagccaaatagatttgtacgggaacgaggccagagaacttgcaaacaccgtgtgacccttttgacagcccaattaatatagggcttcctcaccagattctcggcagaaacctaagtatcacatttggaatcagcaaataagaattgagatctttttaccatactataatggagattttcaaggactcaaaaacaagccatggcatgggattacttggcatcagagtaagtctttgattgtttgatctacggctaataagccgtggaaaaaatgaactaagaaccaaaagaaaaaattataggcagaactttttatatatgtgtgcttaacagtttaaaagccaatgctggaaaataaaactacgatgaaaaaacctcaaaagcaactctaaaattaacttttaatatacaaattttggttgtggctgataagacaacaagcagaaaatgggaggctaaaagaaaaagatcacatagcgtacatacatgaaacttgtggcacaaaaaggacatacctgcttacagaattgatctatctcttcgtgtagtgcattgtgcatcaaagagagggatgccttgctagaagaacagtttaacatatctggtggttgcagaggcaacgcaacatctggctgcaaaaggcataagttagaaatgcacaaagttgcataaataatattttctttggatcacgggcgtccttacatgttgatcacgagaaagctgtgaaatcttaacaaggtgatcctgcaagacagtatcctcaattgattgccccagagtaccagcaggacttcctttatttccccatgaaggccatacgacttcaggaccatccaagcaaaactgagccctgttcaaaattttgtcctcagtaaacaaacttctcatcccccaatgtcttgggcttgagctgccagatctaacaatagggaatcctcgttttcgtgactctcccacaggagaaggaggcggcggcctagggactcgaggaacactaagtactactggcgatggaggtcttcgtacaagaggaatatccctcctgtttgaaggcacacatgggctcctgtgatcatgaccccccttaaattcagatcttgatggtcttcgtgatattggaacaactattggccgcagcattgcatatggcaatgtatctccctttatcacttcgctgccacaagatacactctttgaaactggaaatagttttagagtcagaccgtcaggcatgcaagatggagactgcaacgactcactgttcatgccatttgctgtcattgaatgaccaacagactgagggagaggatctggagattcattttgggaacatactgaagtggaaggtggtgaagacacactatttgcattatatgtacaaggaatcccaacaggtatgtcatcaagaacttgactaacatctgcctcatgccaagcccatgcactgtcatctgagctaagagatggtggcctagaaaaaccagttccggcatgctctgcaggactccaatacataactcctcctccaaa

SEQ ID NO: 58270 - DNA, 6768 bp, Oryza sativa
ggcagacaaattgtctagctcatctgtgcaacttacagatataacgaatggcttctctgagctttttgctatgaaggatacctcagagatcacatgtgtgaagaaggcctcctacctaacctcatctgtaatgaaaaattttgtggttccgaagctagagaaggtgattgatgaagagaggaaagtgacacactcttcattgatggatgagacagaaaaggctattcttgatcctcttaaggtcaaagtgaagttgaaggctgaaaatgttgacatatgctatcctcctgtatttcaaagtggagggaagtttgacctcaagccaggtgcctcaagcaatgatgattatctttactatgactctgcaagtgttatcatatgtgcaattggggccagatatggaaattattgctccaatatggccagaacatttctgatagatgctactcctacacagatcaaggcgtatgaaactcttatgaaagctcatgaagctgctctagaagcattgaagccagggaatcggatgagtgcggtttatcaggctgcagttgacgttattgagaagaatgcccctgaactacttcgtaatctaacgaagtctgctggtacaggaattggtcttgaattccgagagtctggcttaaacttgaatcccaagaatgaccgtatcataaaagcaggaatggttttcaatgtctcccttggtttgcataatcttcaagcagaaaaaaagagtgagaagacaaaacaatactctcttttgttggctgatacatgtttagtgccattggagaacttaacagcatcatgctccaagcttgttaaggatgttgcttattcgtttaatgacgaggatgaagttcttcctgtcaaaaaggtggaggttaatgcaaaggaggcattgccaccaacaaaggccacacttaggtcagacaaccaggagatgtccaaggaagagctccggagacaacaccaggctgaacttgctcgtcaaaagaatgaagagactgctagaaggcttgctggggttggctctggttctggtgatgggcgtggtccctcaaggtcatcaaatgagcttgttgcatataagaatgttaatgatgttccatatgcaagagagttggtcatacaagtagatcagaagaatgaagctgtcctcttacctatttatggcagcatggttcctttccatgtttctactgttaagagtgtcacaagtcaccaagacaaccgcacttgcactatccgcatcttcttcaatgtgcctggcatgccattctcaaacgatagcaatctgaagtcgcaaggggctatctacttgaaggagatcacgttccgctcgaaagatccacgacatagcagtgaagttgttcagcaaatcaaaacgttgaggcggcaagttgcttcaagggagtcagagagagctgaaagagccacccttgttactcaggagaaactccagttgacaagcaacagaaacaagccagtgagactttctgatgtgtggataaggcctgcatttggtggacgtgggcggaagcttacaggaactcttgagtcccatgtcaatggttttagatattctacttcaagggctgatgagcgtgtggatatcatgtatgggaatgtaaagcatgccttcttccagccagcagaaaaagaaatgattacactccttcatttccatttgcacaatcatattatggttggaaacaagaagacaaaggatgttcaattttatgttgaggtgatggatgttgttcagactcttggtgggaataggagatcagctcttgatcctgatgaaattgaagaagagcagcgtgagagggaccgaaagaatagaataaacatggatttccagaactttgtgaacaaggttaatgatcactggtcgcagccacaattcaaggggctggatcttgagtttgatgtccctcttagagagcttggattccatggtgttccatataaagcttcagctttcatcattccaacttcgacttgtttggttgaactaatagagacacccttcctggtggtgaccctgagtgagatagagattgttaatttggagagggtgggctttgggacaaagaactttgacatggctatcgtgttcaaggatttcaagaaggatgttcttcgcattgattccataccatcaacatcacttgatgcaataaaggagtggcttgacacgactgacctcaagtactatgagagcaggctgaaccttaactggcgtcctattctgaaaactatcatcgatgatcctcagaaattcattgatgacggtggctgggaattcttgaatatggaagcaagtgattcagaaacagaggaaacagaggaatctgatcagggctacgagccttctgatgctgagcctgagtctgaatcagaagatgaagattctgacagcgagtccttggtggaatcagatgaggatgatgaggacgattctgaagaagactctgaggaagagaagggtaagacctgggaggagctggaacgggaggcaagcaatgcagacagggagaatggtgcggagtcggacagcgaagaagagaggaggcggcgcaaggtgaagaccttcagcaagtcccgtccaccaccggagcgcagcagcttcaagggaggaccctcaaagaagccgaagttcaggtaaatctaacggtgcttcgccaggcctggctgcttcctgaatgcgcgccctttttgaggggcatggtgtgcttggctgtaagcagaagcgctcctagctgtttctctagatcattacgacactttgtttccgtagtagcgtactgcagttagctgaaagggcggtcggactttggtgaactccatagttgatgaaatgaactgtaaagactcttgccatctaggggaaacccaagttgattcattagttgtatcctcattgatgtaatgttttgtttcctgggtagaatgttgacctccagaatgtataatatttatgttggcggacgtatcttgtgcagatggcaatgctgcagcctcagttgtgtatttctgtcagttgcgtcttatagctccgttccgttctctcgacaaacgggtgctatgttaggttctgtcagtgctctgaaatgtaatgtgtttcctaaaatacggtgtagtttctgtgggacaatattaccatcttcaatgcgacaacggtgcatgcaggaatgtaaatggatcgggcaattgaattttatgctatcacatgtagcaaataaattatcaggaaggtttttatgggggtagtactgggactgctcacatccctagatgcagattacggacaaatgcacttgtctgcctgttgagattacagattacaacttttttttttcattcggaggctcaaaactgttacgacgagttgatcttgatgtcaaatcttcttcccggacaaccagtggctatagaacgcaagcgtctccttgggcttgtactccgggacagtgtgtccagctccctgaaacgtcggcacatgttgttaacatcatcaaatagtacagcttcaaaagctaaccacaagcgaaaatagatgtgttcattccaatggattgtttgtttagacagttgtggtttagcctgaacttgctaatgcatgactgaaaaccgtccagtgtttgctaaagaaaaaaaaaaaaacacatgttgagtgagcaacatccttttggtacagaacatgcagcttatctactggaaaagaaatctggtcacttacctttatggtgaggaaagtgagattgtgttcataaccttgtgtatatctgcaatggcaatatcgctctagtgaggaaaacttgtcaagacattctctcttaatttcttgcttcctcaagtaaaaaaatgtaaacagaagtcttatctacaatctgcacatatacttctaaaattctaggtagaaaagtatgagttaagctgaactgagctaatatctagatgtgacataactcctgaaaaggtatatgaagaactgatgattcctatgaagaaaggatgagaacatacccagcgacttgccctccaaagtaccatggtcgccaatgatcaattactcggtatcccatggatctaacccatgcttccgttccgacatagggaatacagagatcatgatctccactacaaaaaacagaatgatcagtagttggttctcattttatttttttcaaagacaagcacaaatttgaattttaggcctcttcagggtttcccaaaccgacggtaaccgcgcggttaccgcggttattgggcttaccgcggggtacggtaatataaataccgcggtaacctccttaaattcaaataaatttaaaaaataatttgaatttttgataaattttgcacggttttgtacggtttttcacggttaccgcgcggtaaccttacttaccgtcggagcgcggtaaccccggcccgagcggtttaggaaaccctgggcctcttaggctgaagcaaggttcagaaaccgttgataatccctaacccatataagttggattccaaacaacccaacttggtactccaattattttcaatccaaatgagcaataattgtagtactatttgttatttgtagctaaaaattctggcattctgcaccaaggttattaataggaatttaatttaatttaatgtgtagctttttttataggaatttagcactttaaatcactcaattttcaaattacaatcttaatggtctgttgcatacctgtaaataagtgcgcgatatcccatggctgtgaacttcttgtggtacttcaccatgctgtctccagtatcatggtagtactctattcttgcagtatacagttcccatgacccaattaagcttttctgatgtgccattttaacaaggtagttccccacaaagagaagaaagtgaggtgtaaattttaagataaattcaaaatgaaacctttggttcctcgtctatcataccggttccgcgtgaatggcagctcttacatcttcatcatccagccatgcattagcaagttcgtcgctctacaagtacatggaaatgttgatttgttaaacacatgaaacaaaatgttttatctgttgacgaaattaggcacccgaattctaataatttggaacgaaacacagctaaatgtttgatctacaaaatcaaaatgatgaaatttgagacatattaaactaccactccaatttacacaccgtgcaggggagtgatctaccaccaagttcaggccacatcgtcatgcgtccacgagtcacaggagcacggagaggccaagagcggccagccattcgctttctcactggaaatcgcttctctgtctcacctagctttctaaaacttgatggcaagctgctgttcttgaactctaattcttgaatttcagggtgatggtagcagggagcaaggatgttgtacttgttcaggtccttgagttcctgcagttgccagtaatggagcgtttaccaaatttgtaggattgtgctacattgttttgtttacatgtgctggcacagggaagttacccaatgcactctgtctatcttttcttggcacagattattaactttgccccaaaatgtaccatggcatgcagtacttgcatcctgcaagaaagcaactcaaatcattttttagctttgttaactttcatcagatttttttctgtgttgtctatctcctctgacattaccagtgagcacaaccctcgtttaacatattcttttagacagaagtatttagacagattcttttactgttttgaggtgaaagagcacaagagcggaggcattgatttcttgacctcaaacaattcggttgagatgagacccatcccatgtgcaaacggcacaaacgaattgaaatcatagtcctgatcagttgctccattgccaattagatatccctgaaaaataacctttaaattgtgagcccaaagacaattttcgcatgcatgtagagttgttgtatgacgtcatctcccgacaaatgaaaatgggaggaccttaaaattgattcttggcttcagatccttttctatccctgtcaggacataaacaacataagtaggaaacttttgataataatagtttctatatatattttttactgacaaactcaaccttttacaacttcatcagctagtgttggaatgtagatccctgcaaatgactctcccgacatgtagaacggatttgactggaactcagggtataactcaaaccactgcaacaatgcatagaatcaacataaaaattttccgaagtgatattgatattattgcaaccacagtagggagtaggtaccttcagaaggaaggtgtgtgcatcagccgctgtttttaggtcacctgtcgtgtaatctgatttattcaacgagtacgacatcccaacaccagcaggggagtcgaggtacaccacgttggaaacctatttagtgccatatttaatcactcacttgatgttgtatagatattttttgagccaaaaaagagttgatagaacgttaagagtgacttaggtactgctcttttcttcaactccatctcattttctgttaaaacggttttcaaactgttaaatggtgcgctttttgcaaaaaaaagattatatatagaagttagttaaaaatatcaaataaatcattttttaagtttataatagttactccctccgtccaaaaaaacccaacctcatactaggatgggacacatcctagtacaacgaatctggacgtactatgatgtgtcc

SEQ ID NO: 58271 - DNA, 7391 bp, Oryza sativa
ccatcctattactaggttgagtttttttggacggagggagtaatacttaatgcgttgaaaatcaacctccaatagcatcatcaacaatgccaatagcatcatcaacaatgcccttattctatccctaatcctaattttttgggttttggtaaaaaaaatgcctctaacagataacctatcctgatcctaatttgttggaaaccccatccccgcatccttcgctctcttcatttgagggagagcgacaccgcacctccaaccctaatctctctttcccgcgaggttttctctttgtgcgcgaggagggagatcgcgcacgtgtaggagcgatcttttttttttggtgtgcggggtctgtgcaaaaataaatacttcggttggtagtttaacataagagcccactcttagttttttagtttttggaatacttcactcaattaaatttaggctttcttttggagagaggagttttctcaggactatacacattctgtcggtgatgctctcagctacctaatttcttcttttcttaagcttagcacaccaaagctcagtgacaacaaccagacacatgagacatcctatgaaatatgcaaaaataaacacccctgctacgtgacaactaattgtgacacaaatagcggaacaaagcatctgaagaaactagatcagttactactagttgttttatctttgtaaagagtaaaaggtactaaaaattagcacaaagaccacaaaggtgcacacctaatcccccggggattacggagaagaggtttcagaaacagagattaaggagcagagcagtgcagagctatcaccttggaccagctgtaggggttgagctccagatttgggaggccacccggatcgctgccacgctcgaaattgaaggggcctgcgctgaatatgcaaattaatccaatggattggatggaatggaatggagcacttgaatcctaatcaatggcgattaaatcgatggtgaacaaggagattggagcgcaccgttctcgtagacgaagccgtcgaggctggagcatcccgggccgccgttgagccagagcacgacggggtcggccgccgcgtcgcgctccgacgtcaccaggtagtagaacagccgcctcccgctcccctcgtccaccgtcacgtacctgcgacgaacaccacggcgcgtcgtcggtcagatgataagagaagagaagagcggcggcgcgcgacacgagacgcacccggagtagtgcttggaggggaaggcgccatggaagcccgggaggctggcgactaggtggccgtcgggggccgcgacggcgacggcgatggcgatggcgatggcggctgcggcggagagcagcagcagcggcggcggcgcggcggcggcggcggcggcggtgcgaggcatcggaaaggatgatgattaggcgaggcgacgatgggtccttgttttctctttgttggaggttggtggggggtgttaaaactggagtataaaacattggcgccagcgaacagtggagccgcacgtgtcaggtgagggggtggggcccactggagtatcccgctgacatcggcactgagtttgtctccaaataatgtggccggactagggatgaaaacgggttagaatcggtatattattttattatttttttcgaaaacgagcagaaacggtcggggaatttccatatttacgatgaattcatctatttagtgccaacttcgataccatgctgacagaaataaaaaaaacaaaattttgaaaacggtaacatcggtaaaaataatattattatattagttttgcgaaaacggtatcgatacggtcgggaaatttccatactgttttcacccctaggctggactggcaggcgccaccccgttttaacccctatatgcagtactgtcccctgagagcagctataataacaaattataagccagatataaacatatgtcgaggagataaaacagtagagacaagagttgcgtcgcagtgtggggctattaaattgattgttcatgatttggagctagtagttagctatactattaaactggctctgattttgagtagatgatacggagccatggaggtccacgcccaatgcaaagtctgtgtggctggctggttgtctggagctgtggtagagaggatttaatttcgacgagtaaattgtaagttgagctaattatttttatcgaagtttttatagtggagtatgatcactctctatttcatgtttttaattaaagttaggaatatttacctaccgtttgtattttggaccggttgtccgcatgtcagcaaggattagaaggaagaagcttgggagagatgggggctgagctcatcttttccggcacaggtaatgtgttgttcatgtcccgtttaatgccagtagatcaagcaaaggcattaagagaggagcaaggtagccccgatcgagctaaggagaagtagtagctgaaagtgtccttgtggagcaatggtagagcttaagctctaggtaaagggaagggccaaagccgatgttgatggtgtggtggtgatggggaatcagagttggatgcaaatccaccgctgtactgcacctgcagtacgtgtcactggcatgtgggtcccacctattccgggcccatatgtcattggcacttaccgcacatgcattacaggagaggatcccaactcatcagagttaggctgtcttggatactccaacaagagttagggtgtgcttagttcacgttaaaattggaagtttggttgaaattggaacgatgtgacggaaaagttggaagtttgtgtgtgtaggaaagttttgatgtgacggaaaagttggaagtgtgaagaaaaaatttagaactaaactcgggcttagatgaaattttggatactcgtggcacgtttttcaaactgctaaactatgccgtgcgaaaactttctatatgaaagttgctctaaaatatcatattaattcattttcaagtttgtaataattaaaactcaactcaattaaccacacgttattatcacatcgttttacgtgaaacacttaatttttatctttatcttcatcttcaggagattcaaacaccaccttagagaaaaataaacattggatagatggtttttcagacaaagacttcgattaaaaaaaatctggcctagccagcaatttacttaattttattttgatgaaaataatgttattattgattaacactggaatgttttttttttcggggaggaatgtatttttctatggctatgattttgttgctatcattatcttaaaaaaatgattttgttgctatacgagaaattaataataagaaaacacttttggagatcatgttaagtttaaccgtgctttacatttataatcggtgggggcaaggaggggtactgcagttaaggcttggcctttggatggatggattttgggtgccaaaaaaccatggaggggttgccgggttaggtgtgggtcaatgattgatctgatcggatcccatcccactaaaaaaattattttcatgtagcacgtgagaaataaattaagtgtacttaggtgcaccatttaattttaatatttaatagtaactccgttgttgacatcgtaaaatatttgcagtcgatcctcgtagttttaaaacttctgttgatgtaaaaataccaggatttaaaatgtgaaaaatcatattaagtagatttgccttaaaaaataactcttccatatgtttttataaaaataagctatgacaaatacataaaaacaacaatattttcttctataaaaataagaaaatgcagtgttagtatgtctaagattattttgtttttttatttaacaaatagcatccaattagtagagtctccagcaagacgatgctacttaggaggatgttatcaccggatccaagaagagatcatcgaagggttctcatcatggaaatagagactaaggtatgaaattaaaatacacagtttttgtgctttcccctctctttgttaaggaaacagatcccctgactttgtgtagtctacagttataccactgacatgtagaccctactttgatatggcccacatattagtggcacaactccaaactgcacaaagttagagaagtctcatccctttgttacattttctattttcctctgttccaatttcttttggggcacataatcatataatcctgttctcctttcagaacatacacattgctacagccatagccatcaccatcctgagattcatgatgaatgcaacaagatatatatgttcagaaatcacatgcaagaccaaatggcacagtgtcgttttccattgataaggtaccgtaagttggacggtttcttaaacattcttctggctcttttgtcaaaaaccacaataatatgataaaaagacttggacaaaaagtttaacaaagcctacagttccatagaaacttaatctgaaacagaaataatagaacaaaaatgatacttgacatataaatcttcgctattattatgaacaaaatgtaataataccacagcactagactgaatttctttagacttgcactaagctgatttgatactttacagaataactgaaacagaggtcctagaaccactaattgcagtgcagaataaaccaagcaaccactccccaacaagcaaagtaaactggctccgtcttcccatgcagaagaatcattgcaagtataataagctgcacaaatcttgggcaaaatggttatcctaatccatagacaagtacggattttatgctttcccttgcaacttaagtaggctatcgcagatttttcgagacaccatcaaggacaggccactcatcacctgttaccaatgcagtaacgagatcggtaagagccctagtgcttgatttgatggtcaagaaagattaccaccacccagttctatggcattggccaaatctttgattcctgaaccggggggtttatttctagcatctgtattcaagaacaggcagacaacagcgcagtcatcaatttttgatgtggggaaccgtgttctccatgcacgttgagccgattcaacaacaaatcgtgccgctgaggcttctgacttggcttggctgacaatgctaacaacttctgagttggaaagtacatcccacacctacagttaataaaagaaacaaaacaatcatatatcaaaaataatcttccaaccaaaagtaaaatttacttctgtgaacaagcaagatatatgttcaagtaaaatttgtgctcaatggctcaccccatcagttgccaacacaacaaattcatccttttcagtgatgcggtggtaggaaacatcaggcatagaaattagaccataatcctttagacaaaagtctccaaatgctcttgccatggccaaccctggcatgttgtacttcggaagccaaacacgagcaacatctggctcatctggcagagagaatattctgccacttcgttccctaattcgtgcagcttcacctgaaaacatgttttgcttcatttaggggagtaaaagcaggaaacaactatccgatgtgtacatttgtagtcatgcatgccatttagtaatgtagacacaaaatcttgatattacttatcaaacataaactatcattattattattattttaaaataattcacagaaacaagcctttacaacagatactgaagtgtgccaacaatctcagctatgcaggaaaaatatcggaattgatcatttcagaaaaaaagactaatgattttcattatatcaacaattatttgtagaaaactacaattattttttcgaagtcccaataatttcctttaaaaacgcttttcgatgatagttaccgaacgccggcaggcatggcaatgttatcagatccaaagcacccagtcacacctacttgaccttgggtcaccagtcagaccacattatattgaacaggaaaataccagcatgttgggtttgaacggtaaaaaaaacataactaaatcctatgcaggatgttaatagtttaaaacaatagagctgttatctcatttggtacattcgtgtctatgttaacctgtaggtgttggtttgaacctttctgcatgtcctttttatatttagcgcgaagtttggccaggtaaatgttcaacttcctatgccatgtgaaatccggtcaggtcaatctgatttgcctgggttcaaggttctactcagctatcctcatttaaatcaacatacatagtctctccttttgtgacattgcattactatttttgctcaacacatgtgcactgtactaattagttcacaaagttcttcagggagtgatgttgaactgaacttttatatcatactgggatacactatgtaaatagaatgccaaacttgctgcatgatgcaaaaatctgtcattctctaatcaagccagtccttgtagaccagatgtgacgtggcagatcaaatttgtcaccttgtggtttcaatgttaaaagaggtttacttgtaagatctttattatttccaatttgaattttgaatatttagttcccaaaagtgttaaaacagtatttaagaaccaaattcttcggatgcatcaaattgttaaagccctgacattctgaaagaggaaaatggcagtgcaaatcatgttgagtttccacacacaaaataacaggtatataaatgaagcatgtaccatataaaaatactttttactgcaatatcaaaaggtttctttcatcttgccaattgccatacctccaaagaaaaaataaatcacagtttcgaacagacaacaggtatcagtaaatcaaaggcgtgggacagacaactatgaactatcacatcccagataaataaacttattgcactgtgaaactaaataaactaatgaaagatgcattttatattgacacattgtgaaatcatttcagctggctcaccaatttttggttttcagttcagcaatttacaaatgcatctagtgtagaagcactgaaatattaaacttttccttacatttgagggaataagctagagatttttcctatgtaattttgcagtatcctaaaccttctaacaaggaagtttttactctagcacagataggatgactgcaaacctcagccacctcaaactctaaccagcttaacaaaaaaactagcccgacattctaacttgttcagaatatcatttccacatgttcatcttatatcaagtagtttcatgaaaaacatatatagttataatggtgtataaatctattttaagtgtttgacgcactacaataactctgtaccagaacttgttacagaacaatagtgcttctagaattctttgtatcaaaataatcagcagtacccacgatttcaattgtactggaggaaaaaaa

SEQ ID NO: 58272 - DNA, 32053 bp, Oryza sativa
agatagatagatagatagacttccaacttttccatcacatcaaaacttttctacaaacataaactttcaactttttccttcaaacttttaattttaatcaaacttctaattttagtgtggaactaaacacacccttatatcttccggtcgtcgactcctcgtccatagatactaccacatagcccagaggcactatgaccgatcaataatcacacatataccagccaataaagttaggcgttcgcgtgactctgaccttcttaatatggtatgaaaatttataaagttttcaccataacaaaataagtataaataatcatcttcactactacttgaaccaccgccttctcaaccatctctagtgttgtgtgaccatcttatctggacttgagatgtaacacagattaataaccttacattgcaatagcggtggtttagagtactgatagggtgattttccacgactttctaagattatataaaactcatgtatatgtggtatggtaatatcattgtcctatttccgcactggatttaatttaaaaatatcatttttttctcctcgttatagtactaattagaacttctttcaagtatattattcttattgcgtaagtcatgataatataagctaggtgtattttaaacatactccctccgtttcataatgtaagactttctaccattgtccacatatatagatgttaatgaatctagaaacatacatatatctagattcattaatatctaaataaatgtggacaatgctaaaaagtcttacattgtgaaacggaggaagtagtaatttctcaagtctcatctatagataaataagacaccttaaaatatgttttacaatgcaaccatttcaaagtagtgacctactactctgtcaaaaaaaaaaaaccgaattcctagctacaaatctggacacacgcaaattaattaaggattggtctttttttttttgacagaatggtaccaaattaattaagggcttatatataaaacaaattcaaattgtaaaactgtcatcatgcgtctgcctcttccttcaactaacctatgtctgttgctagtttatctcgtgtagaccctagaagtaccatgaagatatgctagcacctttttttttattttgctttatgtctttatcaaacggtatgttttgtttcatcgtagaatccgacggctaataatatttacttttcagtacttcagatatctggtcaattaattgtctattacacacatcgcatacgtatgatttgataatttgcttcgagatacctggattgaaagcaatgtttttaatgaaaatagcagatgcagcgacgatcagcacgtgcctccaagtcatacactgtgaccagatgtcaaactcgaagtttacaaccaaattaaaatgccaagcatacatatgtttttgttaacgagtttacaaccaaattaaaatcaagtccaagtccagccggtaacatggtactaccatactcttaaaaaaatagcatgcatggtaattaagtccatcacatcttaaatctttgaaaagataatcacaaaacatcatccaatagataatagatgttgcatcaataagaaaacaaaacagataataaatcccagtcattggaaaaaagagggtgttcttgagtttttcagtgtctccttcatatgtgggagagagatatagagtaaagaagacacccatcagaaataaagaaaaaaataaatgtttgtatgattgagagagatgataaaaacatttctttcttaaaaaaacataaattttatatatttttcactaacattcttcagtgacataataccagtaatagattattcttaaacataaaaaaaggataatgatagtcatgcgaatgcacgacgtcttgcactagtatatatggtcaataatttcagtaaatcgaaatgtgaacaggagcgattcaagtccttggttattgttgtagggctgcacaagcagctataggctatagctgccccggcgtgaatggaacactctggcaatattactgggtgcttgaataggctgttgatcgaccttcccgtctatctcactgggtgctaatgcaggcctgcagggtacttattttttacaaaatttattcccttggcgaaggtggatgttcctgatgcctaccaagcttaaaatgctgcccagtccaaaaggaaaagcaaatatgacagtggcaatgttcatagtagttaacccttgtctggttgttatatatttatcctttccaccaatttttggtcataaattagaggtgcaatgccatccctgtgtgttttttaatgagacctttcacagtccttgaagggaggcggtaccatatttgaccgttgatctggcgcgatctaacagatgatattgcttggtaccacgtcctcacatgtggaggtaccgattgagcatgtggtagtgggaggggtagaattgtactttcgaatcaatcctttctcccgatccaagcattcagcgaactctcttcgtccctccatctccacattcgaacgtcgtgccccccttccgtcttgcgctcgaacttggatggccgctgtctcctccactcccgcttgaatgccgaaactgccggccaccatcatctccgctcttcctcatcctttgatgctctccccctacggccctgccccatgtggatgtcgttgggccagatccaaccgctgaggttggggtgccagatttggttaaggatgcgcttccgcgagcttgcaaagacgctgattggagacctcttgccaccctctcggcgctagtacgtcagagggggagaccatgtggatatggttggtcgacagtgacggagatctctcagatggcggagatcagcgaatatattacaaatgattttctgtttatttcgcacgtcttggatgtggttggtcgatagcgtcggagatctctcagacggcggaggtcagcaaacatattgcaaatgattttctgtttatttcgcacacaaggcgttcggcggaaaacaaaatgctggcctcccaaattatagattataaatggaaagcgtccttccctgcaacgctccggcgctctctacttgtattattatactacaagtagaattcttgctctttcttcctcttcctaccgttctgccacttgaatctccggcgggagctgccgtgaactccggtgtgttctgctggtgtccctcccgaacctgagcaccacctctgccacagcaactgcaccgtctaagcatgcctccataaccccatttcctcatcctagtaggggcgatgcaaaagatgcagcatcgggtacaaagacgaagagagatagaaaccatgcaattagaacgttattatatgcatgtagtacagaagttgtcatctcataattaactctctgccccattgtaatacacacctagcaaaagtgaagggaaaaagagtgtattagtgtgtttctttaaataggagagtgtgttttttttatctcctgttagttttatctttttgtccttttacctttactgcaggattcttaacctgtaacattattgtagtacataaggagaaacatatttgccaaccactattttagggactctcgtaattatatatatgatgttatttttagtgtgaaagcctcctaaatatttggaaatgactaaatggggacgttttatattgtacttgagcaagacagctcgcaaatggattaagccccttctgtaattcatcagttaatgtgatgcatgattgctgattctgaacaaagacagtgtcaatgaaaacaattgaagtgttagcaattggtaacttgtgaggaattaatctgaatcgtcaaaaaactatgccaagatggtccctaagctttacagccttacgaaagcgattactctggaacggtttcagagagaaactatgatggagatcgacaatttctttggtcaaattaagattccaataaaatatcaaactaagaataggcttccatggcgcaaatataatatatataaacatcgtaaaaggatgcacaaccttcccagcatataatctctaataccgatttttgggtccagactcttgttttccattgggccacgtggcgccctacaaatttggttagggctcactgaaaaactgccacgtgtgatgcgtgaagtatccggactgaaagagatcgggaaaaaaaaacgtaaacatttgcctgcgtgtgtgtgcggggtgggctttgcatctagctaggctgtgcaaccttgggcctgggcctgtccctggcgccccacggcctttctgtaatatgtaatatgtaccgcagtccgcagtactggtgaatggcctcttcacgcagcgctaagcacgttcgttcaaaagaaaagggaagaaaaacagcgtgaagaactgaagtgtacagagccagtatagaacaaaataatagtaataaaaagaaaaggagaaaaaaaagaaaataataggattatgcaatcaactacaattactcggaatgaggaaaagtcacttcatgttagcatcatgtgtttctagaaaattagaaaaaaatagtgaaattaaatggaaaaaaaatatagcagcaataaggattgcgttaggacaatctaaagtctctagataaatacaatctagaatgtttacttcaaacaaggaaaattaatacctaaatttctatagaatggaaagaataaaaagtgaaattagatgaacagatatgtattctctgttaaccgacaagttcagcactactttcctattaattcggagcattttgtttttcttttataatcctcacattatactttttctagatactaggaatccatttattttggaacatgggtaagtaaagacaataattttgctatattttttgtttgtgaaactcaatatagttatagatgcttatatgtacgcgcgtatattactcactcctataaatatacacacgggcaccttttaggactgggccgttaggcatatatttgaactgattgataggttgcctatcattgaaacaacaaatagtcgtaaaatgtaagaactcgtactaagtctatgacctaaacctgtataggcacggaacctaaccagctgagctgcattagaataagtctatgacctaaacctgtataggcatggaacctaaccagctgagctgcattagaataactggatatatgaaatcaagataagtatgtttactatgtcgatgtcccttgctctaaataaaaccagcataaacaaaaaggtaacataagacacatttattttagatatgtatttcggacttattatacaaagagcaatgctacatgtactaaatttttttcttgctaaacttttactaacaatcatttcaaccgtttgatttaagtacatgcacaaccttcccagcatatatactaccctagttcattgctccaaacaggcacagatatagtacaatatatacatacatgtatattaattttgagtagtcgtaatgacctgcgtagcaccccaacatattgagttcaaatctacgtaggagtgaattttagattgggttatttgaagtagtaagttctaacttaaatggctgcatatggctgtatatatccggttacatgtatatgctgggtaaaaaaatactcttccgaaaatataaattcatcagttcttacttcgagtatgtacactgaatcatgtcaattaatttgaggtctatctttgttgtaaaaagcaactatgcagcgcagcaacaaaatgtgcaactagctagtacacggcagagttgcacaaagcagctggagtagactgcgacttctttcccgccggtgccgttggagctttaaatttcgaaattctttcccgggggaccgaaattaccaaaattttggaaatgttgaattttttttagctgaaattatttgaaattttctgtcttaatgaattttaattaaatttgaccaaaatcagaaaaatttacaaaaaaaaaaaaaccgaaaatttcgggcgagatgtgagctttccggtaggggacaaaattaccgaaatttcaaaacgaaattgcaaaccctgcccttaagtcgacattctcattggcggagtggtgaaaccacggaactttgtaaactatcagaagaaaactgacagatttcgtggcgtcactgcagcacaacaattcctgggacctcccagtccaaacatagatatatagaatgtatggtaggatggatgcaatgaccgagtgaatcataagtggaaatgcttcacttccaacaaatatatactccctccgtttcaaaatatttgacactgttaactttttagcatatatttgaccgttcgttttatttaaaaaaaattgtgaaatatataaaactatatgtgtacatgaaaatatatttaacaatgaattaaatgatataaaaagaataaataattatttaaattttttgaataagacaaatcgttaaatacgtactcaaaagttaactttgtcaaacattttgaaacggactgagtagaagctagcaacatgcatagcatatctcagccattaataatctctggctgccttaaaactatagccaattcttttcgtagctagaaaccatccacttaaaacgtactagagtacacatgtggtaacacaagttgttgtcttataactttttgccccattgaagcacacttgtgataaaatgaagggaaaagagtgtatcagtgttgtttaattagagaagtgtgtgtttgtttatctgcctcttaattagttttcccagggaaaatcattacaatgcaagcagcaaaaaaatcacgtcatgcaggggagggcccacgattttgaggttgcgtataagcgtactcaaagtagaaaggggtaaaagaaatttatctttgacagtttgtatgttgtttcacgaatcacagaattaggccataaaagttgtgtgaattggaccctcataggagaggaagccaagcctagaaagacaggtttatttactaattatatatatttttaacttttttataaacatacatataacaaaaaaaattgggtctccatttgaatacccgtgaatctaattgggccgctctgagcaccgtgaatggaattactaaacaaaatggaattaataaggctgcgttcttttgcaatggttcccaactccatcctcttttccgcgtgcacgcttttcaattatatggtttgttttctacaaaaaaaattctattggaaagttgcttttaaaaatcatattaattcacttttcaagttagttttagctaatacttaattttttttacggttaaacagcaggagaggctcctactacgctatattaaaaaaggggggaaattatgtacaagagctaatacttaattaatcatgtgctaatgtgcttttccattttctatgctggaagggaaggttcccaatcagcacaaacgaacacaacctaaatggctgttgattgagaattgtgggatttgtgtcacaatcaaaccttgggatttgtgtcacaatttgtgctccgacaatcccaactcgttctcctctagctctagagaatcttcggcacccggcgccggcatgttgagttagggtttaggatcccgggttggggtggaggtaggaatggaggcaagggagagggaagaggcttagagggatggttgtgagaggcagcgttcctataggcggtgagcagctagagccatggggatggagcaaggcgactggccagcaatggtgcgtggcggggaaaaaccagagctttgtggttaggacataggaaagatggtgggatgtgccgtagagcaaaaaagggaactggtgattgatccgggcgacccttggttccaaatatataatgtgtattttctctaaaacataagggaacaagggtaggatggctagagctaaccactctcaacgcatagatcccggtttgagtccccatgccacaagccttttctatgatttttgtaaaccaaaatcagtagtacggggctaaaggcaatggaatgggccttaatttggcccatttatctcctctgcctggttcgaccaaaggggtttaatgcccggtccgaccaaggtgttttaatgccgggtccgaccaagacggtttaatgctccgtttagtctaaaccttattgcacggtttagtctaaactcggctggttcaatctgggtcgaatgcatgtctgatctttaagcgtaaccgaactatggaaacttctggttccgtacttttccaatcgaactgacgacccggtctgtttttttcaactatgggacaggggcactcaccatcgctggataagaaaagagaaaggggaggggagggggggactatgggatggggacacttgccgctgctggatagggaaagagaagggggagtgggagcgaggccggtcaggataggtagcccggtccggttttttccactatcagacgggggcacttgctgccgttggatagggaaagagaagggggaggggagggaggccggtcaggagggcctcctcatcagcttccaacgagacaacgaggttgggcggcaccgctggagatgctcgccttccgtcgccgtcgccgccacacacagctgctggagccgccgcgtgccgccgcccgaggaccagaactgccaccggagccaccgccggaacaactgccgccatccagggagggaggaggagagggtgctgtctggtggatctggagggaggaggaggaacgagaggataaggatgggtagatggataaggagtgatgggtggcgattttttaatgggctatgatatttttaagtgcgcatgatttttttgacgggctctacggtaggttaagaggcctgccagctaaattaggcttatttttgcaagcggattttttaacctaccaccagcaaaaacggattttcgctggcggttctaaactcaccgccagcggaaaaaaatagggtaccgtcatgaaaaatcatttttcttgtagtgatgtaatttaatcaaacttagaagtatatgtatatatgataaatgtaacttacatatataataaaagtaatttacaacatatatatttcttttcatcagaatatattcatgtaagatcttgttataaagatttaattacaaagaataaaatggtataatcggactgtagatgggatatgtaatttgaaagaaaaagtatatttgaagtttaactattaaactatatttccttgctgttgcatgcttgtatacttaccacataggaagagatactagttatgaaaatagttgggtctctggtttaggctatcaagagaccaaaagcagtacagttgccacccgaaactgctaatgtacgggtgatcacccgcactcccctccccctgtactcctccctcttccccccttcctcctcccctttctctttcaactacagtacaccacaaaatttttttaaaaaaacaaaagttagaaaaatttatgtatagaaatactatatataaaaaaattgaattcaaattcaaatttgaatcgggtatgtaaacttttgacttataaactttggatctataaattttacatgtatagaaatactatatatagaaaatatttgaattcaaattcaaaattgaatcagatataattcaaattcaaatttgaattgggtatgtaaacttttgacttataaactttaggtatataaactttacatgtatagaaatactatatatagaaaatatttgaattcaaattcaaatttgaatcagatataattcaaattgaaatttgaattgggtatgtaaacttttgacttataaactttaggtctataaactttaggtgtataaactttagatgtatagaaatactatatatagaaaatatttgaattcaaattcaaatttgaatcaaatataattcaaattcaaatttgaaacgggtatataaactctaggtgtataactttagatgtatagaaatactatatataaaaaatatttgaattcaaattcaaatttgaatcgacttttggtctctaaactttagatgtgtaaacttgaggtgtataaactttagttgcataaatttaccaaaataagaaagtaatacggtgccagaaaaggaaaccaagtggagggggtgaatctgagagtcttttagccctatgccattaagaaagttggaggttacgcgtgtgccacaaaaaagttttgagtcacctgtatgccatgacacaaactttcgtttacccgtgtgccattccatccaccttctgttagagaatgagctctgacatgtgggatccacgtatgaaaatgactaaattgcccctgaagcattttcatctcactactcctctcacgtgcaatttctccagtgccctagcctagcacgccgccgccgccggtcgtcgccgtcgctggcacgccgccactgccacctcgcctcgccggcacgccgccgccaccgccagtcgtcgccgtcgccgccgccgcctcgcctcgtctatccaccgccgccgccgccgccggtcgtcgccgtcgtcgacacgccgcctcgcctcaccgtcaccggcacgccacctcgcctcgccgtcaccggcacgccgccgccgctgcctcgtcttgtctatccggcagcgtgcctctagtcgccgctgccgccaccgccggtcgtcgccgccgccgccgatttctcttccaaatgttccatccaaagtggctgaaatagagcaagggcaaaatagatctttcaaacctccgttagtctccgttagtgctgattccatccaaagtggcgcacaagtaaaagaaagtttgtgtcatgacaagtgactcaaaacttttttgtggcacacacgtaacctccaactttcttaatggcatagggataaaagactctgaatctgatcgctaccccatcgccaggacgatcgatcatccattagaagcccccgttggccctttaaataaaacgaacccacaagaaaaaaaacacaaaagtacatatgttctattttgcaaaaaaaaaaggataaaattgagacgctgagcaacaatagtggccccaggtgacagaccagagcagcagcccaacgtctgacattaatcgcggggtcgcaggccgcagcacccaacaaaccacgaggacgcttgcctgaccctctcggggactcctaatgggcgcgtgtgcgctggctgtccagctcgcgcagccgcgcacctcttctactggttatgttgattagttttaatgatatttattaatgctaatgataattatagtattagttttttaaaaaaaatacataaacaaatctttcaactcggacttgaaaacattcaagtcaaagatttgaaaattttaatttaagatttttttaaaatttccaactcggatttaaaaatttttaagtcaagatttaaaaacttttaacttagattaaaaagctttcaattcggatttgaaactttcaattcagacttgaaaactttcaactcagatttgaaactttcaattcagattcaaaaacattcaacaaggatttgaaaactttcaactcaaatttaaaaactttcaactgaagatttcaaacattcaactcaaattttttaaaaaaatcaagtcaagatttgaaaatttttaactcaaattttaaaactttcatcttaaaattcaaattttttatttaaattttaaacattcaacttgaatttaaaaaaattcaactcaaattcaaaactctcaactgatattgaaggtgaaagtatcagtttataaaatatcgcaaaaaaaaaatcacacgcgtgtgcgaaaaaaagaacgatttccaaaaaaaaaaaagaaaaaaacagagcgatttcaaaaaaaaacagagagagagagagagaaaaactagggaaattgcggaaagaaaaaaaggaaaaaaacttgtcgcggcatcagaaattacgattttgctaggaatttgtcgggtgatttttttgttgctatttcccgtttttgttgccgttggatctgcgccgagatttgtgccaggaatggggtggacgtggtcatacgtggatagggcctcgcgttggattccctggcccgattactttgcactgtgcaaatttcgatttccgcgcttgtccgtagccgttttttatttcccctcgctgatcccgctctctcctcgcatttctctctctcgctttccccttttcttctcttctcttctcgttttctccgcgaggcgagagagagatctcgtcggagtgagtgcttgctggagaggtttgtctcgtcggtataagtgctcgccggagaggactgtcttgtcggtgtgcatgctcaccggagaggttggtcgctggcgagatttagtgtttagatttttttttgttcgatttgattcagtccaggtccgattcaaattgtgttcgggttcaatctcggttttagttgttttcttgttcgatttgattcaatgtaggtccgatttgctcaccggagaggttggtcgctggcgagatttagtgtctagagtttttttttgttcgatttgattcagtctaggtccgattcaaattgtgttcgggttcaatctcggttttagttgtttttgttcgatttgattcagtgtaggtccgattcaaattttgttagggttcaatctcggctttagttgtttttgaatcgatgtaatatgatggaaagctcgccggagacgttggttgccgtagttttgtttagtttgtctcatcgtttttgtgtggcatccaatgttttttggtcggtgaaatcgtgatgctgctgctgcttcgccaagttgcgcttccaggtttggagatttgttcttcctgggctgtgggaagcgttcacggaatggatctaagattttgttgtttttgttgctgcagagcgttgcttttgagttggggaatggttgtttagcccgcggattcgggggttttaggggaagcttttgattttaggggtgctttttgcttagcaaatcctgtttctgtttttgtgcttgttgatgtgtgatttagtggcaaattctaggcgtgaagcaatttttcagaatcatgacatggctttttgttatgtttgtattagtgaatttttttactgaattactgaatttggtagccagcaaatacatgatgtgttcattactttgtaaagcttcacagtgattatattttttatgtcaatgtaaatggatctggatgttgtacttgtgctaaagtgaagtttctacatgattgtgttttttatgtatgatttttgttgtaaagtgaagtttgtattgtttgttcatttaactcatgtccaagttgatgtttatttattgttctttcagatgcctcgtgtccaaacatcaaggttgggtaaaaatcccattgaagttgattctgatggaggtgaagatttacatgttgattatgaagttggtaatgatgtaagttatattttaaatttttattattgtattatgctgtttaagtttacctttaatttggtattacattatttttctttttttttaggttgatgaaggtcctgaacatggtgaaattgatggtttattctctgttgtgctcaggaaaatggtatgtgaatttttttttgttgacttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttcttattgcttataatcttgttttaacttatcaatgaaacggagaattaattcggtcaaaggaaatttagtactaatgaagtggatagttattttcagattggaattgttctgttttttttttgcaaaataaaattttatatttgttctgtttggtccatgtgtacaatgcggtactctgaatcttgctaccatgctattacagactactgttagttatgttgaagatgtgagtatttttcaggttgtagttgtgactatacaaatttgtatctattctctcaacacagttcagtgcagccaacgttgttgagttttttgttttttcttctctcgttgtttggcactaataccttctttgttttctttcacatatcctgcacctaagtatccttggtagctttgatgcatgcaacgtcatattcatgtttcccatgtaactaattcaatctagtattatgcaaacatagccaccataacacgtgttatggatatgtttttttttgtgtgtcattgtgtctaattttttctcaagtatatctgttttgatgtgtgatttgtgttagtttgcttggattagttttctcaagtgtttttttttgttctacacgcagcagcttttaatatgatatgagcttaaactttttttcggggctgtgcaaatttgtaaggttgcaaaataatagtctagtagtgatggtttcttcacttatagcttagttcaggtttccaaaattttaccgacaatttctactaaaattacagtacacttacatgctatatgcattgaatttacaattgtaattttaatttcaaatcactgtaatttctacttctagtgtttgattttgcatatgtatggcagcatggatagtgctattaagattgggtgctatctcaagtatatctgttttgatgtgtgattttgtgttagtttgcttggattagtttcctactagtaaggtttcagatatattatgattttaaatgttaggctatacagccgggaccaaattttatataattctggtcatgagtgtatatggttgcctcttagcctttataagggtaccccctcactccctacctccctatgatttttttttgattttattcatgctaatgtgctgatctggtatatggtaatgaaattattatttctttctcttttagcttttaaatattctaatttagtaaataagtttttaacacacttctacacttgtttttaaggataagaaatctaaagttcattcgaagactgagccctcatatagcagattctcaacaaaatatttctcaacagttctatcttctttatctcctgatcagcagcgtactattggtgactatggttttaattctatgctgatgtttgacaatgcttatgtcccaaacaaacaaatttgcttcttggattgcaaatcatgttgatgtgaagtcttctcaaattgttttgaaagataaagtcattgcaattaataaagaatgtgttcattatattttgggtctgcctattggtggtatggagttcccaactgattgtgatgctggaaagtcctttattctttcaaagtttggcaagagcgctcttccatctgtgagattctttggtgataagttcatccgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttaataccttgggtggatgctggtttctctgggcagtaagttattaaattttttttccattatctttgttccatattattattgttttttaattaatttttctttgctttttcatattttattttgctaggtgctttatctggattatgttgagtttggtgacaagaatattcctattggttttcctagaatttctcactggaagaataatatgattactttgtattctgaccttgacaaagttgatgaagaaaactttggccttaggcccattaaggatttcaatgatacaacttatttcaaggtacatgttcagttcaattagttttatttatttttacttgtgtttttcttttcataaattaattcttatcattcattcatctttacaacctaaaattttccttgttttaggttgtaccccctgaaaatagaattaatacattcagagataaattggagtctgctattggtactatgttacctgctttcattaaggagaaaatttgttcaatggttgttagtcattgttctgccaatcacattgttgacagtgagtcttgtgaagatattgctatcagcattatgctcttgctatgtgaacatgctggttctagagatggtggtgatcctgatgaaaacttaatttttgataatatcaaccctgggtttcagcctaactatgcaattgatgttgaaaatgaaatcccttgtgatgctcataacaatggaagtaagttttcttctatgttcttttaattttattatattttttaatttttcttctatttatatgttctttgatgttttattttttttaggtaccaataaatctgttgctagtaaagctaatgaaacaagttttcgccatacaccttctcatgataaggaattgggggtatgtgtctgcttcttatgattataatttatttttttagcttaagttttctaactttatgttcttgtttaggtaaatgatgattctgttattgtctctaaatctgttgttagattttccctttcaccaaactttgaaaaaggtacttggtgatgcattgttaattttttattttcttaagtttgcgttgctgttaattttttatttttgctcagatcaaggcttactaacccctgaagttggatatgctaataactccaattcacgatttggtttgtgatttttctttgctagattttatcttaaattttctatttcgaaaatttgtaaattctgttagttcttatcatagttattttgccagcttcaggtcctactgtatctgctgtagctgctgttaggaatgttgcaaataaaattaaatcaagattatctcaactcaacaatgatgacaaaagaggaccattgttccctgatttaattgattcttgtgaagatgaagctgttggttatgctaagtcactttcatgtcaaaaggaatatcttaaccctcgatatgtcacttcctcttcatcacaggtattccttttttattggcttgtgtcttttcttttttaaaaaattcttgaatagatgttgtgatgtcatgtttctgtatgctttattttttgattttctcttatttttttatttgttgtagcctggtatatcttttcactgtcttgacaattcacctattcaagtaattggtataaataataatgaaggaacaagcagaactcattgtattcagaatgtgaagaagaggcgttttgatgatgttactgtatgttcttattcttgttgactatatttatatattgtcctaagttacttttttttctataattatttttttttgctttttttttagaattctcctgatgtggaatatcttggtcattctatatttcctgattgctgcaaggtattgtgtacccaaactaataatttgtataatgccaagaacatgttgaaaagtaacaacctggatttgagttctaccggtggaaaattacctccccatggccctagaagagttttagttccttctcggaaattttcagatccttatgttctttctgttagacgccaatttccagtgtcagatcaagaaaagagacattacaatgcaatatgcaagttgtccgagagctctaaatggcataggtacagtttcctttacatatatttttatagtttttgcattatgcatgtttcttactttgcttttctttttatatcttttttttgtagttatgatgctgtagacattgataatgttagagcaaaattctcttcttttgggcaatctctcatgaaaggtggtattgtattgagctatgttatcaatgtgttttgccgtgttttgttcaacaacaatcatccttcaaactccaagagacactatttcttctcttctattggtgtaagtagttatttttcaaatttgtgcttttttctgttaatgttgatatgttacatattttttggtatgtttatttcactttattttttttcaggaactattgttaactgatctatcttgtgctgatttgagcaaggtgaaaagatcgtttcttggagcagctagtgctaggaagttgcacctttctgacatggtattttttttgttttcatgctcatgtaaattttccaaagttatgttgttaattctgaatgattttttgcagctatttttccccatcgaacaccttgaacattggttcctttttgttgttgatataaaggacagaatgttggtcctcttagattctttacatgaaaaaggtgatccctattttgaagacattgaatgcttactggtatgatattttaattttaaatgcgttttcattcagtttttttcttcttgttttttgtagttgattgattttttttattttgtattcagatcaataatttacagacattctgggattcttatgatggctcttcaattgattttactactttgaagaaagtttacccttgtgttccaaaacagagatcttggtatatttttttgtgtttaatcttttctgttcaaataattggagcattcaaaatacgttatttcaggaatgtgcagagtcacgcttgtattacattacttatttgttgatgtccaaattctcaatacttctttactttagccaatgttttctaattttctaaatgtcattaattgtcctctcattggggcattgtagaatgttcttgcttcatttgttaactagtgaaattaccatgtaattctgtgagctagatatttttttattctgtgtgtgctatgctcacacttttgctgtgtattttattttgtgatattactgtggtgagtagtttgtgtttacattttgtgatattactgtgctgcatatatttttatatttttcgcgtattgcatatattcttaggatgttagtaataacacttgcccaatttttaacatactaataataataataataataataataataataatacaagaaacaagaaaaaatgccattgtggtacaactaaaatcaacaatatcatgaacagtactacctaggttttatttctttcttttttgtaatttaaagagttgtttcaattttttttgtagctttgattctggaatttttgttatgaagtgtatggaattgtggtcatcaagggttgttctaccaaatgaattttcttcagatgatattgacaatattcggatgctgtatgcaaatcagttattcttccatccaacgaataaaatgctgcagactgaagttgaagaagttgtgctcaattggtttaatcctgtaagtgtgtttttatttttttttcctattcttgttttttgatacatttttagttatgaaaaaaatgtttttcattttttatttgtatgctcaatttgttggtgaaggctgaaatttttcagaaagatagttgctatgaaaattggtttaatcttgtaagtgtcttttattttttgccattcttgttttttggattctttcatagttttgaaaatattatttttgtttgttattgtaggatcaatttgctggtgaaggctaaatttgtgcagaagattagtcgctatataaaactgtagtgtgtgatagcatagtggaatgtataggatcatagtgaatgcatttttgcagtgccattacatattcctgtagtgaatacagatgttcacttacatcaaatacttttagtatgaatacacatatatagtgtgtgtagtgcagtaatacagtgaaaaacattaagatctaatactttcagtctcaaaatttgacatccttgttttctgtcttctaatttgatttgttctttttttgtccttccttgatctttaggtagcttgcttcctttgtcattttcttcatgtttcttcttcctagcgggcattgcttgcttctctattgtccctgcaatacaaaaatttatatccattagcttgattttttttgcttgcccatgtttgtaatattttacatattattcatttcttttacttcttgttgtagtcttctgtattttctttgtacttcttgcaattcgcatcagcgggcaattttctattgtgtgacttgttcttccacatcttgtacaatgtttttttggctgttcttttatcttctctaccatcccttttgttcttgctgattttttcccctttgtgttagctatgtcagggtcttgaatatcttcttgctcatttgttgtttctttttctgctttatcctcacttgtgttttccaccgtgttgctttcatcaattgatgcttgattttgagctgcatcttcaattatcaagtcaaggttgctatccagattatcaatctctcctagcaggtactcatatgtttccttactttttgatgcctttgatgtcatgttgcatattcttctagataatacattgaaccttagcacagaactgttctcatcatttgttgcaagttgcatgctcaccgttaattttctctcctttttcctccatctttcaattatgtacttatcaggaatcttgctcattttcagatacaacatcactttcaaaacatggctgcataggattccatctttggagaactttgcacatatgcacacgaagttttcttgtggtaagtctgtcatcacaacatatcttcttggtctgaattcttgttgtttcagatttggcgctgcatatacttcatatgcttttgcttgttgtatagctgccacttctagatttagtgttcccttcaattcatcttgaaacttatcaaatatcccatggttgtataggtctgctgcttgttcttctatcatgtcatttgaccaaaaagactttggcttcttgtttctggattcataatctttcccatactcagtgtcgaagatgatgtcattgattgtttcatattccagtagaaaagtcatgacactatgtgttgggccaactccccttttaaaccttgcatttgtgccctcactaagtgctgtgctatgtataaatgggcaaaaatctgttttggaatacaccggtataaaattcttccttgttctccacattatttccagatatttgatattttccaagttgtattgtgcaatcatttgcaaccataggctttcaaattcagctcttgtcaagctattgtgcacaatgtcattaaattctgcatagagatctttccttctcttgtctgaaaatgtatttcctgacctttctctacatttcttcaaaatgtggaacaaacaatttctatgtttgctgtttggaaatacttgacgtatagctgccctcattgccaagtcttgatctgttataattgtttctggatgttttcctcccatggctgttaggaacgtttcaaaaacccatttgaaagtttctgtagtttcatctcctaaaaatacacatgcaaaaatgcatatgtttccatggcctgtaacactgactgtgaatactgtgtactattcgcagtaatatttgttatttttttcacttgttatattgaatttgaattttatgtttgtggaaaaacatatttcatattattctatcatatctgtcatacaattttttttataatttttaggtgacatacataaaaggagggaacagggatgttcccttgagggataaatattcacttctggaatatcattccttccacgaaaagagcagttttcgtgaagcattgctcccagatgtcaaaaagttcattttcagtgaaagcaatttcctagccataaaaaaacgttgacagttaaaaaaaaccattttctagtactgttggctttctaggtctggctatgttgtaaacaatgcagcagctagtgctaccctaaacaaccttgttatagtctccgccagtaaaaccagcaaattagctgcttgtgtccaatacctgtgtttcaattctttggaatctctgggattcccaatgcctcccaaaccaaaaccgaaggtgtgggatgacggataccggtgtataaataggacgaccatgactgcaaagaattttcaaataacagtacgaccagtgaacgtttgacatgccagagattcattttatatcttgcacaatatttatgggtgcaagtccataagtccaaattaagttggctgaggaagcagaaatttatgaaaatatacaaaggcatagaattatgtctaacacgtgcttcagagttgttgcccggaggataggttgatacatctatttttgggacaagattgatacgtacaaagtaacaaccactgtctgagatagggttgtgttactactgcagaaaataacattagagtcggttcgtaactgacatcaatgcctgaaatgaacatatatatataaggcatgttactcatattttaaattactttcatgtgatactaatttcatatttattgaaaacataacatgggataaattaatagtcaaagtatatcattgaagaccgtataaaaaaatagacatttggacggatttagtatcatgtaaaaagaccatctactcataactcacgatgtggtaattaaatcaccgtgaataaaaggcatatgcccctggccctgcaaacgtagctactacccccgttccataataattgcatttctaccattcaaatttgtctttacccccgttccataataattgcatttctaccattcaaatttgtctcaaaaatattgtatttctaataatatgggaagcaacaaatggaatatgtacccaaacctttcttttaattaagtttacatatggaatgtgtattcctcaaccttgcttttaatcaagtatacatatggaatatgcatgtagttattaaatagggatattgttgtaaattgtgtttgttgttaatctatctctaattttctagaaatgcaattattatgggacggaggcagtagtgttcatataattaattggcaggtcctaacatgaaatgcatcattattggatagagcattagagcccctctgtgtcttcaacccagatcttcactaagggcatcagcagtgtgttcttcggcttgtgcagtctaaagataaataaaaagttggtttgatccatgtagtgtgtaaaaattgattttatgggacacacggagaaaaaattcaacctttttcggcgtcctcccgtgtgcgccaggccaaagtacgcaagcaagtattttatttaagggttgtttagattgatgtcatttcaaaccataccaatttttaagtaaaattattgaatctgtgcatctaaactctggcaaatatataagaattcctgccaaaatttggtaatattaccaaactgccaagattttagtatagccaaaatttggtaaggtttatttaggctataatctgaacaaacccttaatcacatgtggtcgaactctctcttttttcttttttaggactggtcgaattctcttcgaaagtcattttttaccgaacacaatctaatcgattctaacaatgtgcattgttcggtttctttcctctaaaatcgatgctagccccacactggagatgctctaccaaactagacacgggtagttcacagcatagagcagctcttgtagactgtacccggtacttttctgatcgattgtgtcactatatcgacatgttgttgatccctcctctgaagaggttagccagtacacctttcccaactttcagaggataaagggatgcattctcaagacctcccagtccaaggctagatagggcatttctagatagggcatttctaattgtttagttcacagtataaaacagagatatatgtaggaggatgcaaatcatgcatagtactctctgatatggtttctctctttggtaacaagatgcatgcatcgtctggtatgtatatactgtctagtactctttaatgttagagatttgctctggtccaacaaaaatatcttgaggtaccggtaactcacggtactaaatcgtttccgatcgttggatctaacaatgcacatcctgcccagctagattcaacgatcgaaaatgatttggtaccgtgagataccggtacctcgagatactttttgctgggccggacaaaatctcttaatattaacatcccttagcaactactccctccgtacctaagactggatgtaacacattctaatataatgaatctggagagaggtatgttcatatcagttcgctaataggatgtcagacatccaatactagttagttttttatgcgacgtatagagtacctaccatgtgatcgatcgatttcaattgcctagttattgcttgcaacaaagtctgaatcgttacacatatcataaacttgacctaaaaatctactatgcacaaacaagtactcttctccgttctgggatgtaccaaaatgaatctttatttggttggagtaggattgaataattgttttatatatgttgtgatattttcttcccttctttagagtttagagttggtatttctatttttccaggtggtatataccctaacgctgggggtatatatctcatatcgaattaacgttataataaggtgtatatcgcctgaatgaccctcgtggtctcgcctcctcagccgggacagcgatggggacggatctaggcaagaggtctgccctgaccccgcatatgccatccgccgagccactgtcactggcacgataacacctagcgatataaatggggaagaggagagaaaacgagcgggagaggagaaaatgagagggagagtgagtgaaggacaccatgggaaagggggagtccaccactatggagagcaagagttgggggcggcggcggacacgaagatggatggatggccgcaaagtgggtggcagcgaggagagagcgaaatgtctaccggtgtgggtggataaggatgaatgtgtctgttgacttggtgtggggataaatcagaatctcacccggctagctcgcctagctcaactcagattttataggtgtaatatgtttatagctgtagattttttaattaaccgatattataaatttataatatattaaatgtgtcttttttaaaaaatactaatagtatcgatgttggttttgtatagaaccggcacctatgattgttcaaaggtgactgtattatattttctcacctagcgaaggcgggaaaagataaatagctgccggatttaaataaatcaatatataagccgttccctattaagagttctgtgacgatatctcatgttaatatatatatcccgtcaattatttcaaatttttattatgagtgacaaggaaagatgaaaattgacctaagagagtaaagtgcataggagatccttaaacttgtagtgttgtgttatctagatccctaaactctcaaaatgcagattcaggttgtagaacttgtctaagtgtatcatttaggtcccaaatcgacatagcccctatagtatcctacatggcgctgatgctgatgtggcataccacgtggatgtgacgtgtccttttattttttttcttcttttctttttcttttttgttttcttctcattcttcttttttttcctttcttctgctcgggtcacggagaaaggagaataatgaaaaaaaagagaagaaggagaagaaaaagagaagaaaaaaagaaaaggaaaatttttaaatgtccgtgtggcatgccacatctgcaccacgtaggattttgaaggggttgtggtgatttgggatctagatgatacactttgacaagttctgagatttgaatatgcattttgagagtttaaggaatctaaataacacatccctacaagtttaaggaccgcccgtgcactttactctagacatagttacagagtgcatgtgtagtaattagtcttaaggtatctcttcttgttgcactcctctgactttattgaggtatatccgtatatgtgaaagttgcttttcagtaggctcaaaacaagatatcacatgccaaattatttgcttacactagaacggaaaccctcatctcaatcgggcggtaagccccatctcaatcgggcacagcgtccgtcacaggctagaagtcactgatgtgaagagttatctcaatcgggcaaatggccgtcacggatgaatctatctcaattgggccctaagtaaagcccgtcaccgatagctttgacccagacgaccagtcaaactatagcccgtcatagatgacctatctcaatagggccacaattagtgctcgtcacagatgactactaacctttatcgggcctaaactagagcccgtcacagatgatacttatctcaatcgggcctaaactagagcccgtcacagatacctactgacctcaatcgggcctaaactagagcccgtcacagatgactattgacctcaatcgggcctaaactagagtccgtcacagatgactactgacctcaatcggacgtaaactagagcccgtcacagatgactatcatctcaatcgggcatttagttatggcccgtcacagatgactataatccacaaaaaaaataaattttgttttttggctaacctcaggcctttgctagccatgcccgctgcagaaatgacagaaacaaacacagatatccaatatccccagctccccagcatcacccattcatatacatatgcattcacatacacagacatcaatatattttacacaaccacacattcacagccatctcatatttcacatccattcacatatttcacatccattcaaatatttatcatatttcacctgcaaaaccaaattaattggatcaaatatttatttagcaagtcttaacataaacatatgaaatatatacataaatataagcatcacagttacatcatcacagttgcataataagtgttcatcattgcctaaacataaaagttcaacattgttcatcattttagtttaagcctaaacattcctttggggttaattatttcgcagaggataaagctggctatctcctcgcgaacctcctcaaagctggtaggcagagacttggttattgtgccctacattgtcataattctagattagttgatcgatcatatataagtactaaaatgtagttagtctatcagaattgagaccaccgacctcaaactcagccaaagtcttcaccttttctctgtacagaaggcgcatgttgtggcacacatggaatccacactggtcacctatttgttgcttcaccgggaagtcttttttgtggatgagggtgtcatgtcctgtcttcctgaggcctcctctttgcacgtattgggcccacgcttcatctatcgctagttgaattagggtccaatcatatgcgttcttatcaattctggagtttaggtagtaacatgtactccacttaggtgttattaccagaaggatccaatgggcactgcagcattaatatagtgaaagttaattaagtactgaaggaatgtgtcatgctgttgtgtatatttagataacacacttactattgattataggcgcacataatgtactccttgtctcggcgggaccacaaggtgtcgtagatgtagttgaccattccttgacggtcattctggagatttgtgacagtgaccacttgtggatcaaggaaggcaacttctggtgcattcttctgacaccattgccaacttaacctacacacaggataaacgatcttgtaagctagttaatccgattgttattaccagattgagttgggcgacaatacttacaaggagtagcacttaaggaggcttgtgtcaaccgctcggagcctgtagaggtcgaatagatccttgaagtcgacgacgatataatctgttggaccaaggaatggctttccatcgtgctctccaaggatatcggtagctttattcggcttcctggcattagatttctccatgtagtatgcgtgaaggtccttgcaagcggtgcccattgcggcaagcacgtcatctccaaccaatggcatgcctagttggaactcctgtggagcgacatatttcttcttgatctctttgcccttagtctcttcctggcccttgcccagatctagctttcttggagctagaagcgaggactgcacctttcctccccttcctctcccctttgcttcgggtttatcgagagtaattctctaaggggaagagtgtgccttcctgctcttcttcatcggtgggggttcatgaatcgccttgctgtcggccttcgttcggtcctccccaaaatccgtgtcgtactgcaactgcacatcgtaagattgtgcatgacaatcttgagcaggaggggctgaaggagcagaggcgggtctctttggtggacaaccgcctggtgcagtggttggcctcgctgtaaccctgatctcaatgaggtccttgggccattggatgaaggtaccatgggcatttcctagtgagaggacctcgtcgttcagtggatactttggtaggaatagctcatattccggcttcactgagtcgacttgtacttttgcacagtcgcccctgagttgcgctccatgcactcttgtctctagggtcggcttgtacgcaagtccctcggctgctggaaccgtgtaggtcggcatcaccctaactgtgagggtgcagctcgttggttcctgcgatagattaatcaatttttttagaatattatatatcatatggactcgttaagtctttcatgcattatggacgaaacttttactgttatgtggtcgacggcgctgtcgaccgatgttggattttccgccacatcagttgatgcgcaactgctgcgtttttgggtgggacttcctaactcttcatgcgcagcagcagcagcggcctgggtgttctgttgctcttctcggatctcttgcctaatcttggccctcatcgactcgagctttttgtcgaattcagatgtcagctcagctcttatcgacgcccggatcttggcttcaaggcgtgcatctttctccgccttgttggaagaccgcttcttgtactgccacgcgtagtctggtaatccatacttctagggaacagaagacccaacgccccgtgtccgtccatggtattccttgttgcccaacgctttcgtgaggaggtcgtcctcgcgtctttgagagcaggcctcttgtgaggcttgttgctcggcaaccaactccttctgcattacaatttagtggggttaaataaactgcatgatcggaaccaatgcaaacatctagtttgactagacacttactatagcttcgtacactcattgatcttctggatttggcatgaagattgtgccatcatccttcttctggtacctggccctggcccagttcctagccggagggtgtgggatatcaccaaacacgagcggcgtgttcgattcctccgcttcttcatcctcacgctgccattcctcttccttaccggcatatccggcggtgccaagccgatgcagatgctggttcttggtctggagcaagcgatatgcctcgctactagctctggactcggaggtcgacttctttgcatggaattcctcccagacctgttccgggatccaaggaaatttctctcttggatctggattcgccgggttgtagacgaactcgctgactagcttagtcttgaagttcttccaagcgttgcccataaccttgaaagcagcccgcctgagatggtccgcatgctccgcaggataatcgaagctctccttgaacgttagccaagcaatgtccttctctgcggccgacacgtgcttgatgtcatcttgcagaatactgaacttctgcctccctatgaccgatagacctaaatcggctcaatattttccttggagatgtcggcaaccctacggcgtccaccgctgttatgcggaaccgttccttagggattttgttccctgtcctaggagtacgtgcccttgaggacccactagttgtcgtcgatattggttcaccttgctgagacatcgtctacttttttctaaataacgaaaatatactattcagtgcttcaatggctaagaatcgaaagttctaaaatctattagtcacataaataaactaaattacacatctcacagtaataaaatgaattgaatgtcacataaaaataaattaaacatttcatctattcatctattcatccacattcatctcgaatcatctattcatccacattcatctcgaatcatctattcatccacattcatctatccataaacattcatctattcaaacacattcatctaatcatgtattcatccacatgtaaaatgaattgaatatcacatataaataaattgaataattcatctattcatctattcatccgcattcctctctaataatctattcaaccacattcatctatccatacacatgcaagtattcaaacacattcgtctatccatacacatgcaagtattcaaacacattcatcaatcgaaccacattcatctattcatcattcatgcgcgatggaggactcacctgggggtcggcgtcgggcgtcgggcgtcgcaggctcggtggaggcggcgtcgggcgtcggaggttcggtggaggcggctgcctcggtggcggcggcctcagactcagcgagggaggagtcggcgaagggcggcggtgccgggctcggtggagggcgtcgccggggtcggtggaggccgcggtgtgctcggtggaggcggcgtcaggcgtcagagaggagtaggcgacgacgatgaggaaggatgtcgccgggctcggtgggggtcgtcggtgaggaggcggcggcggtccgaatggagggcggaggaggctcggtggcagcgaccgcgggctagtggcgacggtggcgggctcggcgatggaggacaacagcggcgctagggttctaaggaggcgggaaactatagcgggacttagaaaaattttcgatctgatctgagaaaccctagttatagtagagtgatgagtcatctcaaacgggcattgccgtagggcccgtcacagatgactcatcggtgacgggctccatcacggagattgagatgacattcaggcccgtcacggatgactcatctatgatgggccctaagataatgcccgatagagatagactaatctctatcgggcttaaactaaggcccgtcaccgatgactatttttctatttttcccatcaagtctttatatttgtgagtgcaatatatatagctgctatataataattcaatttattagtcataatacatttttggatagtaaatgatttcaaatcaaaatatggtcaacaacaaaattgtagagcttatcaagatctacaacttttattttggtcatttgtctatataactttgttcccaagagcttgaaattgattttgaaaatatgacaaattaaaacagcatttgtaaatagtaaatgatttcaaatgaaaaaggcaacaacaacaaagttgatcctctcatcaagattggcaacttttattttggtcatttgtctctataactttgtttctaacagcctgaaattgaatttgaatatatgacatatttaaacaacatttaaaaatagtaaatgatttcaaatggaaaagccataaacatcaaagttgtacaacttttatgttggtcacttcttcatccgacaaagtgatagtaccaatgtttacaaaattgacatatatgtgttgatgtttataaaccagatgagagaaatgtggtttttgtgaataatgtaactatcaccttgtcggatgaaaaagtaaccaaaataaaagttgtagatcttgatgagaggatcaactttgttgttgaccatatttccatttgaaatcatttagtatttacaaatgctgtttagatttgtcatattgtcaaaatcaattttaagctattgggaacaaagttatatagacaaatgaccaaaataaaaattgtatatcttgatgagaggatcaacttttttgttgaccatatttccatttgaaatcattta

SEQ ID NO: 58273 - DNA, 957 bp, Oryza sativa
gcaaacaggccataacaaaggaataggttcacaccacccagtgacattcgaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtccgcggctagggtttcggtggaccgggcgcacgggcggcggttcacgcgaacggacggccgagatcgaaccgatccaagatggacggccgagatcgatcgggtccacggcggctcacggcagacggggacgatgacgtcagcgatgacgtcaccaccggcggctcgggctcgcatgctcgccggcgaacgacggcgcggcgacgcgaacggagagcaccaggacgtagaggacgacgcggcgaactcaccggtgaccaaaacggcggcggaagaccaacggacggcggcggcgacgaggaggaagcggcgaagctcttcgggtcgacgacggcgacggcgctccg

SEQ ID NO: 58274 - DNA, 1416 bp, Oryza sativa
tattttttgtgctcttggaattgtaatgccaccgggcatgacagtgttgaccccggtaaagaaatcacaactacacaactacataattgattttcgtggacgaggccaacctccagcctctaggctgaccataacatcatccacttgcgataatatcgatcccgaaggaaaacaagatccacatgcaaaaaatcaattttctcatgcgagccaacttaataggccctccagcgaaaataacttatttcacaagcgggcctgttaagtggcatgcctatgccactagcccaccaggccgacgactgtcgacgtctgatatcgcgattccggtatttgcatagtatggggatcgttggtactagcatatatatatatgcgagactgaggtaaaagagacggagatgaggatttttatacaggttcgggcccctgaattatcaggtaatagccctacatcctgttggccgaagccggtcgttgctcttattcaccataatcaaactagtacaatatttggggtagcctatctaactattgtcgacatggcggtctgaaggtctaactcatagtcgacaacagggtagtctttctcctcgaatccgtgcccggcgatatcagagacagtgcattcgtctctcctgacagtatccggagacattgtaggggactagccgtgcttatccctgaagtcgatatccggcatcttgttttggcgtatgttggcttgtatgttatagcttctgttgttccgtagattatggtgggtgttgattgtgtcttcgtatcccctctcctcctagggggccatctatttatacccataggtgtccccttgtccaagtagaactagggaaaccaatatggatacaatccgagtagtccttgtcgtttccatgtagaactaactctggttgtctttccttatccggaactccctcgatgtcagtttccgtataagacatggtatgtggtggatcctgccgagatttagtcaactactattaggtatgtggtatccataaccctgacagtagcccccgacttcaatgcaaataaacgaattcatattctcaaccgcagaccctggagtaactgttgtcgtgctcacgtgaccattcttggtgagtaacgttagacttcccttatcagcctcgtgcgggcacctatagggtttgtctgagtcaatctccgatgtcaaccaagaaagtacagagcatacaactaagtctcatatcttgctgtaatcgagaatttggattgaagtcaagaaattttatcttggcgggtacaccatctcttcaatccgtattccttgtcgagatccaccaaccgttctcgagtgatcgagaaggtgtagaatatgcgatgaatccttgtcaacatttgtcgtactcgccttagtcgatcttggtgtag

SEQ ID NO: 58275 - DNA, 4678 bp, Oryza sativa
cgatattgtgtacctgatatcaactttgttggagtagaagtaatgggagtatcgctacacctctggttgaaagccagttgtagccccaactcgactacttgaagtaaaagtagtgggagaatcgctacaccactggtcgaggaccaggtagtagtcgtaactcaaccacataaagtggaaatagtgggagaatcgctacaccgctggtcgaggaccaggtagtagtctaaactcgaccacttaaagtggaaatagggggagaatcgctacaccgctggtcgaggaccaggtagtagtctaaactcgaccacttaaagtggaaatagtgggagaatcgctacatcgctggtcgaggaccaggtagtagtctaaactcaaccacttaaagtggagatagtgggagaattgctacaccgctggtcgaggactaggtagtagtcgtaactcgaccaccagaaataaggtgagagagatcactacgttctactggtttgagaactaggagtaggagtctcttaatcacctataggggcgctaaagttggtttattacatgtgcatctcatgtggccagcatgattcacataaccaacttatagcatatccggatgtccgctcgcaatcatgttggggatcaagccgacaacgtttgcgagaatttatccgttaacaaccttttctcgaatagcccagccatggtcggcgctatgagataggtcgtcggtcttcgttggcaggttaggtgcgataactccacatttgtcgagaatgttctcgataatggggtgtactcgaccacagcttactcgagtgctcaattgttcctgaaaaatattttctagaaggcaagacatatagcggataatatcgagtatgtactcaaaaaactgcatggatcttctagcattatcaggatataacgagcagattaaacatcaggcattatgtaaaccgtaaacaagcatgattcatacagaagagaacaaagtgagcccccagcgttagaccgtagttggcctaacatcggggacacttgcacaatagatattgtataaaaaacatgctctaggtaaacataataaattatagatctgataatgctgtatgatctgaataggtacgataaattgcatataacatattgcgtaccttcgtagatacatgccggatgtatctacgaaattagtagattaatttaaaaaaccaatctaccaattaccttgttgcgtactcgttcgacatcatacgttctgacatcttttggtacatcttaaggcttggtcgatctcaagagatcgagttgttgatgatgatggttccgatctcgtcgggagacatactctggtcgggttaaatctccccacagccgaagtcgtcgagtagtttgttttcggagaatccatctcttgaacccatctcgtcgaaaccctgaagcaccaaaatccccctacctggcgcgccactgtcgacgtttgatgtcgcgattctggtatttgcatagtatggggatcgttggtactaggatatatgcgagactgaggtaaaagagacggagacgaggatttttatataggttcgagcccctgaattgtcaggtaatagccctacatcctattggatggagccggtcgttgctcttattcaccataatcacaccagtacaatatttggggtagcctatctaactattgtcgacatggcggtctgaaggtctgactcgtagtcgacaacagggtattcttccttctcgaatccgtgcccggcgagatcagagacagcgccttcgtctctcctgacagtatccgagacactgtaggggactagccgtgcttatccctgaagtcgatatccggcattttgtcttggcgtatgttggcttgtatgttgtggcttctgttgttccatagattatggtgggtgttgattgtgtcttcgtatcccctctcctcctagggggccttgtatttatacccataggtgtccccttgtccaaatagaactaggaaaaccaatatgaatacaatccgatcgagtagtccttgtcgtttccatgtagaactctggttgtctttccttatccggaactccctcaaggtcagtttccgtataagacatggtatgtggtgggtcctgccgagatttagtaaactactattaggtatgtggtatccataacgctgacaacaacccactctcctctttcccttaaaaatatcttatcctctcctctcttctctcatcctctccgctcctcaccccaccccactccacctcctctccacttcacagtccgacgtcttctcctctcctcaccccacttacctcctctccacttcacaggccgacaaaggtggtggcggcagcatcgggcgctcggtaggtggcaaaggcggttgtgttgacggctacctcatgtgggaagaggagcggcgactgtggctttgttggcccgtccacgcatggatccggtgggccaggctcttcccctcgacatggatcccgccacctctcccgccccctccctcgtacatggatctggtggcacacatcaatggcagggaggggtggcgacgactacggcggctgcagtgactatgtctggggtgaatgggaagatccggcggactctccccttgacgtgcagatcctgctgactctcctccctcacgcatggatccggtggacatgggctctcctcctccacgccagcgtgcggatccgccaatggcagcaataggaggctggaaggatagggagggcatcggcaacgacgacggtcaccggatatggagtgatgatggcagcggccgctgagcaggggagctgcatccgcttcggaattttttctttggaattttttttcagaaaattctttttgccggcggatgtcctaacaagcccgcttgcgaaaattcctttttacacgcggtttgtgcttcttgtctgtgaaaattctgatttttacagacaccttggaggtaagtggtcgctacctccgcctacgaaatacattcttgctgtatgtaaaaactgttttttgtagttgtgaatagatggaaacaaggaatcatcatatgttcccgaatgtgggagttttgtttttgtgggagaggaaaaccgttggggaaaccttcacagctgcaaggagctcctggtgcaaggaatcactgggagaatgagtttagtttaatttactcgtacgctttggttacatcaatgttacattaaactatggttcccccatcgttgcacgagtctaattcatctttgaggtaccatgaatatatcgacaggttggcctaaatcatttcttttgtacaactttagtgaccgcccgttactttttattagagtgtcatacgacagcttagaattattccggtggaacctttttagaaaaaaaaatcgaagtctcaaataataggtcgattaattcaattgaaccaatggtcggatgttttattattttctcttagaatttctctgtttttttaaaaaaatatgttttttttaaaaaaacttaagaggtgatacgttcacgtggcagcttaggagcggtccgatggatatttaatttttatgactatttggatgatataaaaagggccagaatatagactagatggttttttttaatcaaaacatatataacatacatagttcttaaattgttcgtatagttgctaggaatagaattgttcagatgaattcgaaattgaactgaatacgtggtttagttgttattgttttttaaagtaaactagtaaggtagtccgcgtaatcgcgcgggcatgcatcctagactgtatttgaaaaacttatacaggtgaaatattaattaccgaaacttataaaagatcatttggtttgtctagattatttgtgcacatttagaaaaaataccttagtaattggaatattttctctaattaaaggcgattttttgatgcagtggctaggactattcatatttcagttagttattctacttttgtagtgtagtttaatttagctatacatgtttcaaaacatgtcacggtgtgacttgtgttgttgaatttttctttttcttttggcaaattgaatatgtaatttttatttctatactattgatttaatttagctatacatgtttgtagaaggattcataatgacataatatttgttgtcaaaattttaaggtatttagaagcgatgtaaagtgcacgagtggactgtgccccaatgctataattcttatatagcaaaatatgggcatatgtatcttacattgttagtttaattataaagagagaccaattagatagaaatcaactgtgtagcttataaaaaaactatagttgtttcaatatttattgtttatcttctagttcagtagctacaaaataaggaaggggatagtagtgtttttttgcatgtgagagggaggaggaggtggagggaatttatttttctaaataatttaagtgaaaaccgattataatgtttctttttttcctcaaaatttcttttattgtctttataacttttaagacatgacacatgttgacttaatgttttgcaacaatagatctaattgatgaaaataataaatccatcgagttaaaatgaattgtcttctaatttttaagacgtaatacattattactttgctctatgggatgtttaatcaatttttg

SEQ ID NO: 58276 - DNA, 6320 bp, Oryza sativa
cgtcacgttgtatcatatgagcatttatatgagcatcatgcggtggcttagaatcgtttataggaagtttaatggacatttaccgttgatatattttagcgacacatatttgttgaattatttaaggtgacataatatatgttatcaactattttataattaaaaaatatttcattgttatattttgttgccatgtaaagaatatggcccatagaagaatatggatcttgaattatttatttattaattataaataaaataataataaaaaaataagacatgtaactattgaaattggaagattagaaaagggaagagaatatgagaggagggagtacgtatcgtacggtactaattggaggagatgaacgtaccagaggaggggaggtggggactggtactgtggagagggggattttatttattttaattactaaatctaatggttaaaaatattggacccaccaattcaaaggaaaatcaacggttgcattttagagtgccacttgatggtttagaaacatttgtaggagcgacatatggtagtttagaagcgtgtgtagaaagtttaatggacttttagtatgcaataggtagatttattttgaataatcaactactacctctgtctcaaaatagtggtcgctttgacgtttgactaatcgtcttatttaaaaaattggtgtaaatataaaaaaagataagtcatacttaaaatgattttgataataaagcaaatcataaataaaataaacaataatcctataatttttaataagacaaatgttcaaaagttacaaacaaaaactcaaaacgataagtattttgggatggaggtagtaccgtacttatgcttacttaagagttaagactcgcgatggagctattagcaggcacgggatatcatggagggattaacttttttttccacaaatctaatataagggtgtaaaaataacaagtccacgggtaaaaagtgagggccaaatgtttcctttttctttagaatttctataaacattctataatagtttataatttattagagcatcacttaactacgttcaataataatagatatactattatcctatatcagtttttctacaagttttttacaatcatatttcggtataaatcgatgcatgttttttttttaataatgaccctttttcttatgtggcaagcaacagcagatgctcaaggggaactggggtttacttgtttgggacaaagcctatcgcggtttcatgatagttttctgaaccagctggaataagaagatagctagctatgtctgaaataagttgagctcaacatagcttgtttgattgtttcagtgtcaattagaaccaagtgcatactgggtgtgtttaagaagttgggagaagagaatattgagagatgcgcaaaagataaaccattaacacaaaattattgaatatattaattattttaaacttaaaaaaatagattaatatgattgtttttataaacactaatgcgcgaagaaaagagctatttcttaatcttttctagcagggacgattgcagctagtagcgcttggtggtagtatatatgtaaataattggctcgctttgcagtgttcatccaacgtggaggcgacgacgaagactcggggtcagtcgttgggcgtgtgggctgagtcagtcaacacaccattgaggagacaaatatccgggccgggttttcgttgctatttattaatcatttgtactattagaaaagctattcagctattcagcattcaatttaagttcattcgaccgaaaagaacagtactagttggaggccgtcagtcagcgaatattaatcattattactagatgtggatgcatgaactgcaaagaggaaaaaatggctcctcgatgatacccattaccaaatccgaaagcaatggatcaccaagtccgaaagcaacggacgaagggcctgtttggttcattgaatggttgctttactttgccaaactaaatcaaaattgaaacgaacgaagcttagtcaaaaatctggcagcatgctgttgtatttgtggtaccaaaatagtttgaccacacttatgatacatgtactccatctatcccattttgatcatccctaagatttttttaggtcttcccaaaatgaatatcatgtaatatgtgtctcttcatttatttgtgtaaaaagtaaatacgcatcattgaatgtgttgcatgcacctaactaggattaatttctattggtgcagtgacttgcaatatttaaaacattagcaatccacgggacacgaatcgatgaagcatattaaccgataagaattaatttgagaataatgaatatttggtgtcattggttttggtggatcgatggcagaggatgcggacccggatggatggagccttttggttaggagatgagtctatgcgacttaggatatagaagtagaaatgtttggcacagaaatgtttggcacaatacaagtgtggcatgtctagcattgcccacatttatatatatgttaataaatctaggcacacatatatgtttagattcattaacatatatgaatatgggcaatgctataaagtctatttcaatgtatgttttaaaatttataccgtaaattttaattattacggtcataataaattcttacatgtccactcagcttcatgctcgtgtagtatactactacgaaaaccatctttcatggtggccattttagcttttcgctggcggaatttggagccgccacaaagcaaaggccagtgaaggtctaagattttcgctggcggtttcgttccgcttgtgaaaatctacacacggttgcggtccgcttgtgaaaatcgattttcgcaagcggacaaacgatttttgctggcggttgagtgtcgcttgcgaaaacccattttctctggcggttacctaaagagaaccgccaatgaaaatcaacccaccccgccaaaaattccctaccccaaattcaaaattccccacccggccaaattcaaaacaatccatatttagaaattgacataaacatcattcaaacacaataatccagagcatcacaaatacgtacataatattggcatcaatccaaatacaacattgacatcatcaacagaacaaacacacagattaacctaacaaacatccttacaaaccaaaacacacaaaaacacacaaagagaaccaccgccgaagccatcgggacgagccaccgtcgctgccatctaccggtcgcggaaccaaaacacacaaaaacacgcttgccggcagcatcgcggtcatcgtcgtcaccacggttgcggtcgttgtcgtcagctccaccactggggatgaaccgctgctgtcgccgccatccgctgccgaggacgagccgccaccatccgacgccggggacgagccgccgccgcccgcgccgcgtgctccccgtgccaccaccggggcagatccacgcgtcctccccgccgccgcctctgttctgccgccggcggtggcctcctcccctcagacagatgggagaggaggcgatgggagggcaggggcggcgcggggagtcgccggtcgtcgccgccagagccgccgccgttgccgtcgctggtcgacgcccccagagccggcgccgatcgtcgccgctagagccgccacctccgtcgcaggtggagaggccgagagggaggagagagagaagaggagtggataagaagaggaggggatgtgtggtgttttaatgtggagaagatgatgaggatgggtaggtgggtgttttaatgtgacagatttttttggttggattttcactggtggttctgtttattgccctccatgaaaaattggaccgccagcgaaaattatctattttcgttgacggcgcacctaattgaccaccagcaaaaatagacatattttcgctagcggccacattagatgggccgccagtgaaaactcattttcactggtggtcagtgcccctcaccccctcgttacaagtttgctggctgttttcacattttttcgccagcgaaaataatagaccaacgctatgaaaaatcatttttctagtagtggtagtttgttcttcgttcctcatattttgcacattcaaccatgtttgttctcatgcactacactacataaacgatttttacaaaccgctaaaacacattttcacaaatggctagacgacctgccaagaggcgtttgcgaaaatagtattttatcaaatgggtggcacaactgcgtgcaaaatccgattttcacgggcggtcaagttaagccactcacctaaaaaaaacccacaaaattcaaaacctagcttcgattcaccctagccgcttccatcatcattgatccagtccgccgccgccgccgccgccatcatcgttgctgagaccccaccacactcaaggccagcggcggaggatccacccctccaagggtcagggctgctggatcgtcgcacccggagcactcgatgttgctaccgctttcatcacctcgcgtagcacctgacgctcctgccgccttcaccacctcctagagcgcatgccactgtcgcatccttcgccacctcctagagtggaggagaggagataaggctatgagggaggagaggaggggaaaggaggaggggagacaggagaggataggacttagactttttaagtgagagaagggtgggcagctgacctagtgggtccgccgacgaaaacatttttattttcatagacggacctattaagagacccacatacgaaaattgattttgcattcaggtcttgtcttccttgggaccaacattactgtagatggataatgtcacggttcacctgcaggcttagtagattcattataaaaacaattatatttttagacggagttagttctgatgaggacatcactccttcggacacacacaacaatccaccaccggtcattcaaggaccaattccaagagctcacgcgtgacaattgaatttagaggtgaatacgttcctatattcttctttgtatgattttgagaatagattgctacctaatgattatattatgattaggagtcacttagagagggacttagaggcgtggaggatcggcaaaggcgtccaagtcaagatggaggcccaaaccaagtcgacttcgagcacgtttcggagtccaggaccagtctgcactaaaacgggtgcccaggtcgcatacgtgctcggatttatacgttctttatatagatggaaaactaagaagaaaacctttccaatgtttctggtcccatgtccaaattctttccgagtcaacggaaatggaccgaacaaattaacgtccaaattctgttccagtgctgcgtcaccgtatttggacctttgagccgtgtatcgtgttggaacccattagggttgcgtcaagggttgtttgcacaaccctaaactctatatatcaatacccaccgtcacctttacagtttgggttttgcttagattattcagtcaagaactgtttcgcagctagatcggtttgtaagaccccaacttgtgagtttaatcattcatctgcaattttggttgtattcttccttgtttttgtttgtgttctttgatttgtaaacaggaattagccttctcagcgagatcaactacgtttcggcacggttgataactagaggtgacgtggtgctgcgattgtggggctcaagggcgtgttagttcagaagctggatctatttgtgtcgcgactccgcttaaatcaactgtttatcagaacctttcagaagattgggaactctggtccacattaagtaaacattagtaagatgtaatattctacgaggaaaggaaaacaaatatggatgtgatcaccacagtgaagacattaacgtagtgtagtattgacctgcgcgctgttttttattcgtgatttgttaatcatatatacttgctaaacatatataattagctgcagattaaacacgatctgaatgtaacatgctgttacctaatatatgtcgtgatacttccaagttgcaacagccagtaccttctttgagtggttaatgccgaagaggtacaaaaccatcacaccacacgtacgattggatttgtactgttaaatttaaacgtgaaaaactgaaaattatacttgggagttgttcaaagatctttgatacttcatccatccaaaataagttgatatagtacgggatatgacatattttagtcctacaaatctgatcaggtggaaacctccactgctgcacaaaccctttgtagccccggtttgcaacaacctttaatccctgatagcaaacggggctacg

SEQ ID NO: 58277 - DNA, 2528 bp, Oryza sativa
ccaggacttaagatggtagcgccacgtggctggcgctaccatttttattcttttttcttttattgttttttttgctgcttgcatctcctgatttcaaccacacacgccgtcatacccaaatcccaagaaatcatccataaaccatacacaacaaaatcatccacaatacatgcccatccacaatccacaaatcaatcacaaaatcatccccaaatcaacaaatcattcacaaaataaaaaaaatccactggccgctggccacccggcctcccctcccgccagatctggtgaaggggaagctgccgcccgccgcctccgccgctgcccgccgcctttggggggagggggaggagatggggaagggggaaggggaggagaggggagggagagaagggggtgagaatgagaggggaggaggagggggaggagataagatcgaaggttgacgaggtgctcgatcgacgcgcggctcggactaaagatgccccggttgtatataccaaccgggactaaagataatgggggtctggcatgtttttgaaccgggactaaagatcaaaaagttgtactgggctttttaaccgggacaaaaaatgaggaaccggaactaatgcggtttttggctaacccgacaaagatggtttctccagtagtgctctccagatttatatagtactatgacatgtctcatcctttactatattaatttattttgggatgaaggaagaagttattaattaaccctactgaaaaaatgtcatcaatacagattgaaaaaagtcatctctaccggttgtagctacgaaccaaaaatatttttaatactcctatcatccttacataccacttcagtgttggatgtagacatgaacactcctaccatctttatcgctgtataatatgaagtctcacgtctcaaccactaggacctatcttttcaagtcaaatataatccttttcatgggggaattcgaacctgagatctctcccacgcgtgcacctatatttaccaacacgcctacaagcctattagaaaatgaatattgttttccttttaagccttcctaattgagatttgaatcatggatttgagtatgtaaaacaattcaaataaaaatattgtcaatgataaaattgtagttcttatcaagagctacaatttttatatacactttgtcgcagttcgagttcgtatgaaaaattaaagttcatatctaaaaccgacattaatatgactagggtcattagtatcaggtcataagaatacatcgccttttgatgtgagttgtattagtgtcgggccggtatcatgatatttcccgccaacaagcctacccatctccgattggcttgaaccaatactgattccttaatgataaaatttgctataggacattaaaaaacatgtaattagctgagagacaccgcaaaaatgtgtatttgctataagacatctttaaaaactggtaattagctgctggacacccgcggtattattttattattttcagaggaataggagagagaaaccatgtttaaaaacaagtttgccttggctcaaatgaatccaacgtgggccccacatgtgaccttaaatgtaagcccctctctctcccccccacgcagcgccgctttgaccagccggaacacgccggcggtggcaacaagtccagtaggctcttcgtcgtgtaatcaggtcccgcgctgcgacgtcgtgtggtgaagcggccgagcatgcggtggcggggcgaatggaggttgccgctagggcagaaatctttgacaatgcaggagttgtcctagccggcgttgaagtcgacaaacatggtgtgcaggaaagtgtggtcgagccagcgcaggacgcgcttctcctttgaggcgacagaggtagacgttcccgatgtccgcggctctgacgcagcggacgagggtgaagtcccacgggccgagtggcgcagcggcggcacagatgggcgcctagagaggtcggcggcgtcgtgcggatgtggctgggaggaggtgggcatggccgagtcgatagagaacatggaggagcggccagcgacactcggccgtccttgcctgcacgccgacatccgtccgtccttgcctgcgcgctggcatcacctcccctcctgctctggcgccacctctactgcgtcgtgctggtcccggcacttgcgcgcgaccgcaaagcgccaccccatccaaggcgccacaccggcccgcgcctcgtcgcgtggtcaccggcgctctccctccccgtcgggttcacttcaagaaagagcaaagagagaaagaatttgatagagagagaaaataataaggaagaaggagtagagaaggatagagaaaaacaaaaagaaaaaaaaatctaagggtagaaccgtacttacacagttgtttctctctccaatttctccggatataataaaataatctcacgggcgtccagcagctaattaccaggttttcatggtgtcctatagcaaatacacgtttttgtggtgtctcacagctaatatgtt

SEQ ID NO: 58278 - DNA, 10052 bp, Oryza sativa
gtatggttaacaaataccacagcctgattatgccaaacaaagcaatggactatgttaacagtctgatcaatttcatgagctaccttgttccatcaacaccatcatctcttgcacgggcggagccagcattttgagtcactggggtcatggcttttacttttatttatgtcgtgtttgaaactatatttattctcgaagctagatatttttagctcaaaattcttttggagctagagctatgagtaagttgggattgttccattttgctaaaaataaatgtttaaagtctattctataagaatttctgaggtttttaaggtctaaaaatttaaaagttatgaccatatacaatcgggcataacaaccatgtgctttttcagacatacaaatatgttctgaaagttgtttattattccatctgtctcaaaatacaactacctacgtctctttaagagatcaatgttagggtgtgaaataattgtgattggttggaaaaaaagtaggtgaaaaaaattatatcggggaatattgtgattggagatgggatggttcatagaaaatagctatattttaaagcaaatttgaatattgagtaaattgcacttacggtgcaacaacttggcaggtgggtgtaatttggtgcaataacttgaaaaatgaccgttctagtgcaacaacttggtaggaatgtgcaatttagtataagaactttataagtgatcgtataaatgcaacaacttgtaaggtaggtaggattttgctacaataaattaagaagttatgtgacaacttaattatttagagcattttttatataaattcaaatttttaagtacttattttgacaatatactagcatggatttatataaatatatttatatttttatcctaataactaataactgaaagtcaattaaactggattaagaaattattatatttcagttgataattgagaaggtgaagaaaacaaaaaattcttaaaggtaattggatgtaaattgtatatgcaacataattcttaaagattaaattcatatataaggtaatatccgtatgatcagtgtgtattggcatactgacatcgtgaaaaatctcatctagcatatgcttagctaaattgattcaataaaatactaaattattaagttcttgtactagaacgcacccacttgtcaagttgttgcactcggacgtttaattctaaagttcttgcactatattgcacccacctgctaagttgttgtatcgtgggtgcaatttactcttgaatcttagaagtaacatattttgagacagagtgagtagcttaaaaaaacacatctagtagttgattagcaaaacttcaggcctaatgcattgatatacatagcacatagctaaaataagtagttggttaatagatcaaatatgtctaattgcagcattagtagcggattgacagtagcataacacagctaacaaattatgattccaaagaaagaaactgtacaattgtttcagctttcctgagctccagcagtttatccggctggccggggtcattaagcttttgctactggggtcattagctagaaaataatgaacaattcacttgatagatcgaatgccatcggggtctaatgaccccaatgatagtactgcagctccgcccctgatctcttgcagaatgaaattccatcttgatcagtcatcttgtctagtattcaacactgctacaatatatgcacttacaaccaacctgtgatttgtacaccaattcaccaaaagaatctaaaataggcatatgtgaaaaaggttctgtgatcaaatatatgtgcatcgcacaaaaaggacaagttgtagatgcatcttttgtgatataactttctttgtttttgcagagcacataggatctttttctctcttatgattatttacaggtgcacatgttcaaacatactgggcatcatttttttaataatactgacaacataataataggtgttcatcaagtgttatctacttgtagaaactttgacaattatgctcacataatgggtgcatataaacttgagtttgtaaggttgcagttttttttttaaaaaaaaatcacagatatgcaagtcatgccttttttagctcctaatagcttaagctcatttcttttgtaataaagttgtgttgcatgtcagctccactggacctataataatttgaaatttggtttatgataaaccaagaatagggatgacatatcttttaagcaatcatgcaggagactctctattaaacttaacaaaagagaggtaacttgcaagaaaccaaaatgtggttttaaggtttcaaaaaagaaggcagactgtgatgttgtcaagatggtttacggcgaggcatttctctgctctagtacttctgaatacatctgtgccctaactaaatttccacaacttattcatgtgggagaggatgctctcttcagcatcattgatgatttggacctttagtgccactaattgttgcaaatttgacatggccataaacaacatgtggttgttggaaacaatttacttgttttattcttctgatggacgtctgctgtatgggtttcttcactgaaatctctagtaatcctacaactttacctggtcatcgagcattcatataactgttcaaccctgatggttttcaggttcagttggttcgagtgatactctggactgccagtcacctatcaagcctgataattcagaatccaggcatttgctgatcgacctgaatgtacctcaagaagaaagtctacatgttttctatgctccatctcaaataacttgtccaactttagttaattcttcgtcatcacaccctggagaattttggaatggctccagcaatgtttacaaaaaggaatgtggttctggtgttggatcatcaaaaggatcttccattacggtggttgcacccagctctgctcctgatagttcgagggaagttgtggctgcataccaatttcatgatcctaagaatttgcatggtaatatacatgcaagagaaaacagccagcatgaacatgcagtggataagttatgtggatcaagcagtcaatatttcttgccacagcaaagattttctgtcagttcctgtggcagaaatgactcatctttggccttacaaaaatcaggtgacaaccatgttgcctgccaatcaggacaaccacctctggctgtgcatactgagctccaacatgacacttctattgtaatatccagtggtgaagagaaggtcctttttgaccttaatgtgccagctgaaagcattgacatggaatcaacaataaccagtaatagttttagagataagctagtgaaaaatgatggaagtgaagaaacagtaaccgatcattctttctccaagagaaacggtgtgcatgctgaaacttctatagaagaacgaactgttggagaacatcatatatcagtcagcaaggatggaaacaccacatttttccaagaatcaataaataatgaaattgataaggcgcagtcttcagaccttataagtgttagcagcaaacatttgattgcagaaactcctcatgttgacaatattgtgtgtccagaactgcgagcatctcctgatggagcatcaagtcctcaagagaccttgataggcaattgtgacaaaatggtttgtattgcagctgagacactcgtttccattttctcaagttctgcatgtactacagattgcccaggaactgacagtcagacagcagctgaggatgtaaacgatgaaccgcagcactctttggattcctatgaggaaattgtattgaatgtagaagagatcagagatgacggggaatccatccctgtgattccacctgataaggatggaccgtcttgtgggatcaagctaagaagaggaagaggactgagaaattttctgagggagataatgcctagacttgtttctctttcacggcatgagatatgcgatgatttgcatgctataggttacgagccccggaaaactcgatctaggaaaacttttggggctcaaggttcatcttcaactagaggaaggccgcccaaacatcgtcccactgccaggaaatgatcaacagcatttcaagttcatactaggatgccacgagacgagcaattcagaagatgaaatataattttaaccttgtgaatattcatgtgtgttgtgcgcatcttcaaactcggtttgttactagtcactaaattgaggatattttctttattccttttacctcttgggagtgctgtgggccgttagcttcaaatttgagttcagcattggcaatgaaggcatagtcataccattataaaatctcagaattttgatcttttaagtattaaccctttcttaagaatcttaagtactcgtgatctgattccgatgaggattttaattttaaaagtcaaactttgtatgcttaaataaacagtagttaatatacaggtatatttgctgtatataaaaataaaaattgtaccaatagattcatatttcaaaacgcattcacacaatattggttttgtagatattaagaattacattttatgagaaatcattgggcaaagtttagttttcaagactttctacaattaaaatacaccttataaaaatgaacggaggcactgtttgtttttttgatcataatatgcctttttttttctcttgaaacatatgtggagttactgagtcagtgagagtattgtttctcaggtaatatgcatcactgccctgtggatcaattctaatgctgtctgttacagcttgcaatgatgagacctgggctcgggctgtgctgatggtcccaaatttcctgtgcaagacattactaatcagtttttgcatgcaaatttcacactccagaagaaagcaaagcatttgtttctcctgtggttcatttgatctttgaccccattgatgagcaagtgcagagatcataatgcccggtgtcacgggacatcagatcgaaggtcagttctatgagaccagcagcaattgagtaaaatttatgatgcatccagttatatttaacaccatgctcaccagtgttcagctagaatctgagtgacctcatacacctactgcctttacaattcaccccaaatccccaagaatccaggttgcagcagctatggtggtacataatccagcctgcaacaaacagaagctttgctgattgttctaaaatttgggtagatcacccagaatcttctaaccctatcgtttggcctaaacagccaaagaataagccaaaatttaaatttttaaacttgattttgaagttaattttgaaatgcttttaacataatttttgttaatgttggcttttaagtcgctacgaacaaatctacaaaagttttacttataaattaattttaattttctaataagccaaataagccattttgggccaaatgggcaaccgatgagagccttcttatctcgatttagaggatgaattgatcccattatccaaaaaaaaaaagcttcacaagtatatatctccctccgtctcgtatcctaaaataactatgttttgggatggaggaagtatatccgtacacaaggcttaagcttcatgttcagtaaactgatcagtgcaagaaaacttcagaaagtgtgacatacattagtgccactggtgtgcacaaggaagaagaaatgatttgctactgttggagaagacctaagatctcaccatgatggcctgagctacttgtagaagtagaagtatactaaagcctttatgacctttgcattggccatctagtcggtctagtaataaaggtttggccatggtcggtgggcaaaggcaagtgcttgcacatcctgcatcattgttagatttactcctgttgtcagatggacatgcatcccctctcactccccatgatcatcatcacatcagatgatcagatcggattcagagctagcccaatcttcagggagacctgatatggccaagctagtcaaacagccaaagcatagtactccctccatccacaaatataaggatttcgttcacaagtacaatatttttttggtcatgcacgtcgattgccctccgtccttaaatacaaggaatttgttcataaatataaggatttctacacaaatcgttatatttgtgtatagaggtagcactatctcaggttttctttgaataaaaggtagtatagtagtactagtatttcagcaaggacattcactgttaaggcagtcaaatgatcaaggagccatacatctagaatacctataaaatgtgcagatagatagtgtatatacggctgtttgctgcaaattgtaccagcaacagtagcaatgtggcatgatgattgcagaggaggaataactggtgtgggctccagagatcaatacagagacaccggtaggcttggattgaaacaaaagcaagcccaatgtttattactgcatctgtttgaccacatggagatgttcagttgaggcaggcagttaaccagccattcaggagccctagtatctgaatcctttttaatggcaggtcaaagctacagtcttacctgtactggcaacaattaggcaacaatttatacagacatcagctgcagcaattacagtgttgcttgctgaaatgctagcaacatgcatgcatggcgaccttaatggcatgttgccatgttcccaaccggcaatacacaaaatgaccttcttccctcttttggacgcatgaattttacaggattttcgtaagatttagttcgtcagctcagactggaatatactggaattacaataatttataggatttagttcatttgttatgagttatgactgaatatactggaaatgtagtaatcttattactgtatttctatcatcttagtaccggcttactgctttactgcatgcagtgccacggggctactggaccattcttttcaggcctggagtttctgagtgtcagttaggtctagtattcatggcattgcagcattcactgtttccaaaggtgagttctccctcgcaaaaaatgctgcaatattcagaacacacataaaaaacactccttgagaaaacaagaagaaaattcagaactcgtcctattcaccattcccgaaaattgacgcaagaacaacagtgcaaaatacacttctgtcttactccgaaaataccctctctctccattcaaaaaactcatgtgtactcccttcatcccaaaatatatgaaattttagttggatgtaaattatcccagtactacaaatctagatagggatgtgtcacatacaaccaaaataccttttttaggatggaggaattatttcttatgtaattaagactaaggagaaattaactcatccaacgtgtatacaagtaataattcgatacataaacttaaaatgaaaaatgaattgtatgcctgcatgcaacgagtattaagatgcatgcttgggttctgatgaataatttaatctagaactataaaacgaaaacacaatctcttcatttaagttttggaataaatatgattattttatttgaaaaacaaactataccttagctaacacttttgggcgaagataatagcatttttttgttaacatagaaaaaatcactatatttttggatggactaggatatataccaaaaagttagacggaggtagtacctgtaaccatccaatcaatcatccatttggagggagagaaagagaacgatggtccagtagtgttggctacagtgagctggctaatggccatgtcctgagtactctctcactcttgttaggtgctttgatcacaagagacattgtaacatgccaatataatccacagccacccctaccctgcagccctactacatgcaacaagatccaaattaaagagacaaagtgtgaaaatgttgtggcagtatgctggggcgggtcccacctgtcagctatgggacgcaaccatgagaggaaaaatcatgtcctctaaataactgctcacaagtcatgatcagaagaataatgacaactatgggctaacaactcaggacatggatattacagtactggcttgtcatgaaaaaagcatcaatcaattaatagaaatcgttatagcattaggggatggtctcctgttcctgcacaattaaggctgtcaacttctgatggtcgtgtcagatctttttaagctttggtgttaattagcatcttataccatgcgtgcacaagatcttgcagagtttccttttagctcttccgaacaatgaaggtttctcatgcaagcaagtaatgttactgatggggattttttttgttgtttcctacagtagttttcagctgcattgtcaagcaagagtactcctttctgttgcttctacctcgcacattcaatccgtattaacatctataaccaatctgttggtagttaacacagcagatgtactccatccttatcagaagaaccctcttatcacaatcaatgattttttttctttaacttggccatgttctttcaatatttatccttccagatttttctacagattatttgctccacgtttctaaaaatacaatttttcaaaaaaaaaaaactttcttctaccatattgctatctattctaagctatttgcaaactttttttaaaaaaataattaattgtgttaatcattgaacaatccgtgtcaataatctagggaaaggttgcatcaaaatagttgagcaaggccttttcttgacgcgacactttttccaattcctacgaaaattgaattgattcctaaaaaataccctgcagagtggaatttcctgttccataaacattataatcattggctgtgtgcgcccgcagaggccggaaatataagattttccattatcaaaaaaaaaacaaatacaatgcctgaacattatgcacaatatatcactattatatagtatatactaaagtcagcatcttgtacagcaatgcatgagcataaggtagcatagcaagcaaagccaaaacaggggttggaagaggaagacaacaaatacaatagcaagggtccaagaagctagcatccaagaagtacattttcctcttatctcccccctctccaaaaaaccagagagagcagccacgagaccggaaacttttgctgcggctggcttctcaagatgttgccaacatccttttataccctacctgccaaaaaaaaaatttctctgcaattgcatgcagatgcaaacaagcaagccctcccatggcattggcaatcatacattcataccagtacatgtttccattggttgagaggagaagagaacacacatgctgtaacaagaacacttcaaacctacggcgacaaatctctctgcctctctgtctgtctctgcctgtgaggggaaaaaaaaggaaaaagagaggaaaaaagagaaagaaacaacatatattttgctgcactgacacacaaagatgaaattgcagagcagaagcaaagaaggcatccagattacagacatgcatgcaggacaagagaaggataaaaagagaaatgtttgaaaaataaaagcattgcaaaaaaccgtttctatataccatttcaacattcagaacaaaaaaaaaaagaagaaatgagcaatcttttactgttttacacacagctctgttactacgtacttgcaatcttgcatcattgccatggcaatggcaatggcgatgcaactctctcgccaagaaagtgaaaggaggggaaaagagattaagaggaagaagctaagggattagtgctagtagattaacgagtggttaaatactgatgggtgtttgatggcaatggcggccatggatggatggatttggctagaccttgtagatgatgaggaagcatgggaggacggcgcggctgtcgaggaccaacagctcgccgttgcccatgtcgacggagtcgtaatccgaggcgtggcgggaatggccgtgctggtgctgcgcggaacggacgcggcagacgatgacgcggcacaccagcatcgccctgcggcccgggccggcaccggcgctggcgtgcgcggcgcc

SEQ ID NO: 58279 - DNA, 94288 bp, Oryza sativa
tcgtgccaaaaacggcttctcccacaggaaaaaacggtagaaattttcctctcctcccggatcgcgacgcgcatgcagccgcgatggggggagatggcgcgcgcgtgctacaccggtgcgggggttggtgattggggaccacggtggttttcacgtacgagcgccgctagctagctgtgaagtcgatcgggataggggaggggtcgcgccgtcaccgtgtaggggtgtgcagctcgatgattgagttgtgtgtggtttgcatatgcacctgcaccaattattaattgtggcgcacccggtccagttatatgcatgtttcgtacctgggtaaatccacctttggattcgcttgtaccacgtgataattggtgtagaatttggccccatagtaaacagcactagagcagatcagcactgtcattcacattagcagaccggcaatcaactggagtacatacttcccaagtgacaaatcctgtaatagcatatactggagtatttgtgtgtcttaaaataaatacaccgcttatacttattcctggacacggagggagtacaaacttttatccttttgcgtatttgtgatacagtactcgtcacatctcgatcaaacgacggagtataccagagaagaagaacgaggcatggcggcgtaggcgtgcatgcatgatggcagggcagccgtgcagacatgcaaaataacgaaccagtgggtccctctaggagaggagctgtgatgacaagactaggcattgcatgttgcaggaacagcatactacccctagtagtactagtagtgttgcaggtcggatgcagagatcaccatgtccatgaacactgtttgccatgccgtcccgggagtagtagtagtagtagtaggattgctcgatcgtttcttcgtctcgagatcgtcgtcaacatgcatgcgctgcgggcggcggcagtagctagcaagcagcggttgatgggctaccatggacgaacacatggatcacatacgttgtgctggtgttaaggctgtgtttagttggggaaaaggaaatttttgggtgtcacatcagacgtttgaccggatgtcggaaggggttttcggacacgaatgaaaaaactaatttcagaactcgcctggaaaccgcgagacgaatcttttgagcctacttaagccgtcattagcacatgtgggttactgtagcacttatggctaatcatggcctaattagtctcaaaagattcgtctcgcgatttatagctaaactgtgcaattggtttttctttttgtccacatttaatgctccatgcatatgtccaaagattcgatgtgataggtgaaggggaaaatttttgagaactaaactggccctaagtgtgaagcgaagatgatccagttcaaacaccatgcaatgtgttgtctcgtcaatccgtcactctggtcgccgttatcttcatactggtatttgatatccgtacaaggaatccgctccactgctgccaaaattgaatcaaacagtgtgtgttgacaccaaaattagaagtttagttgaaattgaaaagatgtgatgaaaaagttgaaagtttatgtgtgtaggaaagttttgatgtgatgaaaaagttagaagtttaaagaaaaagtttagaaataaactcagccaaaagttatataatgtaagctcactgggcctagatttttattgctttatgttggctgtgtttagttcatatgaaaattggtttggttgaaattggaacgatgtgacataaaatttggaagtttacgtgtagaaaaattttggtgtgattgagaagttgaaagtttgaagaaaaagtttgctactaagattagtattatggcatagtaatattgcatactattccaaaaagaagacaaaaaggtaaccttagtagagaccataacaaaatccaaaacgacaactagaaaaccataatacatttccgcctacaggaggaggaggagcatcgcatggtgcagctttcctcggacagagcagcatgacaaagagcatatggagggccctgttcagttatccccataaccccgtttttggcgtttccctgcagttccattccatgcagcgttttgtacaactgcatgcagctgcctgtgccctgtgccctgtgccctagcaaacaagaagtacttgtatacgattgctggagtaatttgcacaaatgatgccctctttttcctgcgatcgatcgggttcagagtggctcttctcttccatcactgatctgatcatcgtcagacaaggctagctctgtagcagcagtaaacagggcgtcgtttcatgccgtgtcatgtcagctctgcttgccacggtagcgagatctacagttgcagggcttagctatagctcgtcacgatcagcaggtcagtttcgttagagttgcggcgagatgagaggaagcatggatgagccgtagcaacagtctctagatgccaagttcaggacttcaggtttgtgccactcctctctgcctgccgctaccaacaaagcctgcaactgcaagagccaagagaccggctggcctgtggcctcttctttgtactctcactctctaaagcaaagtgatttgtcgaagctgaaagcatctgacgatgcaaattaattagtactcatgaggcttaatttctgcagatctggtttcttctggcaaacacagctgattgattgtagcatgatttcagagtttggagagcacaaatgtttcgttgacagttttcaggacatgcatgtgaattccaaagcgattcagaatgaactgttccatttctccctgccagattcataggccatgcatgcattgatcttgctttcttgtggcaaggacggcgtgagtgtctttctttgtccactaatcatcagaggagtagctgcaaacggcacatgggttccacgcaaaacaccaagaacaatggcagatatggtgtacggtgcacattaaaatagacgatacggtcgtagaagctctcccgtccctccattcaagtactcccttggtcccatgtaaaaaaaaacaatatattctgataatctagataggtatacaatatagcataccctttaacctaaaaagaattaaatcctaagtacgaatctggataatgcttattcatgttaatagctatgatttaagttaagacatgtcttaaaaaaatatcattaactaaattattgattagaattatttacttgattataataataaaaataattttaaaaatagattcaacaaataacttctagcacgtggtctaagtaatgcagccgaagaaaatttgttaacaaaacttatttttaaacatgtgatgctggaaataatctatggcaataatttgatgaagtgttttattcacccattcattttacaacaagccacataaaaatttaaattttagaattgactcagagctttttctctatattttgtagccttgatttttggataactaattagaagttaaaaaaagtgtcgaagttaaaagtcttaccgtcattttttttgttgcttcattacttttttaggtttataacccatagctcaaccaataaataatttgttgcataacacaaatgttgtagtagtaggctggaatctccaaggcatggtactagtttcaattaaaccaacactagcttaaactatttcgattttaaatagtaatctgaagtcaaacgataatttagaataattctcttgtttctatacgggacccttagagcaagtataatagtagactataagccggctaaatgctgaggtggaggagagaagagaggagagagaagaagcgtgctataaaattatagccagcttggacacaagaaccaagaaactctgtgagagagttaagtgggccctgtattaattataaagagctaactattatatggataggctgagagaaagctacaaagaatcttatagccaacaggtcagcttaggcttgctcttaacatgccacctggtctgaaaattcccgtgccacaaaacggggaccttgtgtcccttttggtcccatgcatcgtcgttcttaacaagcaagatcacgttttggtcccctttcactaatcatgggaactaacaatcctgttgataagatgttcattaggccactgtttattcagcacggtttctattttataggtccttttccatgttcttgcatagccaaacttaattgataaatgagaataggccatgtgctaacacagagttctaaacaagacagcacggaaacaaagccagtttaagcgtgacaagacatgggagagagcagcacgtaacaacttctccaataataccccagtcctattttaaatacagttgtaggttgtgtctaatatttaatcatctatcttatttgaaaaatttataaaaatatattttaaaaaagtcacatataaaataatatttatattttatcatcaaataacaataaaaatattgatcatgaaaatattttaaataagatgaacagttaaaggtaaaaaaactcattactatatttaaaatggaatgaagggagtaaaatcgacaagacatgacactacgattgccaacgtaaccgagagtcatcatggacgcctatccataatcagacgaggttgtaggttggtagaagtatactaatacatctgtcctaaaatataataatttttttgttatgaatctggacatatagttatctatatttatagctaaaaatacttatattttgaaatatatggagtatatgtttgttcagaaaatggcagagatatgtgtaaaacgacatttcatatgaatgcacactaaacgagggtcactttctcgtaaacaaactaatctagtatagatgttgaatctcgatatctctctattcatattgatagtatagtgttaggctgttagcatatgttatattcagtattagattgagtatttttagtagggctaacgccgaaaatcaaacaaaccatttgatgaacattttttttaattcacagttgttgttctacctaaaaatatgtttaaaatgaaacttaattgaaagcttctttgagttacagtgtgctgtacaggttggagtcgcatgcatggctaaacgggagaagttgaccgagagggcaaaccgaggtgtagagccgtgagcagctcagcatcgatctatggtcgatccagtaggatcggtcgatcaaaatcgaaatggatctcatgagatagctttctgaccgaagccgacacttctctagtccccagaaaataacacctttcgcccactcacacgacctatggtctggaatgattattgtttctattatgagaaaactttttgtgaattctgacttgaattaataaatagtaactctattgtatttagggttttttttagtagtttagcaaagctactaaaagttttcttttggttttgcaccaaaaatgattagaacgcgacataaacatatcagaattgtcaaatgttatgtagcaaaaagtaactgtcccattcgtcttgttttcacaagtaacagtgtgctactaaaactgtagtttggtttggcgcaaaaaaaaattctttttctactgaattatcacaaaaatgttaagatcacgacatagacaaatcggaattatcaaatgttctgtagtaaaaattgaccatacataaaactgtcccattggagcattgggacatcatggacacggttcaaacatgtggacaacactagcccgtgcaacaggagcacctaaaccgcagactccgctcactcatcctcctaatcacctcggaagtttggaaagagagaaatacgtgagtcttccagcacatcaccacaacaccgatcataattatgggtaatttggaaccatgtcattataaattttcaaagtttgaaatatgtcattggtatctcaaagacacatatgacccacatgagtcaatgacatatggattaggatggtatatcttaaattttgcaaaatataatggtatggttacaattttccccataattattgtagcataaacaaaagaggaggccagagcttggtgcctagtgagggcaaaaaaaaaaaaaaaagcttaaagagctaatgttgttgtgagaatagtcccctatgtaacaccccttaacacttgcacaaaactaaaccttcttctttgttaatgaaaggagactgtccttctaccctcttattcaaaagaaaaaaaaaacagactttttcaaaagtaacagttcttggtacaaagagcggacttttcttccctaaaaacttttaggccccgtttagttcacgagacgaaaagtttcaaagagtcagatcggatatacaaacacacattcaaagtattaaacgtagactaataacagaacaatttacagattccgtctgtaaactgcgagatgaatttattaagcctaattaatccgtcattagcaaatctttactgtagcaccacattatcaaatcatggagcaattaggcttaaaatatttgtctcgtaatttacacacaatctgtgtaattagttttttttctatacttaatactctatacatatgtcaaacattagatgtgacagggtgaaattttttttatttacgaactaaacaggtctttacatagtttgaacacgggtagggctgtatttagttcacaccgagattggaatttttgttgaaattggaacgatgtgatgaaaaagttggaagtttatgtgtgtatgaaagttttgatataatataaaagttggaagtttaaaaaaatattttgaaactaaccacggcgtaggtcgaggtcgatatggatcgtatcaatcgatcatggcggcaggcacgagctaaggtacggtggcccatgcaaggcaaccactggcaacaggcaagcaaagcacggccgccgctagctccagctccatccaactccaagcagcctaggggcaacattttctccaacgcgacacacaacacacaagtggcgagctcgatcgtcggctgtccatgccggtcaaaggacatgcacaagctgccattggtggatgcatggcccgggaccgacaggcgacagctacatgcgtgcaagtaccatggccatttgcagattaattcaatgcccaaaccctctctcgctaccatcgtttcacactatttccaatgatcatttatccagttaattgtccttgatcgcaacaaaatatagttcctccctccaggttgtaatacccgttgtttcggataaagacatgatttaaaaaaaacaactttaatcattattttttattataatatgtatataattgttaataaatatatgattttattaaagtactttctaatactaatctatgcatgtagtcacctgtcggtgatatgggcccgggaatatgcacagtaaaggaaagtatcgatcccatctagtcgcataaccacgcggcctcgtctccccacgccccacggatagcgctaaggtggccagggagcctcggggtgccacatcacacccctcgggctttcgggacgctctaccccgaggccctcgaccagccaccacgtggcggggagagcgggcgaggcagagggcgcctcttagggcctttaatgcgcggcactccaaccgttcctcactgcatttaatgcggtgtgggtggacgtgcggcgccgcccgatagacccatgtcaatcgggcgtgaccggtttatgaccggtcacgggtgattggacgggcggtagcgtccccacgtcccaccctgtgtcaggcggagtgggggcaggtatgccccgtcctatcgatgcactgccaggagcgccctccgcgcgtggtgagccaccaaagtctccatacatttaaaggggaatgacagggatgtcccccgtgtcaggcgggggacggtgctgggccccacccaaggacgcacgaccaccttgcttttggttgaaggcatgaatggcggtctgatccagacagggtgggtccccctcccatgggaggggtaggtatagacggtgcatgtggtatccccttgaactataaaaggagaacctcgcccatcgagaaaagggacgactctcgattgcttgagctctagaggaataacagctaggtttccctaggagctcaagatctcttgtaagacctaaccataatcccacacacaggagtagggtgttacgcttcccagcggcccgaacctgtataatcccttgtcttccacacaaactcgtgaacgatccagtagttagatcccaagcggaagtacgctcttgatcatcgcgccatctcccccggccgaactcacaaagggaggtctcacgaccacccgctagagaggatcactcctcgacatcacaatatttgaaagacaaatattttaaaaatgattcataatcaaagattctaaagtttgacctcactttttgtctaaaacgacaagtattatctgcccagaaggagtatatagcctcgtagcttcgtttatgtttataaaactaaaattcaaatttatctgtttataaagctaaatttcaagtttacaagataaattttgaagttgatttatggaaaaaagttaattacagtttagtgttttataacatgtgtttttcaatagctgagaacacgtatataaaagttttaccgagaaacaaaacaaattattttgtttgttaataaatagtatggataaccatgtgaataagcaaggaaatgaggctaataaacacatgaagaattctcactatcttacatatataagaagatatatatatatatatatatatatatatatatatatatatatatatatatatatagtttttgggaagtgtacacataggtagcgagcaaacctaattaacccccattacagcaagtacaaaattggtagccaatcttttggggtccctgcacaggggcccccacaaagtccgtgcctacctagtcttgtaacagggaggagtttgcaagcttagctggttctctcctctctcaaatctcgtcaaaacactgcttgccctaaagatggtgaccctagccagccaaaggccacaccatcatccatcaccacaaccacacacacactctctttctctctctacaatgctactaataatcataaggggattacaattaagataggtaatgagagcaactaattatataatagtagggggaggtgttcatgattatctgtactagcgatcgaaacacggtttacgcgtacgtgacgatctgatgatgatcacgcgagaggcgacctgtgtggggcgcccttcctcctgttgttcagtgacagcacgatctgggggaagaacccgccgccgccgccgctcttcttcttcctcgggacatcggccgtcgttggcgccggcgacgtgctccggccgttgttgctggagccgccgccgccgtagtactggtggtggtggtggtggagggggtcttcgaggatggagttgggtgtggtcacctggtggtcgtcgtcgtcgtcggagaggccgccgccgccgccgccgccgccgtcgacgcggaggttctcgaagcgcgggaagccggcggcgaggtcgggctcgccggaggagccgccggacatgtagaggatgttggagaggtcgccgccctgcatcatcacgtgatccacctgcatgccaatgcatgcacaaattaattaacgacacacagtcgttgtagttagtagctcactctcacatctctcgtgacaaaatttttcacccgtcacatcgaactcaaatgtttgatacatacacagagtattaaatatagaaaaaaaaactaattacacagattacgtgaaaattatgagacaaatcttttaatactaattgctccatgatccaacaatgtggtactacaataaacatttgctaataacaaattaattaggcttaataaattcgtctcgcagtttacatgcacaatttataatttgttttgttattagtctacgtttgatacttcagatacatgtccgtacatctacgatgtgacacgctaaaactagtcatcctagatctaaacccaaccttattatcattagagttgtgtgtcgttaattaatatttctcaatcgatcgccaattcgccatgacagtaaaaaaattttctggaagatgtgtacagtggctatactacactactgtaccttgcaagagaggcagcagaaatggaagggctcctgcaggatcctgtcacatgtcaagcagatgttgccagagcccttgaacggcctcgactgaggccttggcttcagaaatatcacctttgcgctgttgatcgtgtatggctgaaatcaaattagaaccaacattaataattagctctacataatagtaaaactgaacagattagtttcagagtttttattgccgttcaatttacctgaacaaaggagcagtcgatgagcttgtcgagatcatccaggcgaacaacgtcgttgtacacatacctcctaacctatatacacgtataagcacttcaatgcacagtatacttatacgtacggtaccgtttaattctagtgctagtaaaagaatcttcggacccatcgtttgcaaacaaaaagtaatttgtgaatataacttttatatacgtgttttagacaatataaaagtaaagtttgaaaaataaacttcgatgaaaaaactctcaaaatcagctctaaatttaaggttaaaaatttaaattttagctgataagcataggccattattccattattccatccaaattcaaattttagatgagacccttctagaagttgtaattgttgatgaggtaaaaaaaaattccattattccatccggacgctgagccaggcagggaaaggatagactcccccggtaataattgcgagcctttgaccggcggctcgtcgtcatccacatcgtgggagggagaaacaaaccctaatttaccataccacccctacaccttccacttctctcggtcacacaacccgaggtcacaaatgtaaaaaaaaaaacacctccaaattaaccccatgacactgtaaaaaaaagatagagagtgtgtgttactgcctgaacgaatgaacagtatcgtcacggcgaccttggattatacagagccggagcaacagtattggggccttgtttggtaggaggacagggtcttttaccaagcacacatatggtaaaaaaaaaaacagagacactgctcacttttttttttactgcatctcgccaatggcttctctgtggtctgtagcctgtagtttctgtcactgtgactactgcagctgcgatcttaacagctctggctttggctgagacgatggatggatcgtagctagtatggctagatagacacaggattgcccatccatttatcaaccaaccggcaccgtctatctttgcagggatagagatcaagatcggcatgctttgctattcatggctaaacaatccggataacccaacccatttttgtgctaatagatcaatcttgctcactgctgcagtttggatgtatttaagaattagagcttttgtagttgcaccagactctctctggaaacacacaaattttataaaagtttgacaaaaagaagtggttcattttatgtggtgatcagaagtttttactggttaattataatggagagcaggacacaagggctattgtttgtttaccgctgtcaaaaagagagatggccttttttcatcagaggtgatgactgtgtgtgctggcctttgctgctgctgctgctgctgcaaaatgtaacttttgcaggtggtgaggtgaacagaagagaagagagagcaatgcattgcatatgctttgcacaccggaatggggaagatgtaagatgggactaggcttaattataagactatggttatttcaggcgtatgggactgaggctcgcagtaacttcttgccagagagagactcatttttcacccttcttcccaattttaaccactccacatttctactactcatggcccaccaaacagcagccaaggacaggaagaaaaattaagtttggcaaagaaaaatacgcaagaaattaaggtggtgattagcagtgtgaaagtactaatgtgtgatttaggtgactaatcagggtgattaaccgaggggtcactttgcaaggagcacaaaacgaaggccggaaaacgacaaggggaagacgaaagatgggcacagggttctaaaagggtcgagagctatagctgcaagtggttaagtgagacaccccatgcgatgcagcttaagcccaagcaccgccgcaattaagcccaaccaaatctaaccaaattatgctagaaatactactgctactagtactcctagtggcacactagcatggtcgctgatgagaggcaattagcaatctttcctctgaaaatgacacaattagcatgtcatggcacatggaagaatcaacaagatcctctagctgcccacatctactggtactagtagaagcaaatcttggaataagccaagacggaaaggctagtgaattaggccaaagctagtgcttttttgttaagtacaagctagtagctgctatacatgcaaaagctaaaatcctagcccacacccccacaaatccactcaattcagcacactgtagcacacccccaacgatttcaaagcagataaataaacttgtaattgaagaatttcaacagactaacacactctcacatcacatgcataatctgaaattctgaatacagttaagatactgcaattaattaacgaagaagatagacatgcatcatatgatgcatgtagctagagatatatgcagtgtatcgaggacatgcatggcatggcaattgggtcgccggcgccggcgccggcgacgaagacggcggattgattacctggaggagagggtggtggcggtgggagggggcgcagtgggggcagatgctggcgcagcagccgaggcagaagatgttcttctcgttcttcttgcggctctcgtgggcgggacacccaacgaagaagctctcctccacgagcccccctacccatccaggcctcatccccatcaaccccttcgtcttcctccaatcctcctcccaattctctcactttcttggccacagctacctagctaccaacaatctctctctgattgagtgtatgtacgtgcgtgcgtatgtatgtatgtacaggtgagaacagaaattaaagatcgatgcgagtttggagaggcgaggagaggagaattgggagggattagtggtggatagcaatggaggaagccatggcagggtatatatagagcgggagaaggtgaaggagaaggaggaggagcttggtgtggtgtggggcaatggcgtcaaggggacaccatggggttcggcggtcaaaggaccaattgggcgtcacggtccaagtgtcggggaccttctcgacaatatccaaccaacttgaggggtgtttctgaattatccttgctcccatggaaaatgatcggtctctgcaaattgattctttgctaatttaaaaagtactaataagaaaatggaattttgtagtgccgtttgtacggaaacaatgctaggccgagcggaaattttcgtgaccgtttttgtccctcacaactttgtgtgcagtcgggcaggattagaataacagcgttatggggtgctttctgcgaagggttgtttcgctttgccaagggaggaggttattgccacctgcgattcatgtcacgactcgtgagagaatataaatcatttttaagtaaatttcataaaactataaatattttaattaaattttaacaaaactagggatatatcacaaaactataaatttaacggcaaatctatcgtaactttaaggctaagtattgcaaaactataaatttaataataaaattatcacaaaactacatattttaagctttagttccttaccactaatgttatatttgagttatgaatatccaaatttagtgattaaattgacactaaacatgtagtttcgtgataattttgttactaaacctgtagttttgggatactccaacttaaatatgtagttctgggataaatttagtgttaaatctgtagttttatgatatatcatcttaaatctataggttttttaataacttgacaaaaatatttatagttttgtgaaatttactcatcattttgttttgggtaatttaatacttgttcactttattatcaaaattaaccaaatatttggcactttcaaaattcagtacatttgtcgctactaaattttggtgtcttttgatatgtcgtttagtttgaaactttttaaattttggtcatgtttttgtgagagattttctagaacttccaaattctaataaggtagatatggtaagaatgtgtttattttgctatcctaccaaaattggtaatataaaaaaatagcagggttaaaaatgataatgaagtgaacttaagctgttgtttgcactgatgaagtgatgagcattatacccctccttttattttattttttttgaggacgacccctttttttctgtcatcataaaattgacgaagatactgataatttcacatatctgctgctaatcttgatggacatcggtgccataaataaccatcttaattatccaaaaactgccatttgttcttccacctttgaccacataaaacaggagcaggcattcccacatgcaacagccgcacggctgcctgaagactgatatgattagtgcctgatcgaatgcacacaaatctttttcatcagctaccatagcattagcgtggtcctgatctatgctactaactttttaatgtgttcttgaacacagtagtacagcacagacaagaagaaaataaacctcctaggttgctgaattccagtcatctcaaaatataataacttttagctattaatttgaacacatagttgtctagattcataactaaaaatgcttatattttgggatggagggagtaacaaaaactgcaataccactcgttacaatctgaaatccccattcttgtcaagccttaatttcaattttttttcccttcaacacatacacagcttctggcattattcttccctgcctcttcacaacctgatcgagcacttactgctgctaccggagtagtacaagtttggtaacgagagaagaaattcgagctgttgctggtgttcgtcgctgctcacacagcatctctgcctttccggttagcccagtacaaacagtggtacgtactgctgccttttggtttcttgttttatgtggcccgaattcttttttaccctcgcagcaatttcaaagctcctttttacaattttttcacagtttcttggccggtagcgaacgcttctagcttttttttcatctcaatggcgcagtacactctgtaccatctgctatctcctacccaaaaatataaaaaccttgaatcagatgaaacgttttctagtgcaatatatttgaataaagatatattatactagaaaacatcgagtccatccaaatacattgtactatagaaatgtagcatccggttttaagtttttatatttttgagatggagagagtagtactacggcagtgtttagttcctcccaaattcccaacttttcatcacatcacatcacatcgaaaactttcctacgcacataaactactaactttttctccaaactactaattttctcccacttttcaacttttacaccatctaaacacagcctacgtaggagtacgttgtgttgcttcaaattttacagctgtatcccatttcatatttcttggcatgctagtgaacttctctagggagcatatttggttcattggttgttgagtagtagtactaccactataatttggattgctagctactccctccgttttaaaatatttgacaccgttgactttttagcacatgtttgaccgttcgtcttattaaaaaaatttgtgaaatatgtaaaactatatgtgtacatgaaagtatatttaacgataaatcaaatgatatgaaaagaataaataattacttaaatttttttgaataagacgaatggtcaaacacgtactaaaaagtcaacggtgtcaaacattttaaaatagagggaatacattatttatagaatttcttgcccaagttttgtggagcttgtaggggatgattgtgttagctacactaaaatgtttttattttgttaggtggagaccaattatatctagctagtagtttttcctggtaccattccttttggggccggtctgtggatataattttcggactcagcatcattgcatttgatcagttcctggccagatcatcagtttagcagtttctctaacacgtgtttgtagtgcacatgacatgatcaaccaaattcgctcatttttatgccctctctggcgcatctcctgcgcccatgtagttgcgaatctattcttaaccttaagcaatttttagcatgtcctagctaagctagagtgtgagatctatattatattattccggtattatttcgcatgtgcggccttgtgcaattgtgcacgctggtggcggcgtaaatcgtttagggccgtcctaataatttgaaagccatgtgtcaaatataaaaattaaaagtcttatctttagtaatactaattacataccccctccgtccaaaaaaaaaaataatcctgagtttaaatctggatggatatatatgtgtccagattcaaatctagaattagtttttttttcaggttcaaatttaggattggttttttttaacgatatgtgtcaggattcaaactcaatattaggatttttttttgatgaagggagtaatagaataatagaataggctatatcttatatttacaatataattaaattgcagttagtggccttccaaccatgccaggaaagctagtatcaatataatgctcctttatttaattagctaattatatcctgctatcaaacgaacagaaattattcgcaaccaataattactagcgctatgtcaagtagcttaattacccacctaaatatgtatgacgatctgaccaagtagaagaagaaccgttgaaacaattcagctttttcttactaaaagaaaaaataaagctgtagccatgcatggttactatatcgaagcttgtcggaattaaaaaaaaaaacagcttgttctagccgattgagtggagaaaaacagagatttgagaaaatagaataaacagattctaattatatcggaacatattgccttgaataatagctagatacatacggagtgaaagccctatacggttgcacagctcacacgtgtctctagatatggacggacctgcgctaaatataaatttcggtagacacaacacatcaacagcctaatcaacttggcatatactactccctccattttataatgtaaatcattctaacatttctcacatttatattggtgctaatgaatctagacatatatatctatctagatttattagcattaatataaatatgagaaatactagaatgacttacattgtaaaacggaggaagaagtagtacgctactgtaaacagcgtcggtaaatcacctttccaacctacgccgccgtacgtcggatcgacaatctcgccgacccaatgattttgccggccgtacaagcccttggacctcaccgccggtgacaaaatggtaagtgcaatgcatggttaattagccagccatgagctagcaaattctacgcaacaaatcacctgctgcatatatatacactccaaaaccatcaccaatatacagacgacaggccggttcaggttcaggccatatatatatatgctctctaacctgaaactcgatcaatgcaagagtagcattggtagctaaaacaatacaacatctcgatcaaaatgtcattatctgaaaataaaacaaattgcaaatgcaaatgcaaatgcagcacatgttgtagtggatagctactaccactagtggcatgtactagtgctaccccggcctgcatgtacttgctacatgtgatggatggatcaaagtaggggcaataagtgcgagaggaggggttagccgtcttgacgacggcccttgtcgtcgagcccgttttcggcacgcctacacgagccctaggggtgtccatttccggcctcgcatgtgccttttaactcttgctccagtaacctgatcatattatgaattcagggtgtgcaagtcaagagaggaggagagaaattcaattcaatagctgatcctggcccatgtacatgcattgcattgcatatatatgactctgtgctagctgctgccattcgatcggtttatcttatccatcaagtgtgtttgtgtgtgtgtgtgcaagcaatattatggaaaccctgtgccatgtgaacggtttctttctctctcacctgaacaaagctaagagcatgccatgataggattggtggttgaagaaggcatggaattttatccatgtgcgtgcgttcgcggttggactatccgcttggttcaaggtagcttttagcagctgcagggtttatcttttcgtttttgaaataaaaaccgcttcgtattggtttactgaaaacataaaactggtgaccttcggtaagcgatgtacgaaaaccagctaaaacggatcggttttcacaaacagacaattaatgtttttacagaagatgtatgaacggttttgcgaaaaaaaaagatcggttttgtgaactctaactttatttctaatctccaactctctccaaacaattcatatttttcattcaaattcttaaaatctgtagttataaatcctaaaaaaaaataaatcaaagttggttattactacctttgaaaaaaataaatctgtagttattgctttatgaatttgatttttatgcttcttcttctctctttctttttaaatattcagctttgatgaggtttagcaggattgcagctaactgatgtctatgcatatgacaagagcaataactctgttcttgtcaaatcaggatatatagtataggtgggtgaaatagcatgtgtgcatgtgttgcatttagaagaaggaaatgcatcgagagaaattaaagagcatgcattgcattgcatgctgcctttgtcgttgtccctagccaagttttgatgaggatcacagaggggcccaaagtgcatttaggggactgtttccaatacacgcctacaggcatatatatccacggctcacatataaccaattttttgttagtaatagaagatttgactgaaactgttaccctatcataacccaagatctctgtcctactactactactatttactaaaaaaaatagggtgcaacaaaaaattaattaattaatttattaacatgcatgtcacgttttcgcaccgctgatgaagcccaaacttaatttgcagcaaaggacatatatatatgtgtccagtgatgaagcccacaggtaaaggccttcttaatcttgagattacgccaagaacggcccatgtatcatatcgtcggctgtgttgctaagatgcttgcgtgctcactttcagcttggaaaaacgcaatgaacagttgccggggcctaggcttcgtccatccaccatggaatcacctacgtgagagcagtattgcagtaggttataccacacaacgaatttctgattaagataggttacataattaacataatcgttcaattaagatgcacattctatctcgattttcattagcatgtttttcaaatcaataaacagcttttttttaaaaaaaaaacttagtagcaccctatatcacccgttggttcccttagtcgacatgtatgaatcgacctatggtgggcgggacctcatgtaagacgctgggcctcaaagtatgggtcaaagcctaaatcatagagagtgatatccccatatacgaggagactagcttttgggatctttcttggtcaggctccgattaagctcttcttagtgaaataccatgggggtggtttttcccaaccaactaggtttatgtgaaaactttatatttgtaagttgccctaaaattttaaataaatttatttttaaagtctataaaaatttatactcacttaattatataataatggcttaactcgttttacatgggctaaaaaatcttcgtgtgctagtgagaatttgggtgaatagccaaaatggtccttcaagtttcatctgatgctcggtttagtccttgatgtttcaatctatctatattagtccttcaagttttcattttagttcaaacttatccttgaaccaacaactctcttcataaatgacatttataccctcatcattcacatctataagagaaaaattgcatgcttcaatttttttatagataatacatagtatattatgtaaaacgaaaaaaaattatgtactaacaagtgtatacgatagcaattgcttaagttttatgtgcacatgttgaaataatgggaagtatatctgtaatgttgtttattcatgttgcctttctcttttctagtatatagatatatacaaattaagggtaaaaaggacattttctaatagaaatattgatagaaatagccatatggcatattaagtgcacccaaggatgatttcaagtcaaaacaaatatttgaaggacctatgtggacaaaatgaaacgtgaagaaccaaattgagccttagctgaaacttgagggactaaattagctatttacccataagaatttcagtgtggttggtgtttttgaaatccatttcatgaaacaatagagatgcaagtgggtagtctcactacctgtataaaaactcgcttgctagtttatttctcacacaataatataaaatttaaaagaaaaaataaattaaaaatgagataagcgggctaaaaaaaacctacatgcccgtccggcttgcatgcctacgaaacaatcccatgtgtggcagcagtggacaccgtgtggccgccatgtgaggcgcgggcgctgcacctgtgcgacgatccaggatgtgacgcgtgcccccttatcgtccgtacgatgggccccaccgtggcctgaagtgggggaacatgccaagtggggcccggcccggccgacctctttggagttgttcctgggccgtcagatggtctcatggaagaggtccaagaggaggacgtcgctcccgcatgttaggacagtttgtggggcccacggtgtcagtgacagggcgttgtgcctagtcaaagttgttgactggctgtattgcgtacggaaccaccgactcttaccatcgagatggattgtgacgtgcagtgttacagcttagggtgtgttcggcagctcaattactgtggctgtttagttggtgaaataaaaagttttgggtatcatatcagacgtttggtaggatgttggaagaggttttcggacacgaatgaaaaactaatttcataactcgcctgaaaaccgcgaaacgaattttttgagcctaattaatccgtcattagcacatgtgggttattgtagcacttgtggctaatcatggcctaattaggctcaaaagatttgtctcgcgatttatatgcaaactatacaattagtttttccttttatctatatttaatgctccatatatgtgtctaaagatttgatgcgatgtttttgggaaaagttttttttaactaaacaggcccacagtggttgtgcagtgctgctgctgtagcggctatggctgaaattgtatggtgctactgtagctattggctgttagtacaacttttttttaagagctacaacatgcaaatttcaaatttgattcgagcttatatgacatgcgccggtgtatttgataggtctaatctcgcatttcagatgtgccgaaacatataagctaaaatattagcatccatcccaaaatataaaagttaatatttactgctccatccgtcctaaaatataataatttagaactggatgggacatcctggatgggacatccggttctaagtttttatattttgggacggaattatcttgtggcattaaaattttagtgtaaaatttagttatctaaagttacttttgtaaaaacagtttaaaatttttcataagctaaattttgcagtgctcatgtacgactgtcattgttgtatcttcgcaccggaaaggccaaaacagaattatctcgttaggcaagtaggatgagacgatgccacaagtagcatgagatgagactacatagtggcatgtgacacctttacatactacagctcacatagattagagatccatgcgtacgcagtcctaaaatataaaaataaaggaatgaaagcaacatattctattactgtgaatctaagccgattcatagtacaaatatacatctcattttgttatataggtttttataatttaggatgaagataataatggctgccacttcactcaaaacaacacaagattggaaaagatgaggtctttcgagatagaaggagtgggaaaaggagagctcaaagctcatgactcgaatcagctcggattggtttaaaggtaaagtcgtagcgatatagtaagttcgagccaaattaggcttttaagttttaactagtaagcttaacgagttagatcgcgagctaccttgttagtataagataccaacgtatctttatatactttgtgcttacttagcattttaattacatctaaactacttacatttagtgagttctttattactttgtgtttattattatgttaatataagataaatttaaaattatgaaagtaatataaatgagatataagaagtgaagataggtactccctccattctaaggtcttcatcggttggctttttccctaacaagccaaaacggcttattagggaataaaaataaatttgtaggtaaaacttttatatatgtgttcttggtgacttaaaagccaatataaaaaagaaactacgctgaaaatatctcaaaatcaatctccaaattaagtttgaaaatttaaaatttggctttttctttggctgattaggccatccgatgagagcctaaaatatactacaacttctactcctccgtcctaaaatataataacttatgggctttaatttttttccaaaaacatagattctctttccaaccaaccataacccctctaccattcaattttttcaactacctccatttctcaaccaatcacaatctcattccatttaattctatatattttcttaataatcgtgtccaaaaaataatattccgggacaaaattagcagcatttaaaattcgtttcaaaatataacgatttcttcacttttattgagttctcaaccaatcataatcttcgaccatcaaattctccacatatcttgctttttcaaccaatcacagtcatttctcatttaatttcacctactaccactctaaaacctgttatattttagaatagaagtagtaactcattaaacatgtcctctatatttggtttggggatgaggtgggatgggttagactcatttccatttcttggattcgtccgtcaattttttagggaccagaccatctgaagggaaatatttcctctcaggatcatcctattccagttattctcgaatcaaacgctattaaaaataaatcttgctatacgtacgactgagccatacgatttgtgtccgaccgagtcatacaaccaatcactgaacttgtttactaccatgtgggcccaaacaaatagcatatatgcttatacatacactagtcggatggatgggtcggacttataggtcggacgtatagcaatttcgataaaaaatagattcagcctgatccatcccaacattcaaccaaactaagggtgtgtttagttcacgccaaaattagatgtttgtttgaaattaaaacgatatgtgtgtagaaaagttttaatatgataaaaaaagttgaaagtttaaagaaaaagttagtaactaaacaagggctaatgcataagataactgcggggtcgtcatccacccgaattgcccatccggccacggccactttggccgcagcgaacctctgaagcctgaactcggcgatgtgagatgagagaggagagactggcaaaagaagaggactgccattctgccaacaaggcagagagagtactcgtcaccctcaccggccagtcggccacactcgagtgtctggacgaccgtcgtccgtcgtgtcgccaccacacactcacactgtagctagctatcatctcatcactgaaactttccaccaatcctttcctctaaaaaaaggctccgcttttcaggcgacacacagcgccgcgccgcatccgtccacgatccatcggcatcggcatcggcatcggcatcggcggccatgtgaagcgcggcccccgccaccgccaccggcgcgcgatcgagctgagctgcgaggagaggagaggcagcgaggcaggctgccacatgggcgggagacacgcaccggcgttgccaacctcaccgggggacagccgtctcgtcgatctggtgagtgactgttgtctgctggtgtgcgcaggcgcaggcgccatggatctggatgatggatggatggccggtgtcgaaactagatttcggcaataataaaagtgtatgggtttggcagtcaaaattagatgtttgtttaaagaaaaagttagtgttgacagtcaaacttgatgttgacagtcaagatagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatccgcccctagaggcgcccagaccctccttatatatgggaaggagtccgggttacaaaagataatctatatccctaacggaatacatagatacagatcaaatacagtcgtgaccgactaagtctcaaggtgtttccttgatgtacaagttaagaaacaaacccgagatacaagtaagatattctatctatattcggtatcctatattcagcccaaatattgtcgccttgtagatatgggatatccataatctccacagtagcccccgagacctttgcagtcaaccatcgtagccttcccaaagataataatccgagtgcttcaaacttttcatgccaaggcctaccgagtagcgaagacgaagactgtaaagggcgaaaagataaagaatatggtgcatcgaatagatgcacctaattaggtgtagcccccaactatgtgattagttaacaaactaatcatatagttgagaacaaaataatagcataatcatgcatcatatgacaatagcatacgcggcgcctaaagaggcattcttgccgactgctttttagccataataaaagaaatccgagtggttaacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcacctcttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgctggcgaactagggttcaccactccactcaaatccaccttcgaaaaagtgcatcaaaatccttcccgtgatccaccgcctcaattcctcacctctcccaagccatccctcgaatcaaatcagcgcattcggggaaaatcgatggcggaagagaaagaaagctttgaaggccagtgggcgccgtctgacgtaacggaagagaacctgaaggagatggtggcgcacggcgttctccctgccaaggagatcatcgggtggcggccagcgtgcggtgagatttttccgacccccgatacacacgagattgtggtcttctctcatttcttctatggcggcttcgcccttccgacctcgaaatttttccgtgggatattaagcttctatggaatgagcttgcatcacctaaacccaaattccatagtccacattgccaatttcatccatgtctgtgaagccttcttaggaattaaaccccacttcgctctgttccgccgaatcttctttctcaaacctcaaccaaacaagagtaagccatgtgtagtcggaggggccggatttcagctgaggggaactctgagccagaaatacttctcaatgcccttcaagacttcaaacaaaggatggcatgcgaactggttttatgttcagaatcctgagcctgctcttcccgaatactcttgtcttcccccggtgtaccaagatacttggaactctcttccaatcggagatgaagctgcccaagccttggaattgttggatcgcatgttaaaactcaaagaacgaggcttgcaaggagagcagatcactcggcatttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgctattgtcgtcagctactcacatcagctgccagttgtaccatataatgcattcaatccgcctccgcaggtatgtatctgaaatcttcaacttatgaccaaaatagtatcttgtcttcatgttgagttaactaaccatggaggcatcttattcaggaatatgtattgatgaaatctgatcccccaattgctcagcgccgatctcctcgccagcacaccattcagggaagtggagggccgacaatcaggtcagacccacaacctcagacctccaaaccggctgggcagacaggtcctcgcaagagaaagctggtgcttaatgacgacgagggcgatgacagcaacaaatctggggacaagggcacgcccaacaaactcccaaagcataccatgcccaggaaaaaactggctggccgtcaaatgccaaagattagaacatcttccaggtataaacttctcggtaccatctccctttgatatgcttctctcatagaaattacgctgaatatcgaaaggacactttgcaggaaaccatccgacatagatccaactggaaaagatcctgatccggctgtgacagagccaaatttatccaaagacgctgagccgtctgccgaaaaccagccgactgccgaaagccagccgactgccgaaagtcagccgactggcgcccatgcttcggatgacaaagccgatccgagtgaccagccgccaactggagaccagtcggcaacagctgaaaccgcaacaacacaagagcccccgactggaaaccagtcggatgtaggtcccgatgaagaaatccctcatgttcagccaggaacatcctcaggtaacacatcttctcaagtgatgccgatttaaataacttcagcttactcgtctaatgtcttggaaatacatcaggaacactaggcgacgacgaagaaacaattcctcgcataaaggcggctgatgattcccgtcctcctatcttactcaaatggtgggacgagaattcgcaagttgccggcatcgtcataaatcgtcaaaaagaagatgaggaagtgtgccagctgaagaaagcacttggagaagccactcgcattgtgaatgtaaatcttccgggtgactgcctttaataactttgttctctctttagcagaactgaaccatgatccatcatgcagagaatccatcttcgcaatgaggccaagactacaactttggaaaagctggttcctcatttgggaactcttgaagcagttagggaccagctgcatgaggccaaggagtacgccaaaaagacagagaaggagttaagggaccgaattgcccagctccaggattcaaacttcgagctaagtggttcatcaaaaggtaatcttctagatctgtcccattaatttatgctgtcatagctgtatcctcaaacatttggatttcaaacagcgcaagctaccaggatggctcaaatggagaaacagattgaagccttgaaaagagacaaagtagaactagctgcgcaaagggactcagccttgaaggaggttgaaggtactgccaactgacaatttgaactttcctctctttaatgcagcagactcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaataacagtggtccgagtgcacttgacgcaaccgaaatctttgacaagctgagagttgcaccggatgtatacttcaaaaatatcaagaaagctggaagtatgggagctagtatggcattggcgatgaccaaatccttgtacccgaggattgaaattgataccattgatggctttgcagacgggacaagtgaagaagctgctcttgatcttatcagtaatgctcaaagtgcggctgacaagattgcaagtgatgttgtagagcaattccgcaacaacgatcttcagccgagtaataataactctgatgacgaaaggactgactctgactgagtatgaatgtaacaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaaaaaatcacactccattattatgatgatagcccccgactgacaacttcaagaagaaaacttgatgttgacagtcaagaaaacttgatattgacagtcaagatagggaagtacaatgataaacttaagcgtagaaacgacgaagatgttcaatgttccaagagttgtcgacaagagtaccgtcttcgcgcttgagtcgataagaacctggccgggtgacttcagagataataaatggcccttcccatagaggagataacttgtgccgatctcgtgtagtttgaattttgcgcaaaaccaggtcaccgactaaaaaggcacgagatcgaacattgcgattatgatagcgccgcaacccttgtaaatatcgagccgaccgaatcaaagctgcttcgcgggcttcttcgaatcggtgcaaatcatccactcggtcctcttcgtagcgttcttcacggaaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgttgcacccatttgccggcataaggttttagccggtcaaaaacacgcgctttaatcccttgaagtatcatgccattggctcgctccacctgtccattgctcatggggtgtgccactgaggcatagcaaatcttaattccaaagtcttcacaaaagtctttaaaaactccaccggtgaattgtgtgccattatcggtaatgatccgattgggcactccaaatctatgcacaatgttgatgaagaagtctcgagcattatccgctgtgattgtgacaaccggtttagcttcaatccacttggagaatttgtcaatggccacaaagagatgcgtgtaaccgccaactgcctttttaaacgggccaaccatgtcgagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtcgttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatagctacgtcatgaatgtccgcatcttgagcagtatctttatgaggtacggtcggtgtataaaggtgttcgacgaaaacatctgagggcgccgtctcgcgcttggatccaaaattggcaagtctgtcggcggcttcattgttgtgtcgaagaacgtgactgagctcgagtccctcgaacttgtcttccaatttgcgcacctcttgtcgatatgccatcatattgtcgtcaatgcaggaccactctttcataacttggttgacaaccaactgtgaatcgcctcgaacaatcagacgctttatccctagggaaattgcaatccgtagtccatgaaggagcgcctcatactcggcaacgttgtgggacgctgaaaaatgtatccaaagcacatagcttaatctttcaccagttggggaaatcaaaaccactcctgctccagtgcccgaaagtcgttttgatccgtcaaaatgcatggtccagtgctccatcttctccgtaggggtatcctcctggcactcggtccactcggcgacaaaatcagctaacgcttgggacttgattgaaattcggggcttgaatgatatgtccaaagacatcaactccaaagcccacttagcaatacgtccgtttgcttcgcggttgtgtagtatgtcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaatagatcggtcgctggactttttggacatggccttcttcctcgcgctcaacgaccaagactgtgctcacaacctgggatgtggctgatacatacagcaacaacggctcttgcgggtgtggtgaggctaagactggtggctcggtgaggagtttcttgaaatcttcgaaggccttctgtgcttcaggtccccactggaagttatctgttttcttcagcagcttaaagaagggcatcccccgctcgccaagtcgtgaaacaaatcggctgagcgccgccatgcatccagttagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcacaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccaaacggcatggtgacgtagcagtatgccccaaaaggcgtgatgaatgaagtcttcaagcagtcggattccttcagtcggatctgatgataccccgagtagcaatccaaaaaactgagaagctcacagccggcagtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcagacgccatctcgcgagtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtttcgaaatcagcgacttcaaagctgatgttctctgtgcggaagttttcccgagtgccaaaagtgactgggagggtgatctggccgagtggagttgcggataatcctggaattactccgtgaaaaggcgcattgcttggttttagctcggagcgaggaatctgcatatcgtccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtgatcttgaaaacctgccggggtgtcgccgtcgtccttcttcctcgatgtgctttgttcttcgtcatagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtacttatgattgttacttccacctcctcccgtagtcggcgtacccttgttttgcttccaactgggacccgactgctttgatgcggtgacggcgtcttcagctttggcgtactcgttggccttttcaaacataagcttgactgtcctgggaggcttacgcccaaacttgccgactagttcttcgtggcgaattcctttggtgaacgcggcgatgatgacgtcgtcggtgatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcagtccatggagccaagatcgggcggaatccgctaaagccactggtaaatagttcgccatggccttgttgtctcctcctgctgcgcggattgcgagaccgtagacggtaagccatgattctgggttagtggtaccgtcgtacttctctattccagtcggcttgaagccggccggccaatccactcgacgcaggtcgtcggtgaaggctgctactccatcaaggtcgtcgttgtggcggtccggtgaaggatgatagcctcgagctgctcggcgttgtatgattgtgtcgcgaagatcgatggggcggcgacgaggtggtgagcgaggccgttccactcggcgctccctatattggtcgggaggtgagtgaatggaccgctcgtcgtgacccctgctcctgcgattggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttcgcgatccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccgtcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatccgcccctagaggcgcccagaccctccttatatatgggaaggagtccgggttacaaaagataatcgatatccctaacggaatacatagatacagatcaaatacagtcgtgaccgactaagtctcaaggtgtttccttgatgtacaagttaagaaacaaacccgagatacaagtaagatattctatctatattcggtatcctatattcagcccaaatattgtcgccttgtagatatgggatatccataatctccacagccggtgcgtgcgtgcatgcatatgcatgtactgtagtactacaccgtagcctgcactgcacctggccactactacacctgcgttcccgccacaaggcgctgtgcgtgtcaggcgccattggatgctttgcatctttgcttacgccatgtttagtttcaaaatatttattcgaacttctaactttttcatcacatcaaaacttttctacccatataaactttcaacttttccatcatatcgttctaatttcaaccaaattccaattttggtgtaaactagacacaattttggttgggaaaagggccctctccttcgttttccgcgcgcacgcttttcaaactgctaaacagtatgttttttacaaaatgtttctatacgaaagttgcttaaaaaaatcaaattaatccactttttttaaaaaaatagctaatacttaattaatcacgcgctaatggattgctctgttttccgtgtgaagggttcggttgggaaccaagtacaaccagcgaacacacccttatccgttaaaggacctctttgatttagaggaaaaacatagtaattttggaagattataattctatatgaaaatttcctatgaagccctttgaatcctatcctttcaaatttctatagaatggacaatcctatagagattttggaggaaatttagtaaaagcccaaatcgatctcttggaaacttttctttgagtctatctctctcatccgactcttgcgttttttccacggttcaatcaaaccgtcattcttgtgtttttcctgtgttttgtaatcctctgttttgcatttctattcctgttagaatcctgtgtttttccattcctgcgattcaaagggaccctaaagcttgttttttttattcatcccccacataccaatataaacattagaatgctcttactttatcaaatccggaagttattattttttactttatctacttccaatgtaattattccatactttcataaactcaaactctgatgcaataatttaattacttagaaataaacttattttgagataagtaggagtaaaaaataacttaatatgatacggaggtagtattatggtggatggagaataaagttggacaaacgaaaaaaaacaattgacgtatgattaattaagatttaattattacattaaaaataaatttatttcattttaaagtaatttttatatagaaaattttcatatgaaacatatttaaaaaacatgctaataaaaacctaagataaaatatgtatcttaataaaaaaagaacataacatttttactgagttctcatggtagttcagttcccacaaagttccttacagagttttactccgtgtttagttccaaaatatttattcaaacttctaacttttttatcacatcaaaattttttctacacacataaactttcaacttttacatcacatcgttccatttcaagcactttcaattttagcgtgaactaaacacagccttagtggtagttcagttcgcacaaagctccttcaaattgcctgcagtttcgaaggaggcctttgaatctggagtgctaattcggcaatggcatattttcgttcctgccgcctcgcatctgtccgtgcgtggccgttttgattggtcaggttttctttatgtccatctattttttttcacctgttcaagaacccctgcatctgtccgtgcgtggccgttttgacctttggagtatggatagtctggatagtggcctagtgggtagagcacgatcacagtatacggtgcaacgcaccagattgctcagaaattcaggtgaaactcaagcatttaatttattttttttcactttcgagacgccaaacatcgtaggttcatgattaacttgtgccgatggcgagaaaaaattctgggggacttgtagcccaacactggaatggttgaactatgacaaaggcccagaaaaacaatggatggactgacaggcccagaattccttcacgtctatcccaacaaaattagtgggttgctgcatcccaacagaatgtttgcgttgattctgatattagacatgcagactatacaaagttgtgctaaataaacaagaggtgcaatgtactgaattcagcatgataaaaaacaaccagaaggttcagaaatatcaatgtcaaacacgttgatggaaggcacatggagacatctggccacctcccggtcatattcttccacaaaacttctatagttgcctgtgcaacaaaagcataataccaggggcacttagtaagtgatggacacaagtgtatgaactcgtatgcatatcttatcatcacaaccaaggttttgcttgttttgtagtgacaggattaaatttaattggtcaggttttctttatgtccatctatttaacaacagagataacaagggaataatataaattgaatttcttacttgtgaagactttccatggttgattcaagttttgtcgcattagcaccaaccacctcacctgtcttccgaccttggtagtagaaatggaatgttggctacaagagcaaaacatgttggcaacaaagaaaaagagatctagataactggaggaagctgcgcagaaatttaggcacacagtcatgagctatagtcatagtacaatgcaacttaccacagagaatatttttagatcacttagtttgcttccaacaccatcctgcaaaagcaacacaggtcagggaagtgcctatcaataaacatgtccaagcatggccataaggttcagataattatttcagccataatcaaaattggtaacatagtgaaacacattttgcctttcaatgtactgaaagtataggagtgttctcaatagagtattccagttattgagtgaactaaccaaacagtgtagcatattagtctttgaaatcagaatacaaaggtaggaagctctgaaccggacaccatcttgattaacagtgattcatggaacagtattacggatattcagtgaaaaattcccatctcataactttgccttctacatatgcagatcccatacttgaacataagtagtgctagaatgatgcgaaatatttcagactagatccagattggtcaattgactcgaggctttctacagaagaacaggattggttcaatcactagcacttgagttttaagcattgtagtttactaagggcacgtttggatttctggaatattttgcctagccaagcaatgccaaagtagtcaggttaggctatatagcctatggcaacaagagagttcatttggtttcatggctgctcaagcaaaactaccaacgatcattgcttgccgctggaggagagctgatttggctctccctggtgggcaaggattttgaggcagttattgcctaacttgccctcaaaatctaggattttttgtttgtaccaaatgcctctcctaacttagcaaggatagaacttcccttgctcaagattaaaacacaccctaaaaagcataagccaaacctaaactttgaaaggacaggggtcaaaaatactactctgcagttaacacatgggaggtaatgcaattatacatgacaaacaatcttcaactatgaacatatgagtaaccaaacaattttgcaattttaatcccaacaacacctatttgagcaagaagaacacttcggcgcatcacaatcgcagcgagatttggatccgcccacttaccatgtcaatgtcaactttgtagataggtatcttggggtaccggctgctcagttttgaaatcacgggtgccatcgctctacctacaaacaccaaacaacccatcttataacacctcacatcatcatcaaccatctaattccaaaaatcccaatttcggcacgaagatccggcacttacaaggcccgcaccataccgccgtgtagtagaacacggccggaagcttctccgctgcaaaaaggaaatcgcgcgcatccatgagaccatgatccaatcctacccaccaaaacactaacaaacaacagcagcaaaggtggaaggggagaggaagaggaatcgggcgcgccgcaccttccaccttggacatgatgctggtgaaggactccgccgatccgaccaccaccatgctggaatcacctgcaacaacaaagaagaaaaagaaaaagaaaagaaaacacgattatctcgagtccagtaaccacttgaggagaagtggtgagtacctgaggaggagggggtggtggagaagaggcgggagagagagggaaacggcggcggggaggagaggggaggaggaggcgcggggctaggttttccggggaggtagggtttggaggcggcggcggcggcggcgagggggaggaggcgaggaagacggcagagtcggtgagccagagccatactgtgccacgtcgccgtgaaagattttgcctcttttgtgcgtaaaagctcggagacgccaagcccacgacgaaaccgcatgggcctgaaagtttctcacacagtaggatgggcttccggcccagtgtatttcaggcccatttattctttacaagtctgtttatctttttatttgattgattgaataataaatactctctctagtttttaactgatgacgttgttagattttgaatatacaatttgactattggtcttacttaaaaataaattttacaatatgcaaaaatatcgattatccttattttttaataagacgaacaatcaaacatatgtctaaaagtcaaaagtgtgatctactgaaaaccggatggagtactaaagtagcaaaccgatttttaacaaaaatttaaaatgagttttttctttaggaaaaccacctaagctcagacagtgagcgacagttgcaaagctttgtttgagaccttataaagaatatctttatctttagaccacaagtagagattactaaagaatgggatagtggagcattattgcgcattatcggtgactgcaaaatccatcataaggcttggttataaaactcttcactaacattcactagttgggccacatgacctaacagaaaggataggaaattatttagggagagaaagaacctgatccaccatgtaaaattgagttgcaaggaaagaccaggacctaccaatctatccatatttgtccctaaaggctccaccagactgcatgaaatggaagtagctatgatgattactatttgagagtgaaactgaaaccaaatctgacagacaaattgtgtgtgcatgtgagtcatggtcaactaggtggcactgttgtctctaattaaataagattagtactctagcatgagttgacagagtctgaacaggagaggggaataaaaaggttagttactctgtctctccatgtgctttgtactttaccttgtagaaattcagattctcattttcaagtggttagaaaaaccttgctggtttgctgaatattgccactcaacgttgccagttcttaagagtttgcatatcacatgactagaaactgtaaaatggagtagaataccttttctcttgtaccttttaagaaaatctattgtgcatttgtgatactaataacatacaaaattcctttattgagagtgccctcaccatttgacagcacttgctgctgttgttcagtcaattcatcaccttgcttcagtaatgggtatggtttgatcatcaacctagctttttagcaagtattcaaaagtactaatgcacactgacctgcacccatgcacctaaaaaaaagacagattcagcaaaccaagaaaagatagctagcatgggctgcgtagttgggctatatgtatgaacatataaatgcaaaagaatatcctctgaaaaaaatcaatcgtgaacacatctcagtgtaatataacgaactcaaaatcagcgaaatgatcgtatcctagtttttttttgacaagttcagaagagatccagctcccaagttgacccatgaaagcctgcaaaggcaaaacgaaactatcttttgacctcatgacaccgactgtcgtaaaattcttcacgacagacatgatggtcattgagacttgcttccattccaagggccttttttccatcacccgaacgccaaaggcaatgccgttgtctgccggctatctcaagttcaattgcagatcaagaaaaattcaggtgatgaccagaccatagtaacaaaggctgagtttagatccaaagtttggatccaaacttcagtctttttccatcacatcaacctgtcatacacacacaacttttcagtcacatcatcttcaatttcaatcaaaatctaaactttgcgctgaactaaacacagccaaactgacaggtagtacatgttgtagatggtgaccattgctgctcagatcatggtagtacaagttttgccaatgttcaagtacttgcaactagaagcaaagtccaaagctatcagatgtaggatgccttgtcgatttcccccttttttcactgaacagttaggaaattgaagcttagcttcagaaaagaagttggaagagaaggtccaacaacttttgattaggtgaacaggcataccaataccatcactgaaagtgagactttggtgggttcagcactttgcagctgttcttccacaatattcggatgcttttgatcaagacctccaaactaaagacacattcagatatgactaatataaaccattttcagtgtcttaggtactagtactactatcaatttacataatcaagctgaaagaagtaggacatttctgctgcccctttgtaacctgttctttaagagttaggacatgttcagtctgtctgtctgcaggaaccgcacaaatggcacaatcgatgcatgcatggatagctggatatcaagctagtagttaatttagatgtcatggtccaggaagaacatgctaagctacaacatggagtatactaaatcatgatataggaggatatcatcgtcacctgacctaacaagcgtttgcacttattcattattaagccgtggatgattatttattactagtacaatcgtaaagagataggactaatgggtgattaattaatgaagcatcataagtatggtggtggtggtcgtactcttgatctggtcgatcgaatcaccaggacttttggtgcacgcccacaggattcatctggcccctggattttccccttggcgggaaaaaaaggtatctctgtttaaatcaacaccgtttactgaaaataaccaatctgtctgaacaattttatttcagcagcctgaatttgtgactgagcattttgagcattctgaacttttttactgaacatttgagcaccaagtgaccggtactaataatcgagctgcagttacagaaagatttatgtctcagatcactgtttatcatcagaagtggtggtgaaggattctctgacctgtgagtcaggaatcactgggcgtgtgcttgctgaggcagcatccatggcgaggccagtgagatgcagcgcggacggcactgcatgaggccgagagctcatcatcatccaaaagctgctgtttcctttaggctttagcagggtttatgttatcatcatcccacggtttagcggttaccacaagatataccatgattttgaaactgaaaaggttaccgcatattccctccgtcccataaaaaaccaatctagtactgaatatgatatattctaatacaataaatctaaatatagaatatgtaatatcagtcttggattaacgaaacgatggagggataacaatatgataatacggttttgtaaatcccaggttttagctactgaacaaaccaaatatcgtgtctttacatgattgccatcttgcttacttcgctgatagctccaactcgtaagtcgtaactgaagcagtgtcgatctcaaacacggaagttaaaaccaatcaaatgcgaactttgtttttgttattactactcctagtacctgaatctttgcctaacttcagctcgttcatcatcatcatcatcaccaagattcatcatcattcattgcatcgaaagttgaaaattgaaaattatagaaacgaaaaaaaaagcatacagtactaagagcaagtataataatagtaggctataaaccagctaaatgccgaggcaaatgatagaagagatgagagagagaaaagaagcggactgtaaacttacaaccggcttggacacaagaaccaaaaaaattctataagagagacaagtggaccctatagagaaggctaaaaaaaaacttataaacaacatatcgattgtattattagccttgctctaacacacaccagcttgtatgcggaaatgctaaggggcgatcgatcgcccctgggcgctcccctttcctccatatggtttcattttttggcaccacattactttcttattttagtaaatttacgcacctaaagtttgtacaccttaagtttacacatctaaagtttagagacctaaagtttatacatctgattcaaatttgaatttgaattcaaatattttttatatataatatttctatacatctaaagtttatacacctaaaatttatagacccaaaatttataagtcaaaagtttacatacccaattcaaatttgaatttgaattatatccaattcaaatttgaatttgaattcaaatattttttatatatagtattttgtacatctaaagtttatagacccaaagtttatgtcaaaagtttatatacccgattaaaatttgaatttaaattcaaatattagtttatagacccaaagtttataagtcaaaagtttacatacctgttttaaatttaaatttaaatttaatttttttatatatagtatttctatatataatttttttcaagcttatgttttttattttttaaaaatttatggtgtagtaggaagagaagaagatgaggagaaagaaaggatggggggtgttagccgcccccgcttgtatgtgtctaacgcgatgggtcaacctcgacgaaccggatttgtgcatgcgtgtcgtcttggcttacacaccacgccacgtcggatgggccccacactcagagccaagcctacctacacacacctacccctccgacggacggcctcacccaatcacgacccaggccaccccgggcccaccgtcacagcgaccgttatcgatcagcaggtgggcccccacggggatctttgattattaggtgactaggtgaaatcccgcgcattgctgcgggaatttagtatgataacaataaaaaaataacgtgtaagatagctaaataatatcagattaaataaattaatgtggtttatgataatttaaatttaaatagtatgtagaatgatgattcaaacgtaaaaagtaaggtggtatgactttatagaataagaaaagtagggagatagtttggaccgtagattaatcatctaaaggctaaaaacaattgatgtgatatgccttaatgagaggaaaaaaggagaaagataatttggaccatagattaatcatttaagcactaattaagtgaggatgaactatataaatatataggatatatcataaaacataataaaaatatacattgaaacattatgtgaattatattggatgataatttaacatgtttatatttgaaaagctcttaaattataaaaactataaagatatagcatgtttgtatgatgtttaaatgtgatgattgttagtagatgatgatgtggcatcttgttaattaatggattagtggatgatgatgtggcatctttgcatgcatgttaagtttaaggagttggtgggggataactttatagtaagataggattagtaaggcgctaatcacccgattaaagtcgtaacatactactccgtgattagccgcgcggaacacgtgctccggaacctggccaccggcacgcggattcccgcggcgaaaccgctcgtctccttctctcctcgcgcggtcgctctgaatttgtttgattttttttttttgcttcgattgcattttgaatttcgatatgatttgggtgcattttgcgatgggtttatgaaatttatgatgggggttacattttggcagaatgggcgttggttttagcagtggagtggagtgcctgcatccgcaaacacagcgacagcagcgtaagaacaaagcttcactgtcagagcgaaacaaaaatgtcgctaacctaatgttttggactttgtaaagggcatgttggtttagctcaacttatcccaaatcatgctaatttcaaccaaacaaagcccctactatattctaagccaaaaatgtcagaacaaaataatcacaacaaaagctcacatataaccaagcattaacttactacaattacgaaagcagttacgctatagtagaccgtaacattggcttccccaacacggtgatatcatgtactctctctgtcctaaaataactgcaaccatagtttttcgcgctcaactttaatcattcgtcttatttaaaaaattttaaaaaaaattaaaaaaattagtcacgagtaaagtactattcaggttttatcatcttataacaacaaaaatgctaattataaaaaaattttaaataagacggacgattaaagttgggcacggaaacttatggctgtacttaatttgggacggaggtagtaatactagtactaccaaaaagttcagaattcgaaaacccggtcagagagattttcttcgaaccatctgagaagaagtcaaaaacgggaaagttcatatggcgaaatttgcctctcccagctaaacgcacagataacaatttcgagcatttgactaatccataatttacaaataacctcctaaaaaatgcaaaataattccactttgccccctgcgctttaacttttttttccctctccgtttatataatccgcctcgccccattctccatcgtttcgtctcctctctctcttccaccaaatattcccacctcgcgcggctactctctctctctctgacaggcatggcccacctgcagctctcggcggtcgccggcggcggccggccggcggcggcgggtgggggaggggacgagatggaggacgtccggctgctggactcgtacgacgaggagatggggggcggcgccgccgcggcggcggcgggggaggaggaggaggcgcacgtgcgggtcaccggaatgacgtgctcggcgtgcacgagcgccgtcgagggcgccgtctcggcccgccgcggcgtgcggcgcgtcgccgtgtccctgctccagaaccgcgcccacgtcgtcttcgacccggcgctcctcaaggtgatttccgcgcgattgcgattgcaattgtgatgtgatccttttgcgtggctgagcccgtttgtcgagccgagttttgcgcgtctccgggagcaaactgggattcgtgagctcgttgacgctcacgcggtggtaaattttttgaagttttttcttgcgctggaattattgcgtaggtgatggttggtgcggtagaacaggattctaggaagctggatcgcgctgcttgctcgtggtttttctcgagcggttagaagttggtgaatcggaatttactcttgtctaataataagttgagtttactaattactatgtgtgtgagtgtgagaccgagtcaatcgtgtatgatattgcaattttgggttttagctggagatgattttttttttctttttgacttcaccttgcgatgacgacttttcatgagttgattcgtgaaatgtggttagcccacagtgcccagaggccagagtttttgtgctccttttgctttggcggttggatgagctgtaaccttgttgcaagctcgtgattgtggctggactctctggattgtgggatttgggagctcaaaaaggctggcagtttgctgcgattggttgttgctaccggcagaaatggggtaactgctgtactacgataggtttgattggctggtgaggcagggagcagccgagtcatgttttcggggggaaagggtgctaagttaaggatcccaatttatgtggcttctaagtactcattgaagtttcctttgagcaaaattgaatgcaaaatgatgttacatgctaattttgggacaagcatataatctcattattctaggcccagtaattaccatgcaagtgtataaactttcagcagtgataaaatttagtcttatcatagtaataacagtgtacttcacaattgaaatttattaatgcttatggttattatgttgtgaagtactctacagtttctggttttaatgactgttaatgtgaatattagttgagttgtagcgctagcaactttttgatgagcctattgtagtgcagacggggaatgttgtgtttcatccttttgcttttgttggaactattaaggatggctttcctgactattaagtagacatttaccagcaagttctatctgctacctcctgttcataataggcattcatttagtttgtttttaatggccacctactattcattgttgacacacatttttagattatatgggtcaattagctacctgcaatttttatttgggtacttgtttatacaggttgaggatataatagaagctatagaagatgccggatttgacgcagaaattatcccagatactgctatctctcagccaaaggcacaaaagactctgtcagcacaatttagaataggaggaatgacatgtgctaattgtgtgaactcagttgaggggatcttgaaaaggctatctggtgtaaaaggagctgttgttgccttagcaacctcactaggggaagttgagtatgatccttctgtcattaacaaggatgaaattgttgaggctattgaggatgctggttttgaagctgcattcttacagagcagcgaacaagataagattttgctaggcctgactggattgcacacagagcgggatgttaatgtgttacatgatatcctcaagaagatgattggtttgcgacagtttgatgtaaatgctacggtctcagaagtagaaattatatttgatccggaagcagttggtctgagatcaattgtggatgcaattgagacaggaagcaatggaagattgaaagctcatgtgcagaatccatatgcacgaggggcttcaaatgacgcacatgaggccgccaaaatgcttcatcttctccgctcgagcttattcttaagtgtaagttttgacctttgctcttctttttcaccaccagcatagttatgcatttttgcacaaagatttttagttggatcaatgtttgtgacaatatccttgacatggttgtgacctggaggacccttctggacttctgttggagcattttagttatgtggaaaaacagcaatcatcatgtccctgtgccatttgaatcagttattttctcctaaccacataatagtttagattttttctatttactttcttctatcttacatgtgagatccacttgccataggaaagcatgctgctttaattctaggtttgggggtttgggctgttcataaaagataacaagcacattttacttcatacttgaattaaatttggcagtactgaacatttgggagtgttagatgatatgttccctagctacgtagttcttttgcttctttatatttcagaatacttttgaacttctcttctgcttgcttactaactctatccaactgtgtccttgcaccagattcctgtattttttatacgcatggtctgccctcatatacctttcattcgttcaatactaatgatgcactgtggaccatttcatatgggagatttgctgaagtggatattggtaagcattgtacagtttgttgtcggcaaacggttctacattgcggcttatagggccctgagacacggctctacaaatatggatgtgttagttgttcttggcaccactgcatcatatgtatactctgtttgtgcactcctatacggagcattcactgggtttcaccctcccatatattttgagacaagtgcaatgataattacatttgtgttgtttgggaagtatcttgaggtgcttgcaaaagggaaaacttctgatgctatcaagaagcttgtagaattggtccctgctactgctcttttgcttctgaaagacaaaggtatatggtaaaattttgtccttcaaaacatatacaattaagtcacagtgccacactcatcacattagttttagaagttatttctgacttgttttaggcaaccgcctgtgttttttttttcatttcatactatcaagttacacaaactcacattgttcttttcaaatgcagaaggaaaatatactgaggagagagaaattgatgcgctattagtccaacctggagacatcttaaaagtgcttcctggttcaaaggttcctgctgatggtgttgttgtgtggggaacaagccatgtcaatgaaagtatgataactggtgaatctgcaccaattcccaaagaagtatctagtgcagtaatcggagggacaatgaacttgcatggtgtccttcatatacaagcaaacaaagtaggatccgagacagttctgagtcagatcatatctctggttgaaactgctcagatgtccaaagcccccattcagaaatttgctgattatgtgagtaacctcccatattcttttctgtgatgtccttcatttgctttgtctgtacttattttaagtgtttaccgtgtactttacatattaactttaaaagcgtcagagcattttttgtgatctatttactatttccgatacttgagaatgttgcaggcaaatgttgtttgtttatgagaatttgattgttcatatgccctcttttaacatcatcattcttatgttgctttctacttctgatgtaaaaagttgtaacttgtttaatctcaaaacattttggctgcttaggagtaccttccagtccaaagtttttccctgtgttaactttagtctttgaccttctatgctttcttaatacaaacatacatgtcttttgtatattcgtgaaaaatttaacagaactcttggaagaatagactagtttcttttatctgtgaaaagctcttgtgtctcctaaatgtgcggtaatgattatagaggcctgttatggttaatgctgacactgcctacattttgctttcaggttgctagcatttttgttccaattgtcatcaccttgtccatgattacattccttgtatggtaagttcaacatatactaacacaatttttgagtgatactatgtttgaaacttcaatttttctgacatgtacattggctgcttttgtaggtttttatgtggatgggtgggagcatacccaaattcatggatttctggaactagcaactgctttgttttctctctcatgtttgcaatagctgtagttgtgattgcttgcccttgcgcccttggtctggcaacacctactgctgtgatggtggcaactggagttggagctaatcatggagtacttgtgaaggggggagatgcattagagagggctcaaaatgtaaattacgtgatttttgacaaaacaggcacactaacacaaggaaaagcagttgtgacaacagcgaaggttttctcaggaatggatcttggggatttcctcacattagtagcatctgcagaggtgaggttgaacttaagttgcttgtatggttcatatcaagctgtagtaaatgtgtttcggtattgtaactatgcttcatatgaatgtggtaatgccaaaatatgttttgctcctcagggttttagttaaaaaaaaagtgttttggtcttgttcatattgacttgtcaaaagtaaaaaaagttcttttgttttctactcaggcaagcagtgagcatcctctggcaaaagcaattgtggaatatgcattccatttccatttctttggcaagctccctacatcaaaagatggcattgaacaaagaaaagaagacagattatctcagttgctccttcaagttgaagacttctctgccttgcctggcaaaggagttcaatgcttgattaatgggaagagagttctggtgagtcacataagctaccataactcttccttgcccttcttgcagctgagttgaaaacagtgtacaagtctaacccatctactgctgtaccatttcttttaagcaaaccactgattatctagacataactgttttgcaggttggaaatcgtactttggttactgaaaatggtgtgaatgttcccccagaagctgaaaatttcttggtagacctggaactgaatgctaaaacaggcattcttgtgtcctatgacgatgattttgtgggtttaatggggataactgatcccctgaaaagagaggctgctgtagttgtggaaggactaaagaagatgggtgttcatcccgtgatgctcacaggtgacaactggagaaccgcaaaagccgttgcaaaggaggttagtctctaatctctattaccttccttgatccataatgttcatcatttacctgaacacctcttcatatacatgtctgcgattttctgctcttgcaggttggcattgaggacgtgagagccgaagtcatgcctgccggaaaagccgacgtggtccgctctctccaaaaggacgggagcatcgtcgccatggtcggggacggcatcaacgactcccctgcgctggcagcggccgacgtcgggatggccataggcggcggcaccgacatcgccatcgaggccgcggactacgtgctggtgaggaacaacctggaggacgtcatcacggcgatcgacctgtccaggaagacgttcagccggatccggtggaactacttcttcgccatggcgtacaacgtggtcgccatcccggtcgccgccggcgcgctgttccccttcacgaggctgcagatgccgccgtggctcgccggcgcctgcatggcgttctcctccgtcagcgtggtgtgctcctcgctgttgttgagaaggtacaggaaaccaaggctgaccaccgtgttgcagataactgtagagtgacattgacattgctcctgtatacgtacatagattccccctcttcaccgtttcatcacagaaatgaaatgagatgagaaaaggaaggccgatggcgtctcttgtaatttgtggatcgctctggacgctgtttgctttacaggttttttcgattttggtcgggttcttttattcttttattttccattttatctctcctggtgaattaccagctgtcagtaatcggttgtacgtttttgcttatcttttcgctacaaagcagttctcatggaaatgcttaccatcggctgtccggctagaaataaaaaatcggacgtctcagttgacaacagtgtaggtgcatagtgaaacaggttaggtgtactcacgagccaacggagcaatgcattcaagcatgtttcaaaatttaaatgattttttctcttaaactatttatccgaatttcaaactaactatatcattggattcgttataattaaatctttataacaagatatcacatgactacattccgacgactttttattttactttttaaatgttgcacacatttttactgaaatgttccaacaagcatttgttggtgttttactagtgcattagtaatgtttcatgttatcttttttatatgtttcagcaaatacattttttatgtttcaacaataattataatttgatatttcagtctaaatataaaaaatatttcactagtcgggacttaatgtttcatgtaataatgattattgttgcagtcaatactttttatatgttgtacctctttggaacaatttgtgaagtgggttgaaacatctccacaagtgatgaaacaattatttttaaatagttcaacataagtttgttttttttctaagaacacacatatatatttttattaaaatatattcatgtgagatcttgttataaagatttaattacaacgaataaagtcatctaatcaaattatagcggtgttattggatcatttccggattagtttcgcatctcccactttcagcctgtccttttttttccagtttcttttcatcttttatctacctttagtgtgtttgtaaataacttctatcctatttaatataacaccagcaaatcctggcatcggttctaaaaaaaacattcataatgctggagggcccattcaaaattttctttcctcttttgacctagtagtgatttgttagtaggggtggaaacgagccgagccagttcggcttgcagtggcttgtaacaaactaggcttggcttggctcggctcggctcagttagagaaacaagctaaaacttgagctcggctcggctcatttcctagctcgagccagcttgcaagccttcctgttgaaacacctcttcatatataatttgtaattattaaaaaaagtaagaacaaatcatcaacatgtaaaatttaaataagtttttatattcaattcttaaaaatcttaatgataaatttcaagttgtcaaataataactctataaaaagttaaataatcgatataaacacataatggcctaggctagcgagccaaaacaaacggctcgtgagccagcttgggctcggctcatttcagcaacgagctgaaaaggatacttgggcttagctcgtttggcttacgagccgagccaagccatccaagctcgagccaagcccgagctgagctcacgaatccgagctttttttccacccctatttgttaggtctttatttcactactactacttcagatttcttagatggtgtgcttcaatattgtattgggctcgatccgtctgtattttatgggccaacagaatattttttttcgtatatacgtgcgtatacatacaaactttgtatatatgcgtgcaaattttttatgtctaaatagtgtatacacatatgaaaaagtttatacatataattttgttggatactacctccaccatttcaagttataagacgttttgactttggtcaaagtcaaactactctaagtttgactaactttgtagaaaaaaatagtaatatttacaacactaccattgtttcattaaatctataattaaataaattttcataatatatttgtcttgaattaaaaatattactattttttttacaaattagtcaaacttagagtagtttgactttgattaaagtcaaaatgtcttataatctgaaacggagggagtacaaagataaaaaaatacacttacacgtataaacataaactttatacgtatacatataaagggtctcatctttttgcttatgcttatgcttatcagctaaaatttgaattttcatccttaaatttggagttgattttgaggttttttttatcgaagtttattttttagcctttgtttttagatcgctaagaacacatatataaaaattctattcacaaattacttttcattttgcaaatataccgtttctcttatttcgcgatggctccgaaagtttgtacacataactacgtaagggccggactgatcgtgcattaaggatttctcattccgtgctctcacgtattatctcctttgatttctagtgtaatgaaccatccatttctacatgtcatgcatatgcttaggaaaaagctatacatatggattttatttcttacaaaatttttgctaacgctaatgttacatattgtagtaaatcaatctagatctactatgacatcgacctagttaaatcaaacgggtgagaactttgttaacctttgttaagagtttaatttgtaagattttcttttaatacatatagcgttgttcatattttcaacaacgtttgcttcctactcttaatttcttttttaattactacaatgtgacgtgtctgaagttcacatggtgtacaacgtggtcgccatcccggtcgccgccggcgcgctgttccccttcacgaggctgcagatgccgccgtggctcgccggcgcctgcatggcgttctcctccgtcggcgtggtgtgctcctcgctgttgttgagaagatacagaaaaccaaggctgacgaccatgttgcagataactgtagagtgacattggacgagtaaagaggaggtgtgttgacggctgttaagtaccaaattaaattcgtcaataccagcataagaccgtaaatataaaacatccaacatagtggtagagtttatttctaacaatttccacgagtgttggtgtatattcgtatgcaggtgacaaactacctaaattgagaagaaatatatatgaaagaggaggagaatcaaactcgtatccgaacttatggagttttggacccaaaaacctaattaaacacctccaaatgtgtcaaacattcataccaatggattgaggggaccaaaataagtgtccaggccgaaaaccggagcgaacatagccgtctcgggtttggtcgaaccctcacggaggccgttggcccaggcccaagttcagttcggtagaaatccgcttcccaattacggttatggccgttttcaccggtagaaaccgtcataagcatggacacttgtcaatacaaaagagaagatgctctttggatgcttggagcatctccatactcccaagacacttttctacctataaatacccctctcatcctcacttgtaaacagacatcaagatgtagagctgaattataagaggctctaagtatacttagggctctttatatgttctatagtatacttagaatagggagagagtaaagtagaaaaaattggaggaattccagagttgtcggtaatcctctcattattcttgtactttgttaattactccactttaatagaaatatcattctgagtaattaagatttgcttagtgagaattaattcttggttagttcctaattactatatgggatcattgttcactatggtctagtaatatgtagtgattgctttaatgcttggccaacgttagagtagtaattaattgcgtagacgcggtgtctggctaattaattttcagtgattactgtgtatctcacggtacgtaggtgggtgtagaggtggtgacaaccctcaagagcacttaagtcctccacagtacgtaggtgggtgtagaggtggtgacaacctcaagagcacttaagtcctcgtccggtacgtattagagcgacatctggaaatagcgggttgacagttcctgaagtatcgtgttaggattaaaattaatctttctatagacactgtttttcacttgaaaatcctctctaccatttgcatatgtttgctttgtgtccttggatgaaattggagaagagctgagcacacacgttccttgtggaaatcgatactcggaatactgaatactgaagctacatcggtattctccgtgtgcttgtagattttatttgtgacgttaagaaataccaacaacaatctcgtttaccatgtacgcggattcgaggctacttcaaagttaatgtcagggatattcacttgataactcggtttatggccaatgggtttcctttaattggtaatatcccctttacatctttgtttacatttctgaatgatggcgaaatatattatcctccaatgctagatgcacattatcactcggtagtgttgattggttcagagattggaatcaacaatggaaaatcatcaacattctatgtagttagagacagttttggattcattcactgcagctaccaccttcaaaactatggcgcactactagtttatttgtgacttgtcttaaattcttattatccagtttagtaggtggacctatctttgttcttatgacgaagcgtcaaatctatgtatgcaattatatttgtggagttttgattctcatcatggaggctcaaatctatgtatccagtgtaatgtattagtgtagtatttgtgaacttgttctcttgttatggatgaaagagacattatccttaatttatcgatttatgtatccaatccagtatttgtgttatttcttttattttcattatgaacgaaatagttatcaatttatgcatccaatccagtatttgtgttatttcttttattttcattatgaacgaaatagttagtattgttctggacatgttcgtgcgacggaaaaaataattacattacttgcttcaaataatttgttgcgtgcatgctggaacacattgggcatattttctttttaattaagtactacactaattactactagtaatcgtattgcacgtttcccataatatataagcatactcaaagtttaatgcattgattttccaatgatatgtatatcacacgacatatacaaagtactaaaagtataaaattgtctcaaaatagtactctagtaaataacatttacatgatcaacaataatattctatcgtgtgaccagtagaaatttatatggtaagcaaaccatagaggtttatatctcagttactttcaagacattaattgtcacgtaatagtactctagtaaattgttatcggaatagtactcggtgtagttgccttaactgcagtgaacagaaggaaatgtcgagtgtgaacatgctggaaacgtcttaaaaattgaaatggcaactctgtatttctggtatggacttacagtgtatcccgtgaacatgtccaaactatattagttgagcactggaagggatttcacactgcacatgtccatcatcctagcagttgcaacccctcctaacgaaagaaaaataattcaataaggaaaaacttatcaaaggccaatgattttgaacccatcccttcgtccaaagaaaccccttctagttgtgattctaagttatttcactctacaagtaaagtgatattcaaatgagaacacatcatatatacatatattatttgtatcacaatactccacataaacttttgattgctgagaaaaatagcaattcaaaatagcatcctcaagcattcatatcatcaaagatcttgtaaaatgtgaggcacatgattttctagtagcagattagaatagaaaaataatatgaaaaacatgaattatttaaaaattacaactctgacaaaatgaagaactaatgaatgcattgaattccctcaaatctggacctaactacataacctaacagcacaggaatcaacacttcagggtatttatggcctaaacagaattcacatgacaccaattgttgggaggaattattccttaatgaaaattcaaaaatgatgaggaaaaagagcaccctctctttgaccatcgcctgtacatcgcaatgtttcatcatcaaccatccataaatcaagactattgataccatacatcagttgtcctcacacacatgatgtaaaattgtatctttgttaaaaaaaagtgtacatgttagtttggcaaggtaaaaaagtatcttgcagtgctttatagggaaacaaagaaaaatggagaaaaaaaagctacaattgacagttttttagaaatattgtgaattgaagaaaatcataaagttctacacgatttatatcaattaagtagactaaatacacattattcttgttctccatgaactacagtgtagtatacatgtcaataccaataaacatttgcactaaaattgacacatcgacactcaagaggtgtactaagccatttaggaacttcaagtgacaccctttctcaccttttcttttcgtttcctgattgcaacctttgcatagttggatttgttcaaaacattagtctagaccagatcaagagagccccagatggttcattgtaatgccatcgaatatattcaagtcatctaggctcctgtcatcgttgaacacctaacatccaatttatgcttcagaataatagaattcgaacacctgacatccaatttatgcttcaaaacaatagaattctcttggtcaccgtttctgcaagcacaaccttagagcagaatgattcagcaatttcactttaaaaaaataaaaaaaaaagtcctcgagctatttaaagtgtaatataagctcaatagtgtacagcgatcgcaggcttcagatttaacacgctatggacttttttgtattccacgttgaatttctaatcctacttgcgttatacttgaaaaatacgggaaataaaatttaagaattgctaaaagttgtttgacaacacaaagaaaaagttaggccctaattagcacatctatatcttgtatgacataacttaaaagtacatctatatcttgcaaacgatacatagtttgtcctttaaatagtcagtgtaccctaagcaagcaaatattccactaatttcctcacttgtcgcatagcacaatactcagtgtacccaaatctaaattggattcgacaataatcatatgtgtattccttagattacaaaataaatatcaaaaaagaagaccatttaactgaagatataaaaaagaactgcttcaatccaaggagctaaagctttttttttttcctttcaaaactctgtagaaactgcttccatctatgcatataaatcttttcacagatgaatacggaaacaaagatttaaacatgttcatgccctctcgacgggaggtaatactctactcttgtttgaggattgtatccgtcaaatattgtatttgatcaaatgatcttgttttggccaatgccctaagaggggtcccagctctgtttatatgggttgggggtatgtgttgcaagtagaaaatctagccaaactcgaccgaagcttccttaataaatattacaaaagaaaacccaaatagggatatagaatcgtaccttctcgcagttgtggcccaccttctgatagcagtcagatataaaggctatatgtaggtatcccatatctataatctccatgtgttctaataaatatgtgccataataagatgctaaaatgatgattttcaattatatccgtatacaagttaaagcctgaacttaatggaaaatgaactaatcctaccaaaatcttgcaaagtttctacattcctaaacaggctacgaaagtgtcgaccaaagtctgtctgcagtagatcttggtgtcatactttgctaactggccaaccctgatcaaggtagctagtacgaagagcaaaatacaacacacatacgcacacatggttagaacagaactactggttgagctgacaagtaattaccaaaagctattcaggaaagtattggacacgtgatggctgccactgttacgcatcagtccatcaccagatttcacaacccacggagaagaccgccatgccttgtattgtcgattggagactttcttaatgtatctgaaatccggctcaaaagtagcatgggttcaagattctatctgcaatgtttggatacaatgcgcctaaggctctgtttagttccctagcaaaaattttataccctatcatatcgaatgtttggacacatgtatagagtgccaaatataaacgaaaaaataattaattatacggattgcgtgtaaattgcgagacgaatcttttaaacctaattgcgccatgatttgataatatggtgctacagtaaacatttgctaatgatagtttaattaggcttaataaattcgtctcgcggtttacatgcgaattctataattatttttgttattagactacgtttaatactccaaatgtgtgtccatatatctgatgtgacttgccaaaattttacacccctagaactaaacacagcctaaagcattgtcacgaggaaagctaacaaggcgcatacaaaatcatctcaaagcacctacagctcatcatatatcaggcatcagcttgaacgaattttcctcagatgaaggcaatagaaatcaactacatatcagaacaaacgctacatccaacatacactagaaaattagcacgccaagtggcgcgctcattatagctcgtgtctactttctaattagtttccaaaattcaggtctataaaaggttggcaaatgaaagattcaatggtgttattaacttatgcaacaagtttagctaaattagcttccatggcacttctgctaaaaaaaacccttgaagaacgatcatcgaaaactggatagaactatagataaatatattttcatgaattcactaagataaaaaaaaagcctgatactaccatagttgttccggtctagcttctagctatggcacaatgaataaacacaacaatgtagttacacggaaaacaaaaataaagtttagaaccacagtctttcacacattttaaatgccagaggtcatgatttcgagcaccttgtaggcggtagcaatttccatcttcaatatcttacatatccctagaaatgtcaggaggtgaacacaaattagttggacctagactgactgatagaaggagatcaagagcaagagacataagttaagccagattgtcctggtgggctagtggcacaacagcaaaagcttgaaacaacattccttagtttttaaggaaaattgttgtttctcaattgttagttcttattatgggtgcattcaaatgataatggaacaacccgttgatagacccatcaaagtgataacatccacccaacagaacaaataggatgagggagcgatattcagaaaaaaatatctcctcagaaaatattatattctttatatatttgtcagataattgcaaaaatgcatattcagatacagagaatgtggaaagaaatatacagagaatgtggaaagaaatataacaagctcatgatgtattaacttaagaatgtggtcattatgaacagttgcaatcgatcgcaacttcagaatttctcaagtaatactcaggacattcccttgaatagaacacttgcaattagggcactaaccaattatgatgcaaatgtcagtaaatggcgccagttttatagatcattttcttttgtcaagaggagaagtattcttgaaagaaactattgtgcaggattgagaccaaagaaaaaaactatgtatcaatgcaggatgattataagtgttattagaaagggtattcaggaaaaaaaaatcaaacttgagttttgtcaagaactattcctgattatgttctttgagcacattaatatttctgttccagattatgctaattgtgtatatactaatagatctaactcatgtataattcgattgctactaagatgaaatcagtaatacataacttaactgattaataatccatataagagtttcatatgacagcatcaaattctgcaattccaagttgtgtgtttctcctggatttctgcagaagtagtagtagcaatagagcaataatacactatccaacaaaatagtcctaactgtgctatcaaatgcaactctaagaaagaacgaaatattttctttcttggtcatttcatcgaacaccatgaatgcacagttcgcactacaaaacagcaaccacacgtttagggaaataaatggaacaaacagtgcactgtagcttgctcaccaccgctggccatggccacgaccgataagcgcggccttcacggcctcgagcggaggccagcagtggggccaaccaccgcggcacgcccggcggcatagtaggagtaggacgcggttgacgacgcagggaaggggcgggcagtgggcgaagagccggctggccggcgcacgcgcagggtggccgcattggctggcgcctcagcaacgacgatcgtggaaggaggtggcatcttacaggtaggggtgggcattcggttttaccgaaaaattcggtctcggttttcggtttttcggtcagttcggtctttgaaaactcaggaccaaatttcatcaaaaaaatctcaggatcagcaaattcagtctcggtctcggtcttaccaaaatttttcaggagtaagtttggaatgaaaaaatttgacagaggcggcgctggcgcgatggaggacggaggcgtcgccaacgcggtggagggcggaggcggcagcggcgcggtggaggacggtggcggcggcggcggcgcggtggaggcagtcaggcggaggccaagcgcgatgggagtgcggcaatggtagggttgtatcatttctagggtttgttttagtgggcttattgggtttcctaggcctattgggctaaaatttcggtcattttggttaaccgagcccaataaccgaaatgaccgaaataattcggtctttcgagggctgggaccgaacagataaccgaatttctcagtgttggtctcggtctttttggttcacttcttcggttcggtctaaatatgcccacccatacttacaggcgaggggtggctctggtgcggacgtgcggcaagggaggctccgaacggatcgacgagggacggtactgatgcagagcagcacgctggagacagcccgcgaatagtcggtgaagggacgactatttctttgcaaggcttcaccatatctaccgttggttcctaatccaatggatgtgtgtgcaaattaaaccctggaatcggcagccacgtggcgcactaatcacccgagatggtgcgtggaattcggtataagagattgagctcaagctctgtctctacttcctccttcacgatccttgcagaggctagccggagcaccgcatccgcttcattcactgagctcgcatttatcccctccaccgagctttgcacccctaagcttaaccacctcgtcaagtttgagagcggcggtcagccaagcagagaaggcggtgctagagctcgacagagcagtgacactcttggcatagaggagggcggcgaagagcgctggagtcgagaggatggtcactagcgtagctcacgccatcctccaccacactgatagttcgacgcccaccgaagtcattgccaccaccgctatcggctcgaatcgagtatgagcccaagcggcagtggtgcgtccatcgggtttccttggaggttcagagaggatactgatggcaacgtctttaaaagaagtccacactcggcatcagtaatcaatgcatagattgaatagggagggaaatggagaagagaagggagagagaaagcaagatggtggtcaatggcaagtggactctgtaattttttttttaggatttttcttattggatagccacatcaacatcatgcaggtgaaatccgccttggtttggcctaagcagggtaaggtaaatggtattaaaaagctaaggaggtgtcgatacacgattttaaagttgaaaggtgaactttaaacaaaatgaagaattcaggagatcaaattaatggactaatccctgaacactaattccatcgagggattaacatcctagtccaaagttcttctctggacttggactagtgcctggcttgctagctgccctgcctgagctcgtgagcacatagcaaagagaaatgtcacatatatggcacgtcatcagtatcggacaatgctggccacttgtcatagtgcttttcattgagactttaagaagtttctactccctccgtcaaaaaaaaaacaaatccgagttttcgtgttcaacgtttgactgttcgtcttatttaaaaaaattataaaaaaaattaaaaagataagtcacacataaattattaatcatgttttatcatctaacaataatgaaaatactaattataaaaaaatttcatataagacggacagtcaaacgttggacacggaaaccagggtttgtcttttttttttttggacggagggagtatgtcagtattgactagtggctattggtgacgaagaagacacaagcaaactgtaaacaacacatacagagaagaaagttgtaggcgatttttaattttcgctatgattcgatgatagtgtcatgaactcatgataaaaggcacacgatagtgtcaaaagggcaagagaaatgccacatgtcacatcatcggtactataggggtttgggccatcggtgactcggtgctgcaaaagacaaaccatttgtaatgttctctgatcatgatagcactgaatataccaaaaaaaaaaacgtggttcagctaatgcagacatgaaaaggtcacatttacgatcgatcgtgtcatcgatcactacgtacggtgcattcttaaccattggccatgcattattgtactaacttgcctagttaggacttaattttgctccattatacagtgcaattcttgcgtggaagcataataatctcaccttttgcggctaatagtcagagattcttacacaaaacgtatcgattatcatcattatcactttaaccattcatcgaaaaaacttcaatcagcacagcacttattgtttttaagataataaaaatggtttacattttcggactctatcgacagagaaacaaccaataaattaaaataattatatagagtgattggacatgttgcattgaaagttaagataaatagaatatattttagtaattaattatataggtactatgctatccaaaacgaaataaaaggctacaacctccaagagtatagcaccacagtgtatagtatcttactatttttgtgctagcatcaaagataagtgtgaagccagatgagagacctgaagataacctgcatatagcctattttctattataaaaactttatcattttagtaataccaattaatttaccaatattatgcaccagcttcaaatggaactagttttcttgacctggacatcccccacaagtcaattcgcaattatatttttgccacaagtcaattcacaattatattttttgcaccatggagaggaggacttttcaaagcaaataagatacatcgccaagcaaattgctcaatatgacattcaaagaaatggtattgaattgtctcttgcacattagaaaacaattttgcttatcaccccttaatccccttttgcaaggttatcctttgataaaagattaattacttgaccaatattatgcattggcttcgaataaagccaattttcttgaccgggacatcccccataagtcaattcacaattatatttttggcactgtggggaggacgtttgaaagcaaataagatacattgccaagtcaagcaaatcgatctatgtgacattcaaagaaatggtattgaattgtctcttgcacattagaaaacaattttgcttatcgccccctagttcctctttgcaaggttatcatttgttaaaaaattaattacttcttatgaaagaaccacataaacattttgatgatttttagtggcaccttcgtcttctataatattgccttgcggcgcatgatcgtagtgaacattactatatcataagattgagtgaacattggttatttttatgcctcaatcgaataaagcaatcatttttatttgaaaatgttatattagctagccaggtacgtatcaaatcatctccttcgactagcttgggaccaataattatcaacatttagtgatattgtgccataacattgattccttccggctacgttacataaataacgtatttatcttttggaggatatgttcaatcaacacagcactcatggattttagtgatggcatgcaaatggttctttttggaaaagataaacaatgaagagaataaatgtaaagaaccagatttgattataaatatgcggccggattttgcatatgtaagcagcagatcatcagaattcagagctaatgcattaatccatcatccacactcgtgagggctgtcaggtgcccatctgacgccacgtacgtccaaccagcgcgtttcatgctctgcacaaactagtactccctccgtctcctaatacaagagaatttgatattttgctggtactgtttgaccactcatcttatttaaaaaatttatataaatatacaacataaaaagttatatttaaagtacttttgataataaagtaagtcgaaaaaaataataattgtaaaaattcttgaataagacgatggttaaacagtgtaaacaaagagtcaaaatccgttatattaaagaacggaggggcggaaaaaagagagcaatagtttgattgttattcatgtactccctccgtaaaaaaaaaaaaagaggatgtgaccactcttaggagtataaatctggactatcctttgtccagatttgttgtcctaggttgagtttttttttgacagagaaagtactccatccgttttaggttacaagtcgttttgactctagttaaagttaaatcgcttcaaatttgaccaaatttatagaaaaaaacagtaacatttttaacccaagacaaatttattataaaaatatatttaattatcgatttaagaaaataatttggtattgtaaatatactatatttgtttataaagttagttaaatttgaagtagtttgactttgaccaaagtcaaaacgacttataatatgaaacgaagggagtatcgttttgtttattaggtgaaagatgcatatacaaaactattctcaagcatttcacgtgcctttttatcgtgcatttaatgtgacaaaaatcaacggcaaaaaaccctacatcaataaaattatattaaaaatgcacatgtctaagtagtactgtatatatttgtgaagaacaagattcaagtgatacttgtgaacgccaaattaagttttgaaattgatggcatatggttccacatcacaccactggtgcttattaattaactaaacgatcgatcgctatcattggctgattttcgtgaaatcaacatttgtccccccgccaaatattggtaattaagtgtgaattgagcataaagttaaaagtgccaccttttcaaatgtggtaacaacacttttattggagccatttattttctccgcaaaaattttacttcgttacaaataaggccttagcatgttatggttgatgggactagggactgtttaagtaattttagattatgagaatcaactaatgggaattcagatggtagaaatctagaaaaattggaaaaaaaacatcttctgacttatagtgaatttcctggattttaatttctttatgattaaattgattgtaagagatgccgcagcggctaaagacaccctaaatagcttgtagatattaagatacacatctagattcatgatgtatcacttctggtggaggcctaggatacaagcttcatgcaaattctatacaattttttgagagaaaaaagcttggattttacatatagaaccagggcaagatgacataacttagttgtaggcgtgtcttcaagctgactccataatttgagtacatatataatagtctagtttagtatacgtgctatgtatatcctatcggttcattctactttacatgcgagtggtggtcgatcgagcagagaaacttgtgggttcgtccattcttatccgtcctcagattcagcctaaagctcttggcccgtcacactcaacctattgatctgaatatttggcacaagtaactaacacttgaacccaccaataaatcaaaataaataaatttacaatttattctaaactacaaataagttaacggtttagccgcacaccgttaaagccgctttttgggtctcctcacgcaccaggctgcacttgagcggcagaatccaaccccaacacgtccatctctccctcgatcacttggtgaaaaagttttttttgtgtcgcattaaatatacggacacgctaaaatattaaacatagtctaataataaaatatattatatattccttctgtaaactgcgagacgaatttattgaagcaccatattatcaaattatggtgtaattaagcttaaaagattcatctcgcaattagtttttctattatatttaatacttcatgtatatatccaaaattttctgttcgagaactaaacggcataagataagctagttgcatgcaccacggcgtccacccgtggaccggccccacaccatcctcgtgggcccgcttgtcagtgacgttacgggagctacaacttgggtaggtcgcttgctgggtttgttgttgttgggggactcgctggattccagattctgttcggctggatagcgacggccaccgttttgcgaccaccaccagattctctgcgcgccactcctacctacgatcgacttgtgtggatctcttctacttttcgagttttgtcccgtgtgtgtgcaatgcattgcacctgcatggtcagccagccgcatcatccgcccgtacacgtgtcctgcatcgacggcgcagacggtctgtccagaaaggtcgtcagctcagggcacttccgtgatgcaagggcactgtgtgttgccaaacggaatcccttcagttcgctccttttcttttcttttcttttcctttttctataattttccttgctttcaccattgctctcaaatctggctccgttcatgccatgcatactctcctcctttcgtgtcactaaaagatacgaaatgttacacattattagaatctgaataggtactaaatgtatcatattttatattggacttatttcaccaagagagtaattattgggaaggttttacagaagcagatttggcaagaggctcatatatgcattgagatcctctgcctctaaagatatcgtgccattatcattctcatataggatatcttatagtattacgaatataaacaggctatcattccgaattcgtagtcctaacaaatatcccattcaattataggttctatattttgaaacggatgagtatattcaaggttcatcggacccacgtgtcagctgattgcttattcttatattataagacagatgaggacctgtttggtagaactctaactcctaaatttaacttcagaagttagttatggagtggagttgtggagctgcctaaacctagcttcacttctttagtttattttgtgagagagctacacctagcttcgcttctatttttggtggagctgaaactgtagatgtgcccggagtatattcagggttcatcggacccacgcgacagctgacggcttcaagggctctcgtgggaaattgagggtgctataaaagcagccgccatgagccacagccacacccgctgtgggaagggaagagccagagaggccacacacacacaagcacaacacaaaagtggccatggctctcctcctctcctaccccaggcgccacccatccatccacctcctcatcctctccgcctacgccctcttcctcctcccaatcttgggtgggtcttggttcttggatcatccacttcattgccatctatcagaaattgcttcttctttctgattttgtttctttgtttgtgatggatgtttttttgtggtgtctgattgttagatggattggagctgggaggagatgggctctacagggagatcctcagggatgagacggtgctcaggctcaaagaacttggcaaggtcaggttcttcatgtcgttggaatattcagttctttgatccactttttaaggggaatctcgtccggattgtatagattgtttgggctcctgcatgctgctacctctgtttgttgctaattcagatagcttcataattggaaatataaattaattctaggtgttatatgtggacagctattgacacccaaatgaccatatataggtttaaaaaaatatctgtggggttcatgtgtgtacacttctttgttcatcagatgaacagtgtaaatttcatttttaggatacaatttcactctttcctcggagagaatacaatttcattttgtataacttaccagtacagaccatatcaagacagctagctgcaggctactcgaaaattatgcaaaaggattgcaaatatattctaggcttctcatctcttcttttttggggtgaatttcattttactaggcgttaaagcatcaaacttttgtaaggcttttgttccttttctctattagttatgtttattggtcattccaaagaatcatatccatctcctgtattcgggtgagatgaccttacgctatgaaggttgctcaatttttacgttctccagttgaaatattaaatatatataaactgaacaaaatcctggtttcaaagatccgtgctgcaccttatttttactctattgcctaacagtttagccatgcagtcctaacacggcgtcgttttgtgtgaatcagatatctgatggggaaggttaccttgagaggacatttttgagtcctgcctcaatcagagcctctgctgtcattatcagctggatgaaagatgccggacttaccacgtagatttttcttctcttgtttatactgcagtcattttctcaaactttgacctttgctgaccaatatatgccttatattaaggtggattgatcaaatggggaatattcatggtcgatttgaaccgaccaactcaaccaaggaggccttgttgatcggatctcacatggtgagaaatagatatatcttttcatactgtcgcacatcttctagttaaataaaatcactgataaaaaaaataaatcttgtttttttttggggggaaaacaggacactgttattgatgctggcatgtatgacggagctttgggtattatctctgcaatctctgctttgaaggttttgaaagttactgggagacttcagagacttactagaccagtagaggttagataaaaattaattaccctagataaaatgttttcatcagtgtgctagtgatgttactactttatcatcatagtttgtttctttcataagaatatatgtattgggttacattagtcgctatcctactccttactagttgcatgatgagtcacatgtgtcctacaaataagacatttatctgcacataacttgtctctgtcttgtgtattttactagtatcttagtatgtgtcatccacatcatcgatctcgtgttgatttaaattagcatagtaggtttcaaagaacgtgaatgggctgctatcacaatagattatcagaaagactacagatatagacatatttaatccaggatgaatccattatataatgtctctttactcagttggctgtttccctgcttatgtagagaagaacctataccttattctgatatctataattcataaagctgttgggcctcacggttgcctggtaaacctcaggtgattgcattcagcgatgaggagggtgttagattccaaacaacttttctgggaagcgccgctgtagctggtacactacctgaatcaattttacaagtatctgacaagaggttgtcttttttcgcataaatcaaccgaactgttttttgaaattgtttgctgattcagtatatattttgcattcaacttcttcagtggcacgacagttcaagatgtcctaaagctgaattctcttgagggcactgctaatgctcttggtgaagtaaggtacagcccggagtctgtcgggagttatgtcgaggtatacaagactgtattattttaatctaggtgtataacagatataagaaatttagcatttaccattctttttcattactattttggttaggttcacattgaacaagggcctgtcctggaagcccttcgttatccgcttggtgttgtaaaaggaattgcaggacagacgcgattaaaggtgcaatcactttctagttaatacttttttggtcaagagtaagcggtgacacttatagaactatatatgtgagccaaaacaaaaatatgacttgtttctgaaaacaaaactaaaagatgaccaggtagcattgcatactaaatttagaccaacttttccaaacaattggcatgctaaaatgaccaggacctagtaaacaatcaagtaagcaattatattgctggtcattctttagcaaagaatgtcagtgctcgaagtcaacgctgaggtcaggtactattaatcagtgacaactgaagaactttattagtacttcacaagattctcgtttaacaaactattttgaaagactgcaccagcgtagagttggtacttgcaaatcaagtaaaatgttatagcatgagctttctttaataaacagtgataaccagcttagctgactatcaccaaggttgatgtttgatattgttctgaattatccaaatccgttaatctcagtgtgattttagcatgagcagtgcttccttacactacaaaaactaattaaactagttttcaatctcgatgcccacagtaacagattagtaggtgctggccaaaatataatcgatcaaacaagctgggcttgctttcaactgccattgcttagcaactttctggtttctttaggtaattataaatggttcacaagggcatgctggcacggttccaatgaaattgcgccgtgatccgatggttgcagctgcagagctcgtcctgacactggagacgctctgcaaagaacccaacaagttcctcacctacgacgaggaatgcggctgcttcactgaggaatccctcgccggactcgtctgcaccgtcggcgagctcctgacatggcccagcgccagcaacgtcataccaggccaggtaatgtaatgtataattcagcttgatcattgctggtgatgatgcttccaggtaagctaagctggctctgctgaagcttttggagtttggtgatcttatgcaggtgaacttcacggtggacatacgcgccatggacgacaaggtgagggagacgatcgtcaccagcttctcgaggcttgttcttcagagatgcgacgacagattggtcgactgcgccgtcgagcagaaggtgccaagaaaccgaagcatttcgcttgtgatttcgcgatgttttttttgttttgcaggtggtctggtgttaaaactgcggattggttggtgtttgtttttttgcagcacgcggcggcggcgacgccgtgcgacgcggagctgacgtcgcggctggagcgcgcgacgcggtcgacgatctcgtcgatggcggcgggcgtgcgccgggccggcggcgagacgccggtgctgatgagcggagcggggcacgacgcgatggcgatggcgaggctgacgaaggtggggatgctgttcgtgcggtgccgcggcggcgtgagccactcgccggaggagtccgtgatggacgacgacgtctgggccgccggcctcgcgctggtcaacttcattgaccagaacgcggtggatgcggcggcggcgacggcggcggaatcgtgacgacgacggcggcgattcttttggtaggtgtgtgcctagtagcctacaaattgtaaatatggatttgcttgttacatttgtcaagaaataaaattgaattcaattcgttgagacgttcagtactgcttatctttattttatattttatggttgcagttactctaagttcaagttcttaagtttaactctctatagaatcgaatttcagactgcattatttgaaaggctaagtttacaattgggaggctgcatatatttaattggatgtagatgctagataaaaagtaccattctcagagaaaaataataattttatcttttttaatgttttttcgttatttttgagtgagaatcgtgctgcatcacgccatcaatactgtaactgacgagttggcccaacagatatagaacgtaagtttgccatcaatcccgttccagcccaaccaaatatatataggcccaaaatggttccgagtgccgctccggcccaatatatatgagcgtcacgtagatcgtactccctctattctaaattgatctacatatttcatagttacaacgagatcaagaaaagctaataactttctcatactatatttaaaagctaataactttctcatactatatttactctagcaacaaactcgatgcatgcaccatccctattatttcctagccaatagcaaatcaagatattacatgtgggttataaatacttatgtgtatggatgcatgcatcaatatacatttactccaatgcataaataacgaatagacttaataaatgaatataaatatgtagatcatttagaaataaactaaaaaaaatatatgtaaatcaatttggaatggagggagtagtcccgttccggcccaaatagtatgggccgtacgtagctgattccttttacggcctgcgaggtgtacgtgaagcagccgcgtcgagatccaaaacgccaactaacgtgtgggcccgaggttgttggggcccacatggcagtgaaccgtattgggccgggaggaaggagcggacggggctaatgttggatggcacgaggcccaagtttgctagccgaacggataaaagaagtgaaataccggctttggcatggcagtgggtaatatgagtatacactaatacgaaatagtagtagtagtagtagtaaatgataataagattattagatagcacacatcgagagtactagtgatatgaactagtgtgtgtgtatatatatatacacactgcagctggttagtatactactccctcaattacaacattaaagttttgtcctgaatcaaacttcgacctctaattttaaccgagtttaatagacaaaactaaatatctataaacatcaacagttttattaaatccactacaaatatcatcatagttaggatttcatccattccattttgttaatcctattacattttaacggaaagaaaacaacggaaccctaacagtgataacatttctaggaaaaattgattcatgcgatggtatttcttgaaagttacattcgtcgatggtattttttttggaataaaacacttagtttgtcaatgcatggcatttgtccgattttcttctttctatatactcgggagatatttgactttagacataactaaaatgacttattatgtaaaatgatttataatgtgaaacaaaagagagtattattttgttttccattttacatggtctctagtaattaatcctattatggcgtgtgtacaaggcagggatgtggcgagtggcttcgctaggccccattggagccaggtggctcaccagcttggttgcaatcgtgccccatagagggcacggttgagttgcagggctgaggcaaccacgctcgaagtacggatcacgagtcgttacatgttgggcaaggccgtggcctcgtgacgcatgcccctgcgtgttaactaggctagatttgacaaaaggtggtggtgcgatggatgaggttgaagaagataacaagtgcggtgggaaggaagagaagaggacactaccaccacggacaccgtcgagttcatcactacatctgcggatgctgctcaccttgatttgctcattgccaggtggcgctgccttgatctgcaccattgagattgctgttcaatctttgctcgccgatgagggaggagaagaggggccgacttgatctaccagacgcaccgtcgatgtcggatcccaatctctgccgaggttgagcttgccaccaccacctagctcctccctcgttcccacatgtcgtcatagagcttcttctccattaactcgtgaaagagatggcagcaaagagagggtgtgctgagctcctcaccaattctgcaacaaggaataagggatagcggcgaggagggtccgagggtgccacgacagggaaggaggagagtacaactccatcggcgcatgggaggagaggtcctcaccggttctttgaggacaggctatgggggagagagagtgagaaacaccgcaactgggagtggagaggagatggatgaggattttttatattattttctcggttttaggatatgtttagtatacaattttatatttttatgtaaaatgaataaaatatgagtgaaatagaaagcatcaggggctaaaatgaatgaaaaaatgaaaccacgttgtattatatgcaaaaatcactgctgggggaatcatctttagtcccagtttgcaacctcctttagtcctggattgcaaaccgggacgcccaatccaggactaaagctgccccatctttagtcctggttgaaataaccgggactaataaatgtttttttcttttttttcattgttatttttgctacttgcatattgatttcgaaccgaactcaacaacaaaatcatccacattcacaaaaacatcataaaaccatccacaaattcacagatcgaatgaacatactcaaattgacatcacaaactcacagatccacagaatgaacaaattcacatcacaatttcacagatccacaaaatgaacaaattcgcagacatcacaaatgaacaaattcatagacatcacaaatgctgcacgcctccaagtccgtcgccccacatggtgccagcaatcacgctcgcgccgtcgctccaccgctacacaggccgccgtagccagccacctcccctcccaccggatccggcggaggggagggcgctgctgccacccgtcgcctcctcttgcgccgccacctaccgcctaccgcctaccgtcccaccagatctagcgggaggggagggcgctgccgccacccgctcgccggcttgctcgctcattcgctccttgctactactgcacgaaaaggagaggataagggagagggaagagagagagaggagagaggaggaacaaatgaggaggaggagaggataagtgcaagggattatatacggcgcgtcgatctttagtcccagttggtcggttgatgacaccagccgggactaaagatagtgaggggcctgacattttttgaaccgggactaaaaatcatttttagtcccggttgatttatataagtgtcgttgtgcttttgaaccaaagctaaaggtcttatttagtctcgattcctattcgaaccggaactaatgtgatttttatcattcgaacaaagatcacttttccagcagtgaaccagctcagattttagaccggtgacctcaacttaattggcactgtcactgatgcctccatttttcatgtccttatggttccatgcatgcaatgctagtaggaaggttctgcatgcatccctagaagaggccacacagctgctgggactgtaagctgcctgtgagggtaattgtactcctacactactatagtcaaggcaagaaggatggcatgaaggactaacatacaacaatacacagacccaaatcatacaaccatgtgacccaaaaaaaaaagattccccttcttttgtaataaccaaataaaggtttctctcctcctaccaatgcaaatatactccctccatcggtccatcccataataaatttatttttaagctccttttgtatatcctaaaataccttttaagtaatcattataccaaagtttataaaagtagaagataaacatattgggagtagataaagtatgagtaattgtattaagatttaataaaataaggatatttttaatttttcaaaattttattggtagatgtatgtaggattagtaagaaataaacttattttggaaccaagaaaggacttatacttgttacatgcatggccgccggactcgtggaagattaaattttctgccgtggcaacggagcaaagcaaaagatacactgtacggttactgtaccctacacgtatcatgcacctggctggaaatcgaggcacgtcgtacagtacagtacaagtacaagtattcgctgacatactacgtgtagagatcagtacttgtactagctaactacttactccctccttcccataatataagggattttgagttataagggattttgagtttttgtttgtattgtttgatcactcgtcttattcaaaaaaaattgtgcaaatatgaaaaacgaaaagttacgtttaaaatactttgtataataacgtaagtcaaaaaaaataatttcaaaattttttgaataagacgagtggtcaaacagtgcaagtaaaaactcaaaatcccttatattataggacggagggagtagtagcttcctcttgtgcatatgaatgcgtatgtattgctgcagcatatatacagcctcgtacgctacgagtagttcgtactagtatagagatgcagatcgatcgatgcatgcttgtacgtataaacttaataaaggtgaagtgacttggaagatttaattttggacgcgatttgaaagagagagagcgaaaaaaaattgaagtttggccagtagatcgatcgagctagctatactccgtaattataagtacgacgtactccgtacagacgacgcgcacggtagatatcgctagatcgagaagcaagatggtgcgcactatactactactctgtgtaccgctaccacagctttgtgccaaccctgctcttgttaaacgattggggacttccagataatacacaaatggtactgttatatcatgtttataattatataattagttgagtttgacaaaagctttcattgtattaaaaaaggagtaattacatatgttgatggtatataaacttggtgtaataacttagtttccgaacttataataggctagcttgttatgatacacaaacttatctagtgtgtgtaatccaggttcaaaacaacatattataactgattatgttgagttattaggacacccacgatgtgagaacatgggtggggtattctgatatcaaaatataccttagagcaagtttaatagtatagccaacagctagctctaaattatctatagttaatcttatagcctatttatacaatagttaattataaaaatatactacattattaatattcggttccacctatcatacacataatattttagagtgcgtgttgtaactggctacaaatctgtagctcgctttcttctctcttttcttttttcttctcgatatatggttatagctggcttatagcctgctattgtacctgctcttatatattgttagggtcatagagtggtttctagatacgggtgtccatatgattatagcctgccctcaaggcattaaaaaatgaaaaataactcccttctctcactgaccaagagaaaagaagagacgaagggagagagaaaaaaacgattttcttttaaaagtgtgggttccatcttaattaggttggtcccaccttaacatcatcgtactacatatacactgctaaatcatcatccaatattttagacgacattagagaatcaaaatccatcgcaccatcagttgtatatactccctccgtccggatcacgagtttttgtttgtattgtttcaccactcgacttattaaaaattttttggaattattatttatttttttacttattttattatccaaagtacttaaagcacaacttttcgttttttatatttgcacaaattttttgaataagaagagtggtcaaacagtgcaagtaaaaactcaaaataccttatattatgtgacggagggagtacatgggactctatccgtgccaaaatacagcaacttttagcacttagtaggatttgtctcaaaatataataagttatccaccaacattcccttcccaatcaatcacaaccctccactattcactttttctacctacctctacttctcaactaatcataacccctcctatttaattatacctattttcttaataatcgtgtccaactctaaaactctctgtattatatgtatgataagactgagggagtaagttgataactcttttgaaggcattagttattcattgtatttcaccgtggtgaatctttcaaagaactcgggggttgattgttccaggtggtgtgtcaccagtgtttacaatactgtgtggtaaccttttcagctttttaaaccgcggtatatctcacggtagctatacagttttcacggtaaccgcaccagttaccgcgataacctccaaactatggggtgacgggaaccctactatcacaccccgaagttcttctccgaagtctaaatttaatttataaataaccttgagaaaatatcagtgtaaaagcaagagagaaaccctaaaggaattaatgcaaatactaatcggaaaggacatgtgggatttttcttgagttctacatgtcgaaatatgctaacaagatttttagtggaatgttcagagctctagaaataattttaaccaattaaaatttagcacgagcaattatttaatccatgggtattcatttctttctttttcctttcctttttctttttcctcttttttttttcttttcgaatgggccgctggcccattctcttctcctttccctccccgctgggccggccgaaggccaaggcccagtagccagccgcccacgcccctcctcccctagggtcaccgacaggtgggccccacctgtcgggcccgtctcccacctccggccgacgccaccacgccgcaaccgccgctcccgcctcttccgcgcgtccgcacccacgtctcccgccttgctggccctctcccgcacaccccgcaaccaccgccccacttccccgcccgcgcccgcgcccgcgctcgagacgaccgggattcgattttcgaatcccgcctctctctcctccccacctctccccactccgtcggcgaaatcgcggctatctcggccacgatcgatcccttgagcctatataaaccaccaccgcccttccctctctttttcactatttcgccgagctccctcgtgccctcttccgtcctagcgccatcgcccgcctatccgccgccgccgccgccgctccggtcgccgctagccgctgcgccgagccacgccatcgccaccgtcgggttcgcgagcccgagggccacgctgtccgcctctccgccgccgatttccgccgcaggaaccacgttcgcaccgcacgccggtgagcttcgccatggccggcgccctagccatccgtggtctctctctccctctctaactcctcccttttgtttccttaggtgatcccggagctcatcccgctgccgtcatcgccctccgtcgctcgccatcgtcaatggtcgtcggtgaggtccctcctccccttcctctctctctctctcccgcgccgcttagccgccgcgccgccgcctagccgctcagccgccgctagcgccgcccgcgccgcctcttcgccgctgccctccgccgccggccggtcgccccggtcgccgccttgcgccgccgctgcgtcgagccgcgccgccgcgcgccatgggcgccaggccggcttgagccgggcccgtgcacgccggccgcgtgccgccccctccgccgtccgatccaccccgagtggataggagccatcatatccccccgtctgcatgatgtccacgtggccgccacgtgtgagccacgtcggcgccacgtgtgcacctcgtggtgcgccacccactccccggtccatggacccgatccaccatggaccagcgcccggagccactgccatgtggggcccgcatgtcggcgccgccctctctctctgatgatgtcaccagggctaataattgcacaataaatcaattaaggatttttctgtttatagtaaaaacacagtgaatcttctaaaattcatatctaattcatccgtgctccttttaagcccattcaagtctcagtaaatcaagaaaaatgcaaagaatccattaaaaatggttttgttctctgtttcagtagtcttatagcctgtttgtatggtttgttttgtatgtcgcttagattccgactctcctaacgctccggtgtactttgagatagtcgccgaggttcctccagcagcagagcaaggcaagtcatgcttgtcacttgaacatattgaacctatattacaaatgctctatcgtttttcccttaaatactgcattgttttataatgttactatgggatgtttgtctattgttacagccatgccatttttgtaccttactcctttgttagcttggggttgtaacatgattagatgttggattaggaagtgcttagccatgcttagttcaactagcacacaatgggggacaacattaatgcatagatatcaaattttagtaatgatgttggttagtgccaccgctccggtgttggttaattaaaatatattaaatggtgggctgtgggtgcatggttttgatggtagtgcccatggcgattaaggaccggttcgcgggaaaccctaaaagaattcttcgtacttaccataagccagcgtgggcaacggctgggcttgtagtgtagctttcctctagctgacgcatccaggcaagggtgggccctgcgacggcctctgtcgcttccggattcacctagacacgagaggggactgcccgttgcccgctggggacgggggtgaaacctgaggtgtggtgtgcttggctagaggggggttatgcgaaaggtcctgtcacggccttattccggtatgtcatggtggcatgtcggtgcacggtaacgtgtcgtggggctgtgtcttgtgggtacagttgtacacctctgatcagagtaaaactattcgagtagccgtgcccgcggttatgggcggtcaaccagattcaccgtgattagtctcaccctagtttagtctgatggaattgattagttcaggtggatggttgggcttgttgcaacgtggtgtagcgttggacagtggatggttgatgttgattaattaatacaactgttttactgctttcaactactgtttataaatgctcgctttatgtaaatgaaccgctctacctatcctttggttatatcctacatcacaccccctgttccggtatgacttgctgagtacggtggttgtactcagtcttgctctattcccccccctccccagagtttgagtatgcgtcagatggtggcttttccgagttataggcttcgtccgtgccgtcgaggatgcctgtggagtggtgttcccgctgcagtccaagtcaaggcttagctccagttatccgttaattttccgttgtatttatgtaagactttataatgtttgtaagacgtggatctgtatgtcaactttatcgtttgtgtacctcggccggtcctggacggggggttttaatgcacattctgcttggaattctattcgggaatttctggacgtgacacctacccaaaacgatttgggaaaccctgtgtgtcacttcatcaaaagcctatggttttgggccgctactaataataagtcgtcgttaaaatttaaaattttattttgaaattttttatcataatttatcttacaatattgacttttacgaaaatttaaaatttacgaaaatttattgctgcgtttattttaggaccgagtagaagataagagtataaaatgtgaccggagcatgtggagaacttgagagttgtttggtgtatacccctatgccggttgcttcatattcatcacagctgaactgattgattgacctgcgtgcagagccttgaatatttctctcctacactcacctgacagctagctagatcgatctatcgatttgcctgctatcgtgtcactcatcaggaggagaaacagattgatcatcccgtcaccaatcgatcggtcgatctatgatctctctaaacgattgatgagcgaatgtacgaagaagcatttcaggaagggatagcactgtgcaaaaatggaagtggagtagcagtagcagagcaaacgcgaaaatgcagggagcatgagctgagctagggcgtagacgcgtagtagtagtagtagctagggatctctgcctgctttctagggctagcttagcacaagggacagtgacacgagagtggaagtggtaagagacaaactggatgatgcatgctttctgaattctgataggcaggtgcagagtgcagacatggttttgccatcaacttttggcctctagcaacacacacacacacaaagtttggatgtgttttagtttctgaaattagaaaaaagttcaagaaaagttgatagtttggaaaaaaagtcgaaagtttatatatataggaaagttttggatgtgatagaaagttaggagttgggggaaaatttggtgtgaaggccaaactctctcctaatctcattcactctgtctcttctctctcttccttcggctctctttgattttgggtttagttcacgctaaaattagaagtttaattgaaattggaacgatgtgatggaaaagttagaagtttgtgtgtaggaaagttttgatgtgatggaaaaattgaaagtttgaagaaaaagtcgggaactaaaccaggcctttgtttacagaagttgttagcagcagtagtttcttccagagtcaattttttttttcaaataatttagttttttctagattttgaaaatttataattgtaactcgtagaatcttaaaaataaattagaagctagctaacaaccaaccaactgcttattgtagtcgtaagctgtcccacgagctcttatattactaagtcgattttagtcgtggattatctacttgattatagaggtaaattaaatattttaaaatttaaacttaaataatttgaaataagtagtctaaataatgtagcacaagatattttttttaagaaaatgtatttttttgacaatgtaatgtaaataatctgttttaataatcgatgaatgagctgaagagaaatatggtgtgtgtttctcttatctctgtgtgtgttccttctctctctttttatgtgtttgtgtgtgagagagatactacagctttttggaagagaaaggctgatgataagtttcgagttggcgacttcaagtcaattcgtgtagctacgataccaagtgcactagctatagcttagccctagtactgcactggagtaggagtactactgtggttgtcctccatgtacgcaaacaaaaattttcgcatcaaagagacaacgccacagaagatattactgcagagtattaatttatctctactactcgcgatgcactactagccggagtctcaagcaacacatcacacagtgtaaaacaaatccagccacgaatttatacagtgagaaaactatagcaatatccattgcagacgtactcgcgtatattagtagttgtgagataacgctacagccgactacaggtaagggctccgttggaagaatttttttatatttttttagaattttttacttttaaattttattaataaacctctcaaaaaaatatttttcaaatctaaatcttttgtccacgccttgcagtgctggcttgccacgctagccccttgctacgccactatggctagcctggccaaacaacgctggcatggccaaaaggttcagtttttgaaaatatttttttggaaatatatattaataaaatttaaaaataaaaggtctaaaaaataaaaaaattcatgttggaacgcatcattcgaagaacgtaattaagaatagaaaaaaaatagagcatttaggcttcttatttgatttatatagaaatttcataggatttaaatcctatatgatttttttctatttggccctttgatacaaagaattaaagcttttcagatcctatgaaattcctatggaatggctcattgcatgtagatttaggagaaaacatagcaagagcttcaacttcttgaaaaatttcctttgagtttatctctctcatctaatataattcctgatttttcttgtggtctaatcaaacaattatttttatgtttttcttgtgttttgcaatccactattttacatttgcattcctgttagaatcatgtgtttttcctattcctccgtttttcttaaccctgcgattcaaaggggccttttatgtatggacaaatcacgcagaatttcaaaatacatgaagttgtactggatatactagggatttagtgttcttttgaaacacaaatgttgaaaaaacttagggatatgcattgagcttctgaaaggaaatcaaaaccatgaggtttgagcttatgtttgaaatccttcaaaaagtggaggaaagaaaggattcctatgaaaattttcttgaaaggaatcctatgaaaattttctaaccaaatcattcaaaccatatgtctccctagctaggaaaattttcaatagtatttcaatcctacaactttcctttaaaaaccctttgtttcaaaagagcctttaatggaggggaggggggggggcagagagaagatgcgttggcctcaccaaacacaggatcataaaaacgcatgaatgatcataaaaacacagaaatagaaaaaaaaatacaggtttggagtacccctaccacttcaaatcctatgcaggaaaactgcatgaatccgtttagatggagcgcaggaaacacacaggaatcagttcataagagtgaaagacacaaatgatatttttccaataggttgtacctcatgtcaaaattcctatactttgaaccaatccaaggaatttggtaggattttcggatggaaatttcctttgattcataggaccatgtataaaaattttccttaggattgagttccttcaaatttcttacaaacctgtcccaaaggagcactaaaataagatttgagctcatatatagtaaaaaaaatttccaatggaagtgatgcatatgataacagtccatagaaaattgtcatgttcatatcctttgttccaaaacacactagatatatataggaaaaaatccttcaaaattcctttgtgggctcctttggaacaatgtccaacactttcaaaggaattttaaagaaaaatccgaagatattttttgaggaaatgatgaacactgtccaacaaattgtttaaaatcaaccactgccgtgtgcaaaaaataaaaataaaaatgcatagaataacagatcagagctgagacaaaccaaaaccggcgttgcgctacccagacaacaacaacaacatgtcaacaactgctactctactccatatccaatcctttcccctctcaaatttaattacgcaagaacacacagtccatcgatatccatcatccatttatataactgttgctttgcttagattgcgattctcaaatttaatcatgaattctcatatatgcatacctttagctttggcatggctagcctcacatgaattaatcccttggcatctcgagtacaagctagtaccacagtttcactatcatttgatcgcagctgccgcttcacagctgcctcactccactccacttcacccttgaaaattttcagctcacgcagctgcagctgacgacgccgcgcgccgacgacgacgaccatgatgaaccctcgccggctgccgcctctgccgtcgtcgacgtcgtccgcctcggcagcggacgacatggacccgcgcgtgtggcgccggctgccgcagccgctggtggaccgcatcctggcgtgcctcccgacgccgtcgttcctccgcctccgcgccgcctgccgccgcttctaccacctcctcttctcctccccgttcctccactcccacctcctcctctcccctcacctccccttcttcgccttcgtcgtccccgccgccggccacctcctcctcctcgaccccaccgccaccgcctcctggtcccgcctcccgctcccgctcccgcccgtcgccggcggccccgccgcgttctcgcccgcggccgcgtccgccggcctgctcgcgttcctgtccgacgcgtcggggcacaagacgctgctgctcgccaacccgatcacccgcctcctcgccgcgctccccatctccccgaccccgcgcctctcccccaccgtcggcctcgccgccggcccgacctccatcatcgccgtcgtggccggggacgacctcgtgtcccccttcgccgtcaagaacatctccgccgacacgttcgtcgccgacgccgcctccgtcccgccctccggcttctgggctcccagctccctgctccctcgcctctcctccctcgatccccgcgccggcatggccttcgcctccggcaggtaagcgcgccgcgccattgatgacgcatgggtaaatactcttgcacagatttgctgatcttgccttggttgttgttcttaggttctactgcatgagctcgtcgccgtttgcggttctggtgttcgacgtggcggagaacgtatggagcaaggtgcagccgccgatgaggcggttcctgaggtcgccggcgctggtggagctcggcggcgggagggagggagcggcgagggtggcgctggtgtcggccgtcgagaagagccgtctcagcgtgccccgcagcgtgcgcctgtggacgctgcgcggcggcggcggcggcggcggcggtggcgcgtggacggaggtggcgcggatgccgccggaggtgcacgcgcagttcgccgcggcggagggcgggcgcgggttcgagtgcgcggcgcacggcgactacgtcgtgctcgcgccgcgcgggcccgtggcgcaggcgcccacgagcgcgctcgtgttcgactcccgccgcgacgagtggcggtgggcgccgccgtgcccgtacgtcgtcgtcgcgcaccacggcggcgccggcgcggcgggtttccgggtgttcgcgtacgagccccggctggcgacgccggccattggcctcctcgacgccacggcgcccgtcgccttgcatggcatgcatgatggttaggagcatactatgtgcttttttgtgcatgctgcctgcatcaactaatcaatttgttatggcctagggcatgcatacacatgttcatgagcaagctaggtttgtggtgtattaaagttgtttcagcaatggggatcatatgttaatttcttatgagcaattaagtgtgttatatgataggttaggtatgagaattagcatgattctagctagtagtatgtgcaagttagtagtatgtactaggtagcttaattaattaattaggttgtatttgtcatctgagttggtagtgtgctagattgacagtggtctgaactctgaagtggtttcatctctgttaattcagaaaacactaataattcagaaaacctactgaagggtttctactcaacaactactactactttgatcttgccatgagatctgttgaagaatattcatgcatgtgattttctgaagagtgttgatttagatggtttatcatgatcacatgaagcctacaacagtatgtgatcatttgagtatgatcttctggccagcatgactttgtctgttgaatccacctcagatcggtatatagtttctcagtttggatatgcatttcttccatatatttgcttaatattcacacatacttatgtgtgtagttgcatctttcttgtgagtgaaattagtacgacctctattaaataaagctagatactctgaaaaagtaagatgcccaaacttagtttatgtagcgcccttggtcgatcaaattttatggccaatcttttttttttcttttgcaagcttactctagctagaattgtactcctaacatagacattgtatatatgtaaacatagttttcccgatcgatcgagttgttgattcagtatatcatgcatctctggggaagcagtaacaagcaccagagatatggtggttcagatctttagccacccccaaccaggttctaatcacatccatttaattttaaaaatcatgtgtaagtaatatactgctagtatatatagtatgttctaaagatctcaataggattgtagaaatcccaaaggaactaaactgcaaaacatgctacgcactgattattacagtcatttggaacacactacgaagtgatcatgcatgcatgcatgaaactgatgaaagtaacttgtgtatatttcagcagactctgaataaaagagcatatgtgtttcagaaccatgaaattgtacgtcttctgtttttctgttgcaaagtatgacttcactagcttgtagagtatactccatcgcactaactatcaaattgcattttgacatataaccatccagtagcaaatatcttctgtactatatatcttcagatactggacgcactagtgaataaattttcggagaatatatctaacatacgtaccatctggtcctacgttgctctattctgggacggagggagtagcttatctaacatgcatcctgaatcagctaggtttgatagattttgttcgctactacttccgttttaaaatgtagctatttataatattcacttatactaaaataaagctatttcttcacttacttcatcttttcaactaatcataaccgttcttcatttattttttaactatttttttctctaattaatcacaacatttttccaatcattttcatattctagtaggtaggaagtactagtatatatatatagaatcataccgaggaaattatgttaactaacaaatgttaattataaaatgtgatcaaagagaagatggatatatctgatgttgttgttgcttgcacagtagaactatgtttggtaatgtacagtggaatggaggaatctcttatggggaatgcacatgagttaagtactgtaggatgaacagcaagctagggcaggggtatgagtatactcctatatgcaatgcaggtagtactgctgctgctgctactgatcttgaccggatcggccggccggccggccggtcggagggcctctgccatggccacaggaagctctgctcatctgcatgctgggctggctgcaacaatcgcagctggaatcctatcatttctttggctttggccaagaaatcaatggagcagtagtacagcctcaccagcaggctacacaaccttagaccccgggccctatatagtagacctcgaatattaattaacatgggtactgtattagtagtactttaattatactttaattagagattggattttaatttgctgatacggactatacttaattaatctgttactacttcattttacatgttgggagaaaaggatttctaaccattccaaccggtcactccgttttgcaaacaaacatatccataagtggccagttagccacttatccatatttctaaccatcccaaacaaacgcagactaagatgtaaaatactccacaattgatccttaatcttgtcagttaagtttataaactttcatgactcttttgaaatgacgtagaaagtttacaagatttttataagaaatagttcgtttcatgtaaaattccttgattccaaattaaaccttaatttgcatatacagtacagtgcttaaactctgactacctcaattctcaaaaggacggtgatttggacatccacgtaagcttcaatataatgcatatgctttataattactttcttaaagtatttataaaacatattaaaaatataactctaggaatagttttgcacagaaaatctactaattaatatcatttacacattttaaatcataatatttttatctactagtgatttaagattttaagatttgactacacacattttgggaattctcttaagatctagaaccaatgttgttgtaaagcatcgatatacacgtcaatagtttggatataagggtgtgtttagttcacgtcaaaattaaaaatttgattgaaattggaacgatgtgatgaaaaagttagaagtttgtgtgtgtagaaaaattttgatgtgatgaaaaagttaaaagtttgaagaaaaggttgggaactaaaccaggcctttatgatggcatgaagacattatactatttgttaactacgttatattgaattctacatcaccaggatattaattatgggcactcctttcccatccaacatccagtatttatatgttctaggtatgcacgatcctcaacaaactagacctcgacttgtcgtactcacaccaatattactattagtaacatgtagttataatgtttgtctagaaaaaatgtccaatgctgcttatatcctactattacaattctaaattttactttgcactttaactgtagaacaaagttattaaaacttgaccaaacagcctatcagagatctccaaattaaatcacctctggtcgccaagtagcagttagcatgccatttatactacatatggtgaattatgtgacttggagaaaacatataatatttttaataagaaattatgagcgtgttggaaattaaacatgagtatcttagggttgagatcacacacccccttctactaaactatcaggtgcatctcaaaaacgtatagtactatgattgtaagagaaaatattgaaatcgtacaaggtatagccttatgatctttttttctctaaaatatctatagggatagtccatttcatatatgaatttcaaagaaaatgatataattaattgcggattattgtactccagtctcctcgatctctcgtggacgttggcaacctggcacaaccaccacccctcgtttactgacgtttttgtgttgttttcaacaagaagataattattggatgtttgactacactttttcataagagaaacaaataaacaatgtccggtgtctctagcttcatgttaatttctaagtcattcatacgtttcacaatgtaagtcattctagcatttcccacattcata

SEQ ID NO: 58280 - DNA, 37632 bp, Oryza sativa
agtcatctgtgacgggccctacggcaaagcccgattgagatagattaatctctatcggccgtaaactaaggcccgtcaccgatgacttatcaagatctacaagttttattttgttcatttttctatataacttttttcccaacatcttgaaattgaatttgaatatatgacaaatataaacagcatttgtaaatactaaatgatttcaaatggaaatatggtcaacaataaagttgatcctctcatcaggatctacaacttttcttttggtcatttgtaagaaaacaaaattagccatattaatgactacacatatcaagtctttgcaataaaacaataaaacaaaatacttcattcattacaatagataagtacaaatgcatcggtcacaagattatgccttccgtatgatctgaacgagcatatgccacatgctcttggggatcatcgtcaaggtcaatgtgaggtcttacataaagattatggttgtattcttcttcatcgacgatgttgtcaactcctacaattcggcgctttccatccctcacgatgtgcatcttcttgtttgaagggtcttttatgtagaatatctgctcaacctgtttcgcaagtacaaatggttcatcggtgtatcccacctttgatagatctactaaagtgaaaccttccttgtcggctttgacaccagtccgtagattcacccaacggcagcggaacaaaggaaccttgaacttgacgtagttcagctcccagatctcctcaatgcggccgtagtatgtgtttgacccaacttgatcctggaatgcatctatacggacgccgctgttttgcactgtgcttttgtcatcttctttgacggtgtaaaatgtgtatccatttatatcgtatccttgccatgtgtctacggtccaagacggtcccatccccaacaattgtactgtctcatttgggacatccgtggacattgtcacacgattcttgaaccattcgttgaaccgagaattatgttctctgttaatccatgcataagatcgtcccaagttctcatctcggatttttgctaagtgctcctcaaagtatgggccaacttctgccatatgttggagtacagcgtaatgagcctgcgcgtacgatgcttgatcgggcctaattcttttccatccgattgtgccaacacctgacaaccttccctcgtgatgagatgcaggaactccgataggatcggcatcggacatgtaattgacacagaactcactcggtcgtgtaaccttcaataatgctcccctcgggtttagctctattacgaacgtacgacttcagaactcccttgtacctttcaaatggccacatttcccttagaaaaaccgggccacataaatttgtttgcttcaccagatgaatagggagatgaaccattatatcaaagaaagatagtgggaaaaacatctccaggtgatagagggtattcacaatatcggtctgcaacccatctagatcttctggatttataaccttctgtccaattgcattgaagaaggcgcatagacgttggatcgtgtgacgcaccttcggtggtagaatgcctctaatagcaactggcaagatttgtgtgattagcacgtggcaatcgtgagacttcattccaacaagttttagatcgtccaatttaacatacttacttatcctcgctgaatagcccgatggaactttaatatccttcaagcatgataacatcgcgatcttctcatccttcgacaatgtgtggcaggctggagggaggtacactctacctgtctctgcatctcgtatgggctggagtttcatgtcctgtagatcaaggcgcgtgttcaacccgtcctttgtcttcccgggaatattcaacatcaggccaaccaaactctcacacacattcttttctacatgcatgagatcaatgcaatgacggacatcacgatctttccagtagggtagccgccaaaatatggatttttttcttccacatacccttctcctttgtcttgctacgttttcttttcttcccaaactcattgcttatgtccttgaccatattgtggacctcatctccggacaaatctttgggagcaagctgaagttctctcttaccgttaaaaattttcttccttcttctaaatgcgtgacgtagcgggagccacctccgatgacccatgtataccatctttcgtgatctcttcagccaccggcttcgtgtatgttccttgcaattggagcatgccttctttccttttatagtttgtccggaaagattaccgagtgcagggtagtcattaatggtgtagaacaatagaactcttagcttgaagttctcctgaccatatgcatcccaagtttccacaccttctttataaagaatctccagatcgtcgataacaggctctaggaatacatcgatatcattgccgggttgcctcggaccttggattaacaagcacaacataatatattttcgtttaaagcataaccatgatgcgaggttatagttcgcaataagaactggcctagtgctgtgagtactactcatgtcaccgaaaggattcatgccatccgtacacagacatatcctcatatttctagggtcggcagcaaagtctttgtgtttttgatcgatattcctccattcaatcgaatccgctgggtgtctaagcataccgtcattccttctctccgtggcgtgccaacgttctgacttcgcttcgttcgggttggcaaagattctcgtgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcatttggacaagcgtgaattctacggacctctaaccccagtggacacagaacctgctttgcttcgtatgtcgtcgtgggtaatgtgttctcaacaggaagcatagccttcaaaattcctaaaagatttgtgaaactcttgtctgtccatccactacttgccttcagcttcattaggtccaaggtaactgacaacttagtgtgttttgctttgcatccagcgtacagaggcgtctcggaatcactgaccaacctgctgaacttcattccatctctctcattctgggctgggtcctcaacgtcacgtaacttgtcttgcagcagatcgtgatccacatcaaccatttcaccgcccaatggagaaggtataaacatgtcatgctcatcttcatcttcctgattatgcgcaccacttctgtctgctgctactccacttcctgattcttgctctccatgcttcacccaacatgtatagcccttcatgaatcctcgttgtaccaaataaccgtgtacgtcctctgcgctatcaaacatattctcattcttgcaatctacacatggacaacacatgtaatcactgtttcttcttttccgatcctcctccgcggcgttcataaaatttattacgccatttctgtactccgtagaatgacgtttcaaatttttcgcatacatccaacttcgatcgattgctacaaaataaaaaaaacaaattgcatgcacatcttataagatcagtattgcaaaagtaatacgtgatgaaatttctcaattaatgtttaatattactcacttgattgatccattttgatcacttttaggaattttctgtttttcttggaaaaaaagacaaaaaatcgccccctacagcctcccaccaaaatagtgaacagtgggatacagttacactaggtggtaggggtatttatactgtgcaataaatatctgtaatggccctaaaacaatcaaccgtgacgggcatacaagtaatctctatcgggtcttaataaaagcccgtcaaaaaagagtgtcatctgtgatgggcattaaacttatctcaatcgggcctctagttggagcccgtcacagatgaccctcatctatgacgggcttcgtttagggtccgattgagatatggaaccctcatcttaatcgggcctcaactatggcccgtcacatataagtgtgatccgtgacgggcttaagttttatgccgatataccatggctgtgcgaccatatctcaattgggcgaaacttcggcccgattgagattacttccttgtgacggctcgcaaattccagtcttgttatgggccgtcacagatggaaggatctgtactggtgttaattaatcaacctatttggccagttagggatcgacgttgcacagtgaaatttgtacggacagaaacatccattagcttttgattgtttgtcatcagttttcatctctgctcactgtcacacatgtacttcagagactagatgactaaaatagaatgctgaatgtacatatttatagcatgaaaacccttcggacaaaaagttactccttccgtcccaaaatataacaaccttgtattggatgggacacatcccagtacaacgaatctggacaggggtatgtctaaattcgttatattaggatgtgtcccattttatacaaggttactatattttgacatggagggagtacaagcatcagatggcatggcacgtatgtaacacaggcacaactatatataggtcacaaaacgtaagtccatgaaagagaggggtaaaaccgagttgcagactggttgtctgctctcggttgtgcctggcaaaaccacacccagattctactcaattctactcaaatcatttgcacaatattgagtttaacaatagaaaagctaaaatgtacgggaaaatcatttgcacattatgagttcaatttctagctttgtgactaactagcttggaaaaaaaatattttctgaaaaggtaaaatgtacgggaaaataatttgcacattatgagttcaataaaagaaaaggacgtcccgcaaaaaataaaagaaaaggacgagatcgatcagtgtctaagaaaagattaattggctaggtcgaaagatcgttgtatatacagtttgccctcggtcgtcagataccatatacaaatagggttgtggtttaaactagctatgtctggtaggcatcaggaacatcagcttgctaccccaggagcagagatgtaggtagcaagttaaatcctgctagcctgcatgatccgcaagggatgttctcaatttggaagcggcaattttgcggtatacaggaacacttccctaagcaagagtgtggtactgtggtatgtcatttagaaaaataaaaagttattgcttccagtttgttctaatcaaccaaactagtagcaaactgtgaaataattaacatatatcaggatttgctgaaagcacaatttaacatggatgatggatgacatttgcccacaagtcctctactgtgattccacatgtacgcttccaagtcagcccacgtgcacgattggggcgtgagccaaatctgacttggaaaatgcccaaatttggccagacctttcggtttgaaagggttgaaatggattgaagggtttgatagggaataatttcacaccacaataaattttgaaataaatcctctccaatccttctcggaacatagccttagccaaattgggggaagatcttagggtgggatcctgtgagaattaggagcccacgctgttttcggcgtaacaaataacgtgctggtccaacacaaattatgtacaaacaaactttataaattaaaaagttcatacataaaaggtgtgcataggaactacgcattcgtgtgtgtataaatttcaaacaaattcattagcgttttatctcagcaaaaagacaaaagttcatacatagacctttatacagaaaaaacttatagattcaaattttgttgggcataaactttcatgtgtacaaaaccattccgtgttattgcgcgatggtgctgtgtccatccaattagcacgatgaggccctgcatgttcttctgggtgtgcctatgaaaaatattaaactaaacgaggaaaagtaagagacggctaaaaatgagagagaaaaatcataaaattaaagcaagttggtgattcctgttctactttccgcaattacttgaataatgtagtccagtgaagaactcaatgtgctcgaacaaataggataggcattcatctgctattctttgcttgcaagtagtttatcaatgtatcataaaaaggtggtggactgaaattgtcacgttctattatcatattacgagcaaattgccggggagatagagtctgtgctgaaaatcaatttcagattagtaacttcggtagttgataattagctccagttcagcagcaattcataacgcacgtggaatacttcagatgataaagttggaaaacactgcactgcagcagatgtcgaaagaaaagtcacctacacggtgtgcaggatggaagaactatgggtgtgtttggttgcttgcataccctcatcctggcccatctcaaggaagagtgaagcgacgaggaagaggaagagtgaaggcccaggtggcgatggcgacagtcctccctcgacggcgttcagatctggcggattcgactgagctcgagcatgtcgcctccgcgcgcgtctggatctggcgaatccgaccgagctcgagcacgccgccctcgccggagaggatggtggtgccatcttaggtcagtcctttgcttctatctcaggtcatcgtcctcctcttccctttctgatttcgttgctactcttcctctccaaatcgtagattttgaattttgggggcaaatgaggagggggcggattgacccctgcttgccccttgcacgcgcggtgcaacgccttgcactcgcgggtgcaacccgctgcatccaccgggcctgcccgagataggaagctcgaatcgagcgtttctcctcaacctggctggggagccctttttgcatcagcggggccaggctaaaaatgctgcacaggcaaccaaacaacaggaagttgcatctactgatgcaggcaaagcctaatgcaggcaaccaaacacgccctatatatttgtgcagagctctgccttcttgtatggccaatcaccgaaacagagtcacgaaaatatcttggatatgactggcctgtgtaagcacaagagagaaataccggcaaggcccagtattctgcagattttttttatctattttagaccttttaaataaataatttaataatagacctcccaataaattattttaaaaaacaaacctcttcgccacgccaccagaactggcgtgggctaactaagttgtcctgtgacggtctaccgtgttgacagggtcaagcaggcatcgatatggcagcggggtgaggtggcgtgacactgtcatgccaggcttggtggcgtgccgatgctgagcttgccgttcttcgcggagcagcagacgaactatcagtacgaaatgatggactagggcatcgggatggagatcggcaacgaggcacgacgaggggaggtggaggctatgagaggcctcatagtgcaccgagctagcgtggatcctagttgcgccagctcggattttcgccgacgtggagcgagcgaccgcgccttagctaggtttctcggcacctaactgagcaacgcagaacctcgcgaggaccaaggcgcgcagcgaggagaagacgtgagacgcgcgcgctgtgggcggcgtagcctcgcgctcgcgtgcccctagtgcccaaaatccccgattcaccctcccaaaatcccctcccgccacagatcggattggaagagaaaaggcaagaaaatcttggggattagaagaaaagaacagatcggattcaacaagatgaaaaataaaacaaaagcaaaatcatcacaacaagattcaacaggtcggactcctcctgcaacaccacccccgcctgctctgattccgacgacgaggacaacgacgacaaggtggggactcgtcgctcccgccgccggtggaggactcgaggaggactcgctgccgccctccaagaacctgtacgggaggcgaggaggaggaccagctcaccggtgctccagatccagccgccgccgccaagaaccgcctgctgcccgccgccaagaaccgccacgccgcccccgccgctcccaccttcgggaaaggcacggtgacggaccgggaggaggcgtgacggcggactcggagaggagcggcgtgggaggtggtagtgggaggcgaggcctcgccgccgtccgctcccgcacttctctaagcacgcttcctcctcggcacgagtgagggaggagaagcagagcgtgggatatagagggaggggaaaggctcgccggtgcgtgcggtttattgcgatgaggcggcgccgtcgacgtgggaggcgaggaggcgcggcagcgtggcaggagaggaggaggcgcggcggtgcgggagagaggaggagccgaggaggcagtcgcgccgaggaggggaggggaaagggtggtgcgagtagtaggcgagggtagttgagagaaataaatgtggggtaacgcgcctggggtcacgcccactgtgggcttggtaccctttaccagtgtctctattcaattaagccacacaactagaggtgtttgcactgtgggatgagtgtctctgggccaactttttaggctagggatacgggccccatggcttgcactgtgagaggcctgatacgggagtccatggaggggcagaagaggagggaggtgcgggcatgtgcaggagagtggaaagggaaggttgtacgagtgacgctgtgaggtgggtcacgggtcaccaaccttgaccggttcatccacgaggagctgctgtcctgcaaggataaaacagtcacggtaaaatatgcatggcagcatttaatattgtacagtatttctagttggaacgcagatcaatattagaatattcaaccaagtaaccaagtagccatgtcatgtgttttacttagtactttctctgttttacaatgtaagtcattctaatattttccatattcatactgatcttaatgaatctatatagttttataatgtaaggcattctaacatttcccacattcatatgaatattaatgaatctagacatatatatatttatatagattcattaccatcaatatgaatgtgagaaatacaagaatgacttacattgtgaaacggagggagtatttcataagagcatcaagttcagaacttcagatataatgttggcgttttacatctcctctctgcagctacattatcggaagagaaatgcacactactcctactagaaaaaacgtttttccaggtgggcaaatttctttattccaaacagccaaacgttctgcctgcacctaaaggcctgtgaaaaaatattttttgcaggcggccttcggacccgtctgtgaaaatatttttgcaggtggactcttctttctcgcatgcagcagatccaaccgcctgcgaaaataatcccaatgagccaaaaaaaattccctgccaccaccccctacccgccgtcgccctaccagctctggccaggtctagggttagggttttaggagggagagggaggggagggaacccgcgctgccgccggtcgccgccactgcagggggccatcgccagagctggaagggagggagggaggaagttgcgtaccaccaatgccaccaccgctgtatcttgaagaaagggaggaagccgcgccgttgccgccactgccctaccccctccccctccgggcggatctaggaggtggggagggaggggagccgccgccgccaccgccctcccctctcttccctccagccgaatctgggagagggagggaaggtgagccgcctccacaccgccaccttcgccctgcgccaccaccatcgattgggtgaggagccacctccgtgccgccaatgtcacttggagaggagccacctccgcgccgcctcagcttccgccaccaccactgtcgcttcctccactgctgctaccatcatcgtgtctgcctccatgccgcgctgccgcctccgcgccacctccacgtcacgttgtagtcgctcggaactgggactgggagtgacgaagggagggtagggtagctgcctccacacctccttaatgccaggccaccgctgctctgatctgggactgggagtgagggagggagggagggaggggaggtgagacatggaggagatgaggagacgagggaggtgaggagatacttttcgcaggcagacctcttaagataccgcctgtaaaaatgaccacttcagaggtatgcctgcaaaaatagattttcgcaagcgaacgataatctcgccccacggttctcatttttccagacagccatttagctccaagaggcatgcccgcctaggaaaaaaatgccatcatgtgaaaaaatggtttttttagtagtggcacggggaaaacaatttgttttgcttcaacccctaattattaaaaagatatgtgctaattatatttattttttatctttaccgctgactagctggtaaatcatttaatcacaagagagaagagatgtcagaaaaattatttatcttagtggtgtccaatttgaactgatatattatttatctaagtgatttctgtattagcatgaggatagacaaacaaaataaaataaaaatggccgtaagcccctgactcaatttctttggcttgtcttaagctgccaactaatatttaggtccatattccgtctttggttttgtggaagaagagcgttgaagctccttcaagagcagaaaactttttgcatttattttgttttccaaagccccgaagttcaccgcaccgaaggttggaacaacaattactcccccatactatgtggtcttcctcatgacctaaattaccttcgaagtcgagttcaatggtccaagatggacacaataaaattcccaatgcttcccaaatctaagtgcgacgggtctggtgagaatactgcagggcttgtggccatcggtctatgaatgatatgctatgagtgcagggtagagacgcacagaatatgaaagcatatgcaagagcttatactacatgtgacaacgtgactattgtcagaatcttgaaattgcagcctaattagttaagctaccaccaggacaagctgaaataactactgtacatgatttggggatggtgcttgcccacggtcaagttacagaggtacatattttggatcatgtttagcaatgccacatttatctcatccaggttatttctttcataattaaattgatcagagatatgatgcccatcatttgaacctctctaaacatttctaccttcagctaaaataacatacttcatttcgcctcttatagaaaacggagtggatttgctgacatgtgttctctccattgatagtgtcttacttttataatatgaaataaagggagtaacatttttacgaagctaaaaaaattgtgtgtacaaagacagggaggggatctatccaataatgatgatttcctgttaggacttgccaattaattatctattatatggttaagcactttagtgtaggcatttaaacttccaacaaacactagctttgcggtaccaggtacatgcctttattcatggtgattaccacatcctgagcaatgaatagatggtttttacatgctagcacgttagagcaagcttacacagcaacataaagaaatgcaacgaacgtttcaatggttcggccattccaatagtcgcatattattgttggttactaattttacctctccactttaatttagaatactaaaatgatttatgtagccaactataaatagtaggcaaggaaatattcttgtctatggtcaaaacatataaataggtttctatgatttaccatatcgatataaaatgcctaaaatttatatgtactgcgatgtaatttctttatggatcaatgccgttcaatattcagcttaagttagtcctcctgaagtttaaatcctagcttcgtcactggtgatggtactgtgtgtactttcatcaaggccaaatgccaaaaagtcctatataatctatctattatatactaaaagtctattaaactttctacaaacgctctcatgctactatatggtgctctaaaaacgctctcaagctgccacatggcgttttaataaaatagagaaaatcttaaaaattttgagaaaaagaaaaaaagaatctagccctcgactttcattaaagtttgtggacccattagtttacaccgttagattagatccattataaatagtaatctatccctcctaatttaccatgtaatacttacccaaaaaatattggctggaataagccaagaaggcatacgcacttacagagttaacaaccacaaacgagaaaagaggaaatgatatacagcaaaaaagaaaaaaaaaacatactgcatatatattacttcacttcctctgttttttttataacggctaatgtcaaatatttagtgaaactatcgaaagaaaacaaagattttaaactgatttccaattatacttcctatggacttctttttattttctttatgatgatcaacgtcaaatatttagtgaaggtggtagtaagaaaaatatattacttcataaaagatgcacacccaaaaatagatcgataatataatagaaaatatcaaataaacctatcatttcacactacaattgttgagtatagataaattttatttgcatcaatgggcctacattgatagttcaagatgaaataatgagtaactaaaatattacttgggacatattgtcagaaacacaaataaaaaaagtattgtttaaaaatcacattttttctcaccaaacacagtcaggattttagccgttaatgactcaatctacgcttttgatttgtacatatttttttaagtacataagtaataaatttaagattgagttctaaagtgcttatcaaattggctctccctcatttatcttgagcatgttccgaactattaaactgtgcatgttttgcaaatactttttatactttttttaaaaaaaatctatttcatgtttgtaatattaaatacttaattaatcttacgttgatgacctacatcgtttttcgtgccctggataagctcaaccaatgagatcgaatgtagcctaagtaggagataaattagattatttactataaaatttaaaattaaagaatcaagtgaactacattattaaaaaatcattactttttttatgaaaaaaacaaataagttttttttgtctcctcgctatttcttagctattaaactaaaacagaaacaaacaataatattggatttttctagaaacacagcacgcgcataccctaccccttgagtatcaccaaaaggctgattcgacacattttgagatacgatgttaccatgggcgtctcgatgtcgatgggtacgtcacctaccactgaaacattttgagatacgatgtcaccataagcatatcgctgtcgacgggtacgtcacctaccactgaaagaataattagttgtaaatatgagcacccgtatcaagtataggacttgaaccaggtgggcaagttccaccacaagaaacctaaccaattgatccgctcactttacaataacgttggatattaaaacaaccataatttttaagttacattgttggaatacttctatgccttttaaaccggtgaactattagttatagctgttagatcaatcttatatataagttaagcatgtattcatggtacatgacatctccaaaatattactgcacaattgtattttatcattatcatatttaagttaggttgcatggagcctctcacccaccctacatgaaatgttcatagatgggtcgcctcacaaactacatcaatcgtattaggctatataaacccatatatttagtggagactcatgtcccactcaattcatcctttaatgaactattacaatagatatgcaattaaaaaaaacaccttactttactttcattgacacgttttctaaaataaaaagtctaccttattttcaaattgtaaagaagactataaataattgcttatagatattacttaagtatgatataatataaaactaatttagaaacttattaagcaattaatgccaatgaaaaaaatttacgaacaaatcgcgacagaagttctttgtttaatattttgctcttatacttatctcaaatttagtatacgatgcatgccggcgcgaatacgcgggctaccttcttcctagtttattaataatgaatataagtcagtctggcctccttgaactgtcaaaagaatagtgtgtagtttactatattaattatcataaccatatttctctagcaatctgcagttgtctgtaccaaatgctaaatataaatgcaaccttttactgtctttgcctctggatggatcatacgtcctttgagtagtaccgtgaattagtgttatgtatatgtttatttcttgcactgatccctaatctcagttacgaaccgacactgatgctattttctatggtagtgacagaatcctatcagacagtggtagttattactttgtacgtatcaaactagtaccaaaaccatattaatttatcaacctatacccttccggcaccaactttgttcgtagcacgtaggctgtgtttgttgtgggtggttgggaaaaaacctcctccgcacagaaaacggcgcggtctattagcgcgtgattaattatgtatttgctattttttttaaaatggatcattatgatttttttaagcaaccttcgtatagaaacttgttaaaaaaagtacaccgtttagcagtttgaaaaatatacacacggaatacgagggagagaggttgggaactaggagtaaagaacacaaaccttagacataattctatggctttgtatcgatcttttcatagacctgcaaccataaatattgtgcaagatatatataaaatgaatttgcaggaactccatcaagaaaacctcaggtctccgttcaataaaattccttgcagtcatggtcatcctctcctacaccagtaccggtcatccaacacattcggttttgcattgggaggcattgggaatcctagagatactaagcagtatttgttggtttagcttgcggaggctataacaaggttgattagggtagcactagctagctgctgcattgtttacaacatagctagacagagcaagctagccaacaactactagaaaatggatttttggctactgttccacgttttctcgtgatggctaggaaattgctttcaccaaaaatgaaactttgtaacagctaggatcgatccttcatggaaactgctcttttcgtacaaggaaggataatccagtcaacaaaaatgaaatgtaacacgaaaggtatttgctataaattttttgacatatacttatagataaagcattttcgtagacgtggagggtttttttccccagacggatatgaccctcggagctaaatggccgcctacgaaaatataaaccagggagcttgttgtccgcctgtaaaaatacttttttctaggcggaccaatcaagtcctcgtaagtggtccgcctgaaaaaaatatgatttttgcaagcagaattttacgtggtctgcctgcaaaaataatgccaacaaaaaaatatctaagtcctcgttcttaccatctcctccaccatccttatccttatctcctccactcatttccttctcctcctctctctctctctaccagcagagctgctccgcgctctagcctccacctttctccaccaccgcctcccctcttcgccgcgagtgccgccgccccacctcgccgccacggccacagcctccccttctcgccgcgtcgcgggccctccctcctcgccgcctcctccttctccaccaccgcctccgctgtctctgccaccgcctctgcagccgggctcccctcctcgacgcttccaccgcgccacctcgctcctccgccaccggccgtgatgcgcgatgacgacgacgatgatggcgacgcctatggatctgccattggcttggcccgggcgcgtggatccgccgctggctggtctcggggaggggaggggagctggtggcgacgaggaggagaggcggcggctcacctcctcgctctcccttcgtcgcaccgatgacgatggcgacgacggcgccgcgtgtggtaagcccggacagaggaagagaggcagcgacgcacgacgacggcctcaacgatgtcgccgccagctgttggggaggccagcggacggaggaggagagccatcggccagaggggaggccggcggcggtgccttttttttttatttgctgtgatgtttttcgcaggcgggtgaatctaccgtcaggcaggccattgggccgcctgcaaaaatcatttattttcgcaggcctttgcttctagacggttcgttcccccatgcatctttcccactgagttacttgtctcttttgtttacatgagttttacgcgcaaattgcagtctaatttttttttaagaattatacagtacaatgtagacattcacaacacatgcacactcacccctataaacatactagttatattgtaattacttactagttacattgtagttacattcgtactattaaagtaaataaaatctttgtgtgtgtgtctatatatatagtccccaccaaccgagcaagctaaccatgttgggtacgtaataaaatattatagttacaatgtagttatagtataattacaatatagttatactattatatttgtaactacaacataagtaaacaaattctaattataagcctgttatgaattttttggcagcccagtattgtgggttggtccatcagattgaggcccattagatagttaccgtggcagttactagtgagcagatcttatccaagggttaaaaaaaaacgtgatatatggactccaaaaatctgtcgatagacagctatgtagtcctttccaaccagctcttatgtagttttcatcaaatcatatctctcaatccccctcccactcctccactatatctcattcattagggccatcatgttttttttatccgtaatctcttaaaaattttaaaaatatcttatatttatggacagagtgagtacacaacacgaaatatcatgacaatgaataggtgtgagcgtgactacattggtgcatatatataccgatagtgtagtcgattgcagtgccaaataccaacatctgatacacgtctagcatatcaaagccttataccagtatatataccaccagtccaccacatcgtactgcaggtgagttccagcgttctgtctagctaggttgaacaaattaaaatattgagacaatacttctaatgttacagtaccaatatttttttcttccaattcaatagaaaacaggtagctctgctgtcccagaaaacttgaatatgccacccagtttgccaccatttggtcaggcttgtctgaattactgaatagaaaatggtagctatgctttacatcatgtgcgtgtgtgttatatatgcaaggttatattattctcattggtttggtaggcatcaggaacatctgctcgccatgcaggaagcagaaatgtaatttagcagaggattattgcgagttgtagtgatgcaaaggacagagctggaatggccttagtagcactcttcaaaatgtgccacctagaaagaaatagggcatatcgactgctccatctggatcagtatcatcgctatgaggcaggagtggaagccgagatccctatgtaagaatatgaagaaagatgacgatctgctaaaacctagagacgcgagcgtgatcaaactagttgttctagccagctgaggctatcagcttctaatcatgaccatgaattaacatcaaggcatgtattaaacttaattggaatcgatatcgtaattcttacttttgccttatttccagttccattttttttattttgcaggtatgtgttaaacttttaaagctttttttatattcacttaagctttttttatattcacttaagctttttttattttctgaaatttgtgacgcaaaggacctgtaattgacggttatatatgaccactcttatacattttcatttgaaaaatggctttctcacgtgaaactgtctgcgagtactttgacatgcaaaaattcccatttcaaataccacaatgttatatatgtgggagaaccattaaccatctccggctttgaattatcccaacgcgtactgaggcatatatatatatatatatatatatatatatatatatatatatatatatatatatatatatatatatatatattacacacacacactaattaatgttactggactcggtctgaaaagtgtatttacttcattttgttgatcaaacaacagaagcaaccgcgtcatgcatggaacatatggcaaattactatgatagcagcaatggtttttttaatactatcccaaatattgtcgcaccaagccaaatacattactaaaaactaattttgtagactgatgattaccaatttatacaagtctttaataaaccacctgtgacctaggcctgtaaaaattaatcaacaatttccttatgcatttagaaggaaccgcatgtgacaatcacattttcacagacatctctcttaacgaaatacctgtcaaaatgaattctagtgttagtttgtttctgataatcacaagtcatgcgagaaatgtatgcaagcagctatataggatttggaccataatatgtttactccatgcgtggtctccttgacatcttatctatgaaatacttcattactttgccatgtatgctattcttttgacttcacctctacatacatatttggcgttctaaataacatcaaataaaaatgtcattaactacaaatttcatatttagcgctataaatcagtgcctcctctcttgctctctatactttgcattgatgctgtcatattgagtaatttggtgatctatttgtgcatgcttatatcttgttgatcatcttctagctctagtttataagtagtgtgcaaagtactctatctataagttttattttctctttccataggttttattttttctgtacagggccggattgtcctatcattattagagtgtcaaacagggtttacgattctgataggcccttctgttttgggcactagcggaattcggaatttcacggaatccgatggaaaaccggtaaattccgaataaattttataaattaaaatttgaatacaaatttctgtagaacgagcagttctactctccaagggcctatgagttagtccgttcgttatgattcattctaacaatatatcaactattgcatcctggatggtttggttttttttgataactgaggtacttgcatcacccgtttttcatgtacgcatggcatgtgtggagcagcaaaggtctgtttgcaaatctaaatttgttgcacagaattccattcgtagacattttggtgtataaaagtttctagacttctagtgaaaagcgagaaaacaagttttccaaaggctaatgattatccttggtctgtattttggaggaagatatgctaaatatttgttatggaaatgattcattttataggattgctcgtatgaccaatgtgacacatctccttataacaatgaacaatttttatttcaactatcaaacattcaggcatatggagcatatgattgtgaacattgtgggcatctcaagtaagacgagctagttatcgttgccattcgtatcaaagataatcagctcccacccaagggttttcccttcaagactttactaatggcaagtccttgcagtggttttatttcatcttttgtcttagcttaaagttgcaacagtgaagtctgtacagtgtagctttcatatgcggctcgcaacgtttagccttctgcctttataaggataagtgaaaatttgagttttaaaaaaatttagagatgatttcaggttttcttcacttagccttcaggttataaggataagtaaaaattcgaattttgaaacataattttagagttgatttcaggttttctttgatgtagtttgttttcccgcattttttcaaaatcaataaaggacacgcatataaaagctttacatgtaaattatattttgtcattaataagatgtttcacttataataattataaatgaagagatgagacatacataactataaaaaggcagtctgcttccgtctttgctgcagcaagcaaaaaatatgtaaagctcccaagacgagaggccatatcatgaactgtagtcacctcagatttctcaccgccatttaggagtgggaagctttaggaattctagtatgtctttattgcagtatttgtcttggctccacatacaccaagaaaaaaaacaagtttgtaaactctagggttagcaacagcacagtgcggataggaaatgaaccgcgccctctcactccgttgcatgttcacccggctcagacccctgagtgaagaacggggttcaaccagtccctagcttttgcccttctaggactccgtaacccgaccaagtgctgttggtgatatgccctagaggcaatcatagagatgattgtatcacatactatgtttacatatttatccgagattgtttgcttgaaatagataactcattattggttaacgaatatgtgattctttcatgagactctttatgttgtacgttactatttttaaaggatccctgatcaaatatcatatgtggaacaaatatgtttaaatgatcagcacatgtattaattgatgatcatgtctcatggattatagtatcgagatacaaaattaataatgtggacacatgttggggaacatgttgttggatagacccaacatgagacattgcaagagctatatgcatgtgttgtgtcatcagtgatcacatttagcgttggtgttgaatccttagacctaagattatcatggttcccaacatgataaacgctactgcgtaattgggtagttataaaagtagttttcgggtatgctagaaacatgtagtgggatatgaataatgatgatgggatttgtccctcctatggagagatatctctaggccctatgatgttatagattatagaagtgcatggccatgccaaaggtgattgaggagtcaatcacaagttataaatctatcacaagttcgagtgaatgattgagctattagaggatagcacatatctagccttgagtttaatcgatatcgtgaggcaaaggggttcatacaagtatacactagaggttctgctaggggctgctgttgacacgtggaacgaaaaggtgttttcgggttacagccgagtgtgcatgaacctacagggtcacacgcttaacgggccggaataaggggattggatggagatccaatatgagcttaattcagatagggatccgaataggagtcctacgggccttggaggcccgagtcatggatcctatatattcgtgaggggtgtgacaggcagaggtattgtatcacgtgagaaaccctagccgccactctccttcccgagcaaaaccctagccgcacgcgggtgctagcatttctgcgcgtagtgttctgtccctatatgtgtggataccggtagaggcgctgctgctttgcggtgctgatcagcgtgtgtgtacgacatggagaacgcacgaggaggagaaggtcgagctggtgcgatcgactacttcctctacatcgacgcgcgctacatcgcgagggttccttcgacttcttagcactttcttccgctgctcagcgtgtcgactggtaatgatctatgatctaatgcttgcatggttcctgatttacgcgatagaaaactttgatttatgctgtcgtagcctacgcgtatccaaacacgtgcgtgtgttgagagatcaccgtagggctgtggctgacttaggttggcttatggggactaggattagtttatatattgatgtggaattgcctccagcgaatgagacttgtaattggagtatattttaagtggtaaccatatccagtgaacccatgggtctataaccttgtccccacctccgactccggccctacagggtgaactgcccaacacctgatcggggaaattgccactcctggtaaaacatggtcacaaatatctaatgcaacgtttggctgacaaaatcttggatataattgaagaattttgtgtttccttcgccagaaaccagtcaagctctttgagaaattctcagccatctcatctgccagcgaggacatgcatgcgcaacaaattctctaccatctcgttgacaaatcaacctgtgtgagacgccttcaaattggttctctacattcaactccgtgaagcagctagcatcttaatttttgagattgctgtcgtcgttgatcactacctcctgagatacacctgccatttgatagcaggaaaattgctcggttttgcaatgcacattgttagctttcccatttgatacttcagtgggtaccactctgttttgtcacaactctatcgaaaataccgaaatttgcccctctttaacctctcttcttcgcacccaacccttttccacgtccaaactccagccagcaaccgctgccatgtggaccgcaccaatgcagttggctggccaatgctacacctactctactaccacttgcatctagactctgctcgccatccctaacgtggccgagctcgagctcattccagtcgaaaaatccatcttgagcaattgtcgaccgaaacatgtgaaacttttaggtctccaatttaaatcataatttgaggtaaccttgttcattttgttcaaacaaaacaatcgctatgaaataatgcaaaatgaccgttgtgtaattcatgttatactatgaatgaaaaaattgagtggatggtcgagctggatgtagatgccgcagcagagtgggtgctgccaggcaatgatgggagtggcggcacctgctggacctcaacatgtggttatgctagttatgcctagccaaagttagggacagttaacttcggattggtgtcaaaataaacatttttaaaatttggcaataccaaaattttgataaattgacaacattatcaagatttggtaggattgactcaatataatttgaccaagatttcataggcattaccaatatttggtaacaataaactaaatataaccacatgattaccaattttactaaataatggtatgctgagaaagacccaaaaatgatagagaatcaatgttgaaacagggaaatttggtatttttgatagagttataccaaaagaagaggtaggattgacatttttacaaagccaacgaacctggtggcacacgagcttacgcttccgaacagcatagcgaacgaacaattttccatattgttgtcagtgcgcatgcttttcttttcctaacaaagaacggaggggaagacagaaggtgaaatatccttgacatggagatcagggtggcatagggtagctggtaccagatatatacaaaagttctcaacagagataagacatgtcagcaaatccaccctgtttatgagtctagctaggaagattatttgtaatagatggaatgatatctctgttagttttagcttaaggtagcagagtttagagaggtcaattaagtaatggagatctccatagagcgatttaattatgaatgaaatagctctgggtaagatgtgaatgtgcatttctatacatgactcgaacatgtatactctgaaatcttgtacagtggtttattttggcttgtgctgcaggtggtagcatagttaactaggctgcagtttgatgtttcatacagtagttgtcacttgcagtacatgctcttgcatgtgcttctgtaccagctcagaccatatatataactgacggagcaatggataggtcacgcccagaacccagatggccacaacccctgcactattctcacctcacaagtcatgcttagaattgggaagcattgggaatttcattatgtctaattctcactattgggctggaattttgaggcaattttgaccagaatctgcagcagcatgtacgagaaattatcatttcttacaactggcgaacttcggatggaaaaaagttaattaaatggaatattatttctttttttacgttacatgcttcagcgtttttcttccaaaaaaccacagacggaataggggcgtacacattggacgaaatcatcctgtttataatttgataacccataaaattgcccagaggccacgtccattttatctctaccacatattttttaaaaatagatgatgtcgttgattttcatattatgttcgatgattcatcttattaaaaaaatcggtgtaaatgtgctaaagtatatgagttatacactggtggagaaaccatctttggtcggtcggccaaattctacaatagtcccggttccaataaaaatcgggaataaaaatcatctttagtcccggtttaaaagttaaagggtactttttgatctttagtcccagttggtaacacaccaaccgggactaaagatcatttttagtcccggttaaacaagttgtcagggcgtgtcaggccccaattatttttagtcacggttgatataaacaaccgggactaaagatctatctttagtcccggttgtttataccaactgggactaaaatttaccccaagccacgcgatcttttatctcttcgcgcgtcgatctgtgtctccctcctcctctgtcttatccttagcttcttcccatccacttcttctcctcacttcttctcctcttcctccttctcctcctccccttcccctctcctctgtcttcctggcggcagaaaggggcggccggcgcggaggcccggcggcagcggttgcccgcgcggagggcccacggcggtaggcggcggagacgcgaatggcctcccccggcggcggcaggcggcgcctcgggccgcccggcatgggaattttttttctttatttcctttttaatgtgatgtgaatggctgtgatttgtgccatctgtgatttgtgcgatctgtgatttgtgtgatctatgatttgttcgatctgtgatttgtgaatgataatgggagatatgtgatatgtgaagtatctatgatttgctatttgttatttgtgatttgtgatgcgattgtgatttgttagttttataatgatttggaaatactgaacatgagaaaagaaaacaaaggaaaaaaatctttagtcccagttggttacatcaatatgtatctttagtcccggttgtaagggttacggataaggtataccctctatccttgaatatacgctatacatcgatatggtatatctgcgcgtatacggacgttctatgtatacgctaaggaaattcatcacggagtccacagatggaaagattcctacccggataggactgggtcgtcactgtatcgtgtagggtccgatgtctccgaatcctacttagaaaccacctgacctgcggtataaaagggacccccgggaggacctaaggcatcgaatctcatagccaggacaaccaccacagcctacgaagccggagcctacaggagccaagtcgctggtgatctagtcggaacaactcgactacgatctcgtcggtatcatcgagttccactgtgccctttgtaatctatgacttccatcatataatcccatatcaactggattagagctattacctaccaatgggcctgaactagtataatcactgttttttgtttgcttgatgtcgtactacgtagatactcgtaccagcgtaccccaataccctctatatccggtctgcgggtttcccccgtcgacagtgtcgtcttcccggtttataccacggtgccgatctcgactggtccatcaatgaccggaagcgagaacgccgtggctacaaccccggacgactccatgtcgaaggatcctcccgcagaagtggagaatggaacgtcgacgacatccaagcccgaggaggatcctggtgcggtcaaatcttgtccttccgatgagtgtcacaagccgataaggacaacttccgaggtgacaaggtcatggtgtcctattcacaaaaccagaaaacacaccttgcaagcttgcttggtttttctcaacgcacaagctgagatccgcgcctgcaaagagcgtggaattcagcgcacttcgccgagtcgtgatgtctatggttctattcataagacaaagaatcacgacctctcaagctgcaagattcttctcaacgccacgaatctctcctagagatgtgaacaaggaatgaggaacgatggtcatctcagaccgattcgttggggtgatcgacattgatccccacgagccatcagtcctacactcgctcaaggaccagggttcatcgttgacaagcacaccacgcgatgtgtttgctattgaagggaccagcgcgtctgcgcgcgccgatgcggaagcagagaatcaagtggttacaccggcccagcatattggggccatcaacgcaatactgagggaaaccccttatgatcccgttctgaacgatgatctcgcacggtagacagaacgactacgggaatcagtaaccaacctcaacaacgcatttgaggaggccgctgccgcggcacacccagaacaaccgccagctggcggtgcaaatggcgcaccactagaacagcaggcctcaccccgacaagccacccctccacaccacggcaccagcgatctccgtgaccatttaaatggccgccgagaagcacgacgcgcgcaagacaacgagaatcgttcccgacatcgtctctcttcacgacgtcgagagaacgaagagcgaggaggacacccgagcgagaaccgagaccatgataaccgccacaaccaccatgaacgcgatgatcgcgaacagcggatgccgggcgatactggtcccggacgccgccatgacgatgacgatgacggagatcggcgccggaacaacaatggtgtacgacgagaggattcccgagaacccgggcgtcatcctcggaatcgtacaccgaagccgagtgacccatcgtcgtcgtcatcatcctcttcatcctcatcatcagagagacatccgcgaaggacatacgatcgccgacaacccgccgcccccagcgccaggtgtagagctttcaaccgttcgctacgtgatgtccgacggcctgagagattccgactgggagcaatagagaaatacgatgggagtaccgacccagaagaattcctacaggtctactccacggtactctacgctgccggagcagacgacaacgcgttggcaaattatttgccgacggcattgaagggttctgcgcgttcatggctgatgcacctcccgccctactcgatttcttcgtgggcatatctgtggcagcagttcgtcgctaacttccaaggaacttacaagcgccactcgatcgaagacgatctacacgcgttgacatagaatccaggcgaatctttgagggactatgttcggcgctttaatgagtgcagaaatacaatccctgaaatcaccgacgcctctgtgattcgcgctttcaaaaccggtgtcagagatcactatactacccaggagttggcaacaaggtggatcacaactactcgaagattgttcgagatcgtcgatcgatgcattcacgcagacgacgcactgagacgcaagaacgacaagccgaaaacggggggagagaagaaaccagccaaggacacacctgaatcaagcaagaagaaaagtagcaagagtgggaaaaggaaagctcaagcggaagtcctcgcgtcagaatacgagcgccctcccaagcacccagacacacaaggcaacgtcacgaagagaatatggtgccctatacacaagtcagacagacattctctgaaggattgcctagtcttccaaaagtcgttggaaaagcaactggcattagagaagggcaagcgagtacgtgtagtcgagaaggccgctgaggcaaccactcaggactcggactcggcacacccagattccgatctgcatgtctcgcacatgttcggaggttccacggtgtactcctcaaagcgagaatacaagaaagtggagcgtgaagattgttcgacatggcagggggctgcacaaaagatgaagtggtccgaacagaagattgagttctcagatgaggaccatcctaaggctgctgtcatcccaggacgatatccgatcgtggtcgagcctactattcggaatatcaaagtcgcgcgagttctcatagatggcggcagctccatcaacctcctcttcgccagcaccttggacgcgatgggaatcccatgaagcgagttgactcccaccgatcaaccaggtgcacaaagactacaagtgctctagcccagagttatccaagtacctcgcggaggtcaggaagctggaaaaaagatttgatggaatcgaggtccgacatgtataccgcaaggacaatatcgaaccagacgatctggcgcggcgtgcgtccagacgggagccactagaacctagcacctttctggacgtcctgacaaagccatcggtgaaagagtcaaacgacgaaaataacacagtcgcctccgacatcagctcgggggctacataggtagaacgcgccgttgccgacatcgagaccacagacgactggcggatcccactcgttaaattcataagtagcgatgagttgcccgacgacgatgtagaagccgagaaaataacccgctaggccaaaatctactgtatgatcggcaatgatctatacaagaaggcgccaaacagggtacttctcaaatgcgtctcgtccgacgacggcaaacacctcctcgtcgacatgcacgaagggatctgtggatcacatgccgccggtcgtacattggtcagaaaagcctttcgacaaggatttttctagccaactaccctcaaagacgcttgtaacatggtacaatggtgtgaagcttgtcagtttcatagcaaacacacaaagctaccagcccaagcactgcaaaccatccctctcacttggccgttctcgtgctgggggctcgacatactcggaccattcccacgaggacagggtggctacaaattcctgttcgtggcgatcgacaagttcaccaaatggatcgaagcaacactcacaggggaaatcaaggccgacaacgccatcaaattcattaaagggatattttgcagatatggattgcctcaccgcatcataacggacaacggcacccagttcatcagtgccgacttccaggattactgcattggactgggagtcaagatctgcttcgcttcggtctctcaccctcagagcaatggacaggtcgagagggcaaacggcatagtactacaaggaatcaagacccgtgtctacgacagactcatgtcacatgacaagaagtgggtcgaagaactcccttctgtactttgggacgtgcgcatcacatcgacaacgtccaataaggagacacatttcttcctcgtgtacggctcagaggccatgctccccaccgagctacgatatcagagtacacgagtacagaagtactccgacgaggatcaggaggaacagcgaaatgacgatgtgaacctactcgaggaacatcaagaacgagttgtcgtcagagcagctagctaccaacaggcccttcgtcgataccacaagaagcgcatccgagcacgtacgctttcgatcgacgactacatcctccgacaggttcaaagccaagcagggcgaaacaagctctcacccaaatgggaaggaccgtacacgatcacgcaagccctacggccaggcgtattcaagattgcagacggcgatggtcgcgagttggcaaattcttggaacattgatcaattacgtaaattctatgtataaatcaatagcatccattcttgtaagacatcttacagcttcaataaagccttttttcaggaaaagattacaatcaaagtgttccttcccgatgatcccttaacccgatgacacctagcgttgaaacctatcctcatgtccctttacgccatcttgacaaggcctccaaggaacctaagggaacttcggcttgggacgcccagagccgataaggccttgtcggatcctgtagagacgaaagaccatgtaagatctggtcgtgtaagagttctcgccgtgcatattaaccaagccgtgtaatcggaaatcgggttttccaacttcacggctgggggctaggatcagtgcttgttcaaccaaggcaggtcaaaggtccaagagccatatcttccaagaagaattctccgatgacaaggctgggggctagggagagtgtatgactcaagtgactgatcgaagtcacaaagtgagaagacactcgtacacacagcatccagagtaagaaagcttagttagatagatttcctttctatttcacaagtacttcttacaatccgcaaaaaattccaaaatatattacactttttcctaagatatttgtcacagatatataaagactaccaggaaggccaatgccaatccatcgactggaagactttctccgccagcggcgccatcgacttcgctaggttgtctatctctgcgggagtcctccgagaacgagaaaacccttcgcggatgaactcgaggtgcagttgcggacgacgatctcgtatacaggccagcacgtgccctccgacataccggctcgatcgacggcactcctgctttaggcctcgtcgatacgcttgccgatgccttcgagctgagcgcaagccccattcagccacgagatgtatccggccgctgactcctcgggatcaccgcgaggtactcggagttccttgcagactatggccatggttttgcaacaactcctgaggtacgagttgaaccacacctcgcgacctcggagtgcttccacggcccgatgcttcttgacttccagcatagtcctctcgagttcggcgacctcaaacttcgtcctccagtactagatgcgacgatcacgatcggcaagcgcactctcaaggtctgctcggcatggaaacgactaagttaagctgttctcctctttcgagaacacagcaaattaagccaatccagacagaagagcaaaggggatggaaacaaaaagaaccaacctaaggaaggcgtcgccatgcccatttccacgggcagattctggtccacgtcgtcctgcggcacatatggctcgagcgcaagtgccggaacgattacaggcaactcaggctgcccgcgctgctggacatcctcgacatctacatctgtacaaacaacaacaaagtacccggaatcaaaatgctaaagaaaactaaggtgatgactgcacacacaaaggcagttggaaccgacaaaagttttacaaagcataattgattaaggagtacagccgaactgaagtcctactcttcaaaaagtgggagaacagactctcctagatcactgacttcttccatcacgtccttacgcgcgttgttagctgccccctgatccaagatcctctggaaatcgagttcagggtgcgacaaccttacgcacgcgaggaagtggcacgccccggtgtagatcccgttagacgtctcctccccgatcctggccgcatgcttggagcgaatcgcctccatcgccgtcgccagtttcgcgagcgaagtcgtcagcgagaactcgtcgggattcgccaggatggtgctcgtgacaccgcactccccggcgagctggtgtaggcctgtgtaggtaacccgcagcgaaccacggatctccgacaggttgttctcgagctccgacatgcgctactcgagcccctgcccttgtcgctcgttgccggccaccagctccctcatcttcttgaggtcctcgcgaacctctgccaggtcacgcgccagcttgttggcacgttcattcgccgacgacgccgccgccgccctcgcctccgcaatctcgcgacctatgccgcgagcgccggcctggaggatgcgccccatctcgacttggagctcctcccaggtgaggacgtcagcaggcgggcctcgagcaggcacaagatcgcctgcagggccgctgggcgtcgcctcacggctcctgggcatgactatgacatctgtcgaggccactgcaggagacgcactggagttccctccggacccatcttgcgccgctttcgcccgcgccgccttgcaaaaaattgccataatggctatcaagacaagctgccagaattcgatcaagtgaaggacctcaaatttgtccacttacttctcaccaagtgtcaccagcctctgccgtcacggaggcgggggagacgcatccgatgcctaagtaaaacgagtacggtgtgaggacaacatcttccgactacgcaataaatgaccaaaggggctcaccgatggagtgggcgccttccgatgattgccgagcacggaggagaacttcctccccttctccacatcaatgccacctaatggggaggggaggggggcggttggaagatctagcacctatgggccattactatccaacaccaataagattgtatgtagtagtgtgtaccctgacccatctattccttgttgatagcaacacctcatggatgccctgtcaatatatctatgtatatattataatagaaaatagttgtcaattttttttaattgtgtcctcgtactatcaacttggagtgaatatgtcagttttgtatgatttgactctcctccacatacaccagaggacaaatatctaatgccttgtttggttcacataattcttgatagaattaaactcagcatatatatggtcttgcatgtgcttccatagtgtgcttctgtaccatctcgtaccacatataatcaaattaagaagcaatggatggaactctctcataacccgatggccagaagcccagcactactgctacctcacgaatcgcgcttagggttaggaagtatcaggaattataacatgtccatttctgatcattttgacaacgatctggactggatagtacgtaggggggcattgttttttcaaaccaaagagttttttcaacctttggtatgctgaacttcggacttttggaaagaaaaagataaacacaaaagatttctgccatcgagatgtctagcttcaacgttgttcttcgatcgccaaatccaaagacggaatgtggacctacatattagcagaagcattggcagcttaagacaagccaaagaaatttcatttttattttatttctctatctgaatgccaactcttctctcttgtaattaattaattggcaattctcctgctaagttacagaaatcatttccacaaatatactggttcaaactgaacatcagtatgataaatatattttttttatgatgtcaacctcttctccatcataaataactgttcagcgtaagaaatatattcagacaagtatgtacttttaataattagggtttgatgggtattggaaaatgtcatgccagcgcccatagcatcagcgacaatacatgatgaagcccaacccaggcgatccatgcgagatcggcggcccacgagcaagtacgtgtcgaatgagtggacccggtagctgtcgaccgggccactgccagagagggagcgagatcttttggcacatcgctatataagatcggcagagtagagagaaaaggaatcgaacattgtagaaacaacaaaatcctcaattcaattcaaatctctctctctctgttctactgcttcttctgttctttctctgttcttcctcaattcctcttctcaattcacaaattcctcttcgatttcccacggattcgtcttcgtctcggcgtgaattccacaagtgccgtgacatttggtatcagagcagcgatcctggagaaaccaaggtacacttctcgtttgcaatcgcaggttgaggcaatggagaagcagaatctcgatttcggcaagttgctcggcgacatccaggagtcgctggtggcgttgaacaacaagcaggcggagatgcaggtggcggtggcgaagttggacgaaggggttagtggatggcgaccccaagttgaagccgcgatcaaggacttgcgcgctgaggtcgacgaacttcgacagcagcatgatgccgccagcaaggagaagcaagctccatcagcggcgctttcccctcgggtcccgttgacgggcgaggaaaggaaggtgccgttgttgccgactccgccaccatcgtctcactttggcgcggcggaaggcgggagcaaattggccgatggccacggcgttccactacatcaccggaggagggcatctagagtggttaccactctgatcccaactccgggcaagggtacgttcaatgtttctcctgtgcctttgcattcctgtgaaaattttggttcggggtttggggaaatggatggagaggttgaggaacgccattatagccatagagtgcctaagttagattttcccaaattcgatggtaccgacccacaggattggaggatgaagtgtgagcattatttcgatgtgaataacacgtatccggggttgtgggtgcgtgtggctatcatctacttttctgggagggctgcgtcttggttgagatccactaaagctcatgttcgatttcctaactgggaggatttctgtgctgcgctatctgataagtttgatagggatcaacatgaactgctgattcggcagatggatggaattagacagtcgggaacagtgtgggagtattacgaacagtttgatgaactcatgaataagttgcttgtgtatgatccagtagtgaatatgcattatctgacacaccgtttcactgagggattatataggaaaattcgtaatgttgttttacttcagagaccccgagacctcgagtctgctttggctgttgctttgttgcaggaggaggtgctggagacagctgatgaagtgactgggaaggaagttaagaagagtgaaggaaattctctgggacgttcagttgcaaatcttagaggggcatatcctttgcctactcctccaatgaggtctgggggcatcaacatgggcattaaatctgaagaaaagaaggagtctgaagtaagacgttcatcagggacgaatgagagattatcttctctgaaggctcaacgtcgtgctcaaggtctctgttacatatgtgcagagaaatggtctcccacacataagtgttcgaatactgtgcaactgcatgctgttcaagagttattcacagtgttgcatgaatcagtagaggacgggttgagcacaacagatcatgttgttgagcaaacattaatggcagtttcactacaggctgtacagggaactgaaactggtggttgtatgagaatgctagggcagatccaaggcaaagaaattttgattttagtcgactcaggcagctctgccagtttcatcagtaaaagggtggccagcagtcttatgggggttctagagcaacctgtgcatgtgcaagttatggtggctgggggagcaaagttacattgctgttctgagattctgaattgcgagtggaccattcaaggacatgtgttctttactaatctgaaagttctggaattgaacaactacgacatgattttgggcatggattggctgatgcagcacagtccaatgacagtggattggaccacaaaatctctgataattgcttatgcaggaactcagattcagttatatggtgtaaggtctgatactgaacaatgtgcccacataagttccaagcaacttagggaacttaatgacagaacagcagtgtccaacttagtccaattttgttcagttttcgccttggagtatcaagagcagattcctgaggtggtgcagacagtactgacagagttttcttcagtttttgatgaacccaaggggttaccaccaatcagacaatttgaccatactattcctttgctaccaggagctgggccagtcaatgtgagaccctatcgatacactcctatccaaaagaatgagattgaaagtcaagtgcaagagatgttgagtaaagggataattcaacccagttcaagtcctttttcatcaccagttttacttgttaaaaagaaggacggttcatggaggttttgtgtggattacagacatcttaatgccataacagtgaagaataagtaccctttgcctgtcatagatgaactattggatgagcttgcgggagctcaatggttttctaagttggacttgcgctccggatatcatcaaatcagaatgcatccagatgatgagcataaaactgcttttcaaactcatcacggtcactttgagttcagagtgcttccttttgggttaactagtgcaccggcaacttttcaaggagtcatgaacagtgtgcttgctaccttactcaggaggtgtgtgcttgtattcgtggatgacattttgatatatagcaaatctttagaagagcatgtgcagcatttgaaaacagtttttcagattttgcttaaacaccagttgaaggttaagaggaccaagtgttcttttgcacaacaagaactagcatatctgggacatataattcaacctaatggtgtttccacagatcctgagaagattcaagtaattcaacattggccagcacccacttctgtaaaggaattacgtagctttttaggcctctcaggatactacaggaaatttgtgcgcaattatggcattcttagtaaacctcttacaaatttgcttcgcaagggccagctctatatttggactgcggaaactgaggatgcttttcaagctctgaaacaagcgctcatcacagctctagtccttgcgatgccagatttccaaactccttttgtggttgagactgatgcatctgacaagggaattggtgcagtgttaatgcaaaataatcatcccctcgctttcttaagtcgagcccttggactgcgacatccgggactctctacttatgaaaaggaaagtttggccataatgcttgctgttgatcactggcggccatatttacagcatgacgaatttttcattcgaactgatcaccgcagtttggcttttcttactgaacagcgtctcaccactccatggcagcacaaggctcttaccaaactcttggggcttcgttataagattatttttaagaaagggattgacaacagcgcagccgatgcattatctcgttatccaggttctgatcgggtggaactttcagctttatcagttgcagttccagagtggatcaatgacattgtggctggttattcctctgatcccgatgcctgcagcaaggtacaaactctctgtatcaattctggagcagtaccaaatttttctttgcgcaatggggtgctttattttcagaacagactttgggtgggtcacaatgtagatgttcaacagagaattcttgctaatcttcacacagcggccgttgggggtcattcaggaatacaggtcacttatcagcgcgttaaacagctgtttgcttggcctcgtcttcgtgccactgttgttcagtatgtg

SEQ ID NO: 58281 - DNA, 11958 bp, Oryza sativa
aacagcattagtccagaacacgaagagagacagagagagagagagagagcaccgtccagagagcgccctcggcgatggcgaacccggagccgaagaggaactcggaaacctcggcgacgagccccttctcgtacctcgaaccgtacccacgcagcacgtgcctggcaacggcgggatcgctgacgacgacgagatcccgcggccccgccgcgaggcggtagacggggccttcctcgcggaaccacttgaagagagggaggaagagcgcgccgccgaggaggtcccgcacgtcgtcgagcttggcggaggcgacggggatccccgagtcgtcgcccccgccgaggcgggttgccaccgagcgggagagcgccgtgagccagtcggggctcacccacgaggtggtgatgggcggctcgtctccccccgctccgcctccgcctccaccgccgctgctccttggcggccgcaggcggaggcggacgtggccacggcggagacgcggcgagaccaatggcggaggaggcgggcacaggaatggtacgcacgggacggcggcggcggcggcggcggccatcgcactggccgcccgcgagctagggattcgagatggattttggggaattggggtcgccggattggggggagagagagacgagacgagatgagcagttggcagttgggcgcggggatggatgggagggggaggaaggggatgaggtgggacccagctgtaagtggcggaagcagcacggcacaaagcgcgtgagttttgaatgctgcgactctcgtggtaggaagttcttgggccggtgggccgttacaggcttacagcaatcggttacataccaagaaggaaaaagtatacttaaggtccctcaactagtcatcgggataaaaaacgttctcgaaccacaaaaccagatatgcggggcccttaactatacagaacgggtcacccgagatccttcggggttttgaccccgattttagtctacgtgacgactgagtcagcatggaccccacatgtcagctggccacgtcatcaccctctctcctcctcaccctttctcctctctctctcactgtctcacactcttctcgtttgggtaggcagctggggaggatgtcggagggctgttgccttcaacggggctaggtgggacgagggcgtcggcggccggcgacgggcgacacgacggcggcggctggcaactggcgacgcaccgccgttgcagaggccgcaggagcggaggtgggccgccgtcgagggaggaggtaggcaagcaaggggggcggggaggccggcgatgacctcctcaccggctgcgagggggagcaaggcgtcggcggcaacgaggcggttcttagccgcggccagctcgacccgtagtctctcaagctcctcgccgagcggcatggagggacgacacggcggcggcaagccagtcgcatcgtcgggtttgatttccgacagcaaatttccctgcgcaaacatcagatcgggatggctgcggcgatcaggatgcatgattcggaagaaggtcactacagttttcactcaattttgtccaggtcgttcactcaattcggaatgaaattcattttcagtagcactggcacatgatttttcaaaaacatcaagttgtctcaactcttcggatcgaacaactgctttcttggatcaacatcaacaaaataggattataggagcgctggccgctgcacatgatttttttggttggatgcggcagatttggcaacgctgaggagctccgcggtgtgcaggaacgtgtcgccgcgagcgtcgtggtgtgcggagaaggagaacagcgggcagcgtgacgcggcggcgaggacgacgacgcccaagcccgctctttgcgcggagaaggagagctaccgtctgggcagagagctaccgtctagattttttttatgtttgcgtgtgatcaaggctagacaaagagctagatggtagctctctgcctagggcccaacctcagcgccaagaaaaatggtgttgagacttaagacctcggcgccaaatcaagtggcgccgagctctgtaacttaaccgtgtgcttgcggccgacccaacatcccttttgtgttggccgtcaacttggcgctgagcctacaaacgtcagtgccaggagtaatggcgctgaggtcctcaatgccaaggcaacgcccaacataggagctatgttgggcgggcaggcctcgcgcggctgttgacagaaaatacgaggcctgggagatctgcttaactccagtgcaggtccaaagctcgccttcggatgtatgagcgtgccatttgatttgatattgcaatcaacaagaaatagaacaaagaaaccacaattaatcctataaatgataaccgatcggctaggtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgggatagatcggtcgccttgccgagacagtataaatcacttatatcgaaatatatattaatagtaggattatatacattcatagcatagccgatcaggtggatctagcatgtatctgctaatactccgatactactctatactaagattttaaagtaagtagaatatactaaacataagcttaatatacttagatgcgacaaaatcttaacataaagggcagatttaacatatagatcaagcatatagaataaaagtagttaaatcagataagatcggctgaaactctgatactaccctaatcagcaaccagaaagcaggctagagattgcaattttaagcacgacttaatagatcaaactcaactgatgcagcattaagtatgaaaagaaaaacaatatctggacaatcaagccactggaagtttcatagagtggtagatatatcacatagtctaagttaacatcattgtctaacctaatcggctgccttccattaacagatgttagccgattacagattagatgaagatattatcgaagattatgtgagatatatgataactcgacgaattatatagacaagattagagtgtcataaagatggaagcactaatcttgagaacataagtcgtcatgacaagctttacctcttgttgaagatcgaaaccgatgcagctcaacccgagagcacgaactcgtcgaaataaaagtaaagcataaagggtggcgatgcgccgagattgtattggatgtcttgttttttttacataggactcgggtctatttatacccgagaattacaagatacgttcataacagacacgactattatctctaacaaactctaagataccataagtatttacggcagacttttacccaaacatatctctaaggaaattaaatagaatatcctaattaatagatacaattgccttcccaggactctatccatgcatggcaatcatcttgaagcacatcaacttgaacccgatgacgtacaccgagtcatattatcagaatcggttgtatcggctaaccccgtccgacttgaactatgccgacctgaccttagccgatttggactgcagccgattcttactctatttccgcaacgatcttcatcttggattccacttcgatctgatctttacctccgatgccaatagtgatagaatttaccaaatttggttgttaacagcggctaagtccgaaacctcagcgccaatgtacatggcgctgaggtttgtaggctcagtgacaatctcaatggcgttgagatttgccggctcaacgcgtccttgcggccgaacacaggagcgatgttgagcggcaaggacgcgagcgtctaagtcccaaatctcagcgccaagcaagctggtgctgagcttagtggtttagcgccaatgagactggcgttgacatcctgccacgtaagcgtgaggattggtagggggatggttggcgctgaccccgtggcctatttttggttgaagtttttagcaagtactagttttgaaataagttttccccaaggaccaatttgtcaaaaactcccgaggaccaggtgccagttggagaagtcagatgacgagacttttccgatcctatccaacccatccgtcccgccccgttgctactccctccggtttgataatacttgtcattttggacaaggatacggtcttcaaaaaataattttgactattattttttattataatatgtataaaagtattaacaaatatatgattttattaaagtatttttaagactaatctatacatgtttgaaagataaatattttaaaaatgatttaaatcaaatattctaaaatttaatctcacccttatctaaaacgataagtattatcagcccggagatgggaagagcatttgttctccaacgattgtgctgaagagagactgatttgtacaagtgtgaatgccgcacgtgtgtctatgtaatggacttgagtaattagtcttaagcatccctaattcgtggacaagaaacttaaatcaagcgatccaagacgaagacagccgatcccgggacaggagggcatgtctgacacagcaactctctctctcacacacacaggacagtatggcacaccatgaccaccgatgacgcagccgcgagatcagtttggggagatgcagcgcagctagctaggagtagcgatgttcggtagcagaacagacagaaggcaaccgtgggcaaccaaccagcagagcccgcgtttgcggatgaccatccagctgcactgcatgtacgaccgattcgcgccgcggaattataaaccggatccgatcctagtccattcattcacaacacacgtgtgttcttgatcttggataggggtagtacctgggttcaaacaacgaaccagcgaaagcacaaaacaacgcagtgtcgatcgagccatatgagtggagttgggatcctatcctgtaaatgtacgtgcagtaagtcactgacatatgggtctaaaatttaggtgggacccacatgtcagtgacacataccacaggtacagtaatgtacaacagtggatttgcatccgagtgaccattttaattttaataaccacccaagatggatcggaccggttccatctcactttttttttaacctttaccgacctcatctcacctcagttgtatgactgtatctcctccattcgagtcatgttactgttcacagatccccacacgatgctgtagggcctctgcatttcgccaggcccgtcaataaaatatgagtgtcgtatgataaacacactctcttcctctcacgacagtagatactactactcctatatcctaccaatggatcaaaaggagacagaaaaaaacggacgcggaggaaaaaaacaaggagcagcacgcatggtcgttcgtactcccccaagctgttaattattcaaaatacttactgctaccaccaccagttcgtcccgtacctgtagtaacgaatagatcagtttaactgtcagacactcatgttcacccaaaggaatacaaggcggagtaggattctctcgccgatgcgtcgcggcgggagaggacacgtcggcactcggtcggcagcgggagagatcacgacaggacgacgagcgcggtgcgtggcgtggcctactggagtatactactgctccatctatcgtagggtgtgtttagttcaaaataaaattagaagtttggttgaattggaacggtgtgacggaaaaatggaaagtttatagctcctatcgtttagctttttccctgataagtcaaaatggtttattagggaacaaaaataaatttttagataaaaattttatatatgtgttcttgttaacttaaaagccaatgctgaaaaagaaactacgttgaaaatatcaaaatcaatctcaaaattaagtttgaaaatttaaattttatcttattatttggctgtttaggccatccgatgggagcatgtgtatagaaaaattttgatgtgatggaaaagttggaagtttgaaaaaaagttcgaaactaaccagaccctataagtacactccaatcttaagtacggttgtgggtctttttactaacgttcattttatttaaaattattttataataattatttttatttttattagatgataaaatataaatagtattttatatatgacttgttttttatttttaattatgttttaaaatgaaatggacgattaaacgtttaacataaacttggaatgagacggatgagtaatatactgcgagtttaggcgcacgggcggcgggggtgggcatccgatgcggtggggttgggggtggggggcaagcaaagactggggcaagtacagtggtgtggcgccgctccggaaattcgcttcgcttcgcggcgcggcggctgaggatcagcgtcagccggatgggaatcccaggcgtggaagcgcgatttttaatttgggcggcccccgaggcggtatccgatgatctccttgtcggctacccgcgtcaaacacactggtatagtgcggctaggtacccaacttttctgctgttttacacaacggtccttcctctatttgactatgcctacccgtatggtagcaacttatttcctcctattgtagtaattcttaacattttcaataatgatactgtctctaaaatatatctttaacaaattttctattattacagtactttgtaaaataaatttatatgttgttctagtacctttcaactatatatttttcaaagttatttatagtaaagttataaaattttaacctcaactttgggtgtgtttagttcacgtaaaaattggaagtttgattgaaattgaaacgatgtgacggaaaaattaaaagtttatgtgtgtaggaaaattttgatgtgtcagaaaagttgaaagtttgaagaaaaagttaggaactaaaccaggcctttgtataaaacatcaagaattatagatttggagggagtactccatatccgttttatattgtgaaaaattttgggtttcatgctgtgaaacacttcaaaatgttgatgcatttcttttattgaacttggacaagaccaaaataacttatataatatactagaatagagtgaaaactgtttctacgcaaacattattaggtaccaagatgtgtacaatgtggaaagctatggtatgtattaataattcatccatttcatatgtaattatcgcttttccgtgattatctttcatgcaactttttttgttattatgtggaaagttagctttaagggcctgttcactttgatgtcattttcaaccttaccaaatttcggtaaagttaccaaaaagagtggctacatttagtttgttgttaaattttggtaactatgtaagaaatcctgcccaaattttggtaaggtattttttttattaaagtgaacaggccttaaaagaaaaaaggcttgcttatatcttggaacaaatttatactccagcaaagtcaaatacacatggatcgacctagctagccttttcatactgtgcactcaaaaccatacctttagtgtggaggataacatagtatcccactacaattccactgctataaaacccctagtttattgaaataacaaaacaaagttctacaattagcaagccttaactagggaaggcaatgaaaacaaaaatcaaactacattagactaggtcaaaatgcacccacaaccacaacggttatgtgctcgagccagtatctcatactaccaatactacaccaacaccaacactacatactactactagcggcactgtacatacaaggggaataatacaagctaaaataaagctactccactcctagagaaggaggacctaaacgcaataaccaagtcaattaaacacggttggtacaaaaaggacacccgcccaatacaaaaacgccactacaaatgcaaccgcaaatgcacggccctttcccccaaaacccccactgcattcccccccaaacccacaaaccccgccgctggatcaacaccacctcaagctcgaagtgagccactgtcccaagcaaccttccttcttctccccacctcgttttctccaaatcgccattcacaacccatacacactctgtgcgcgtgtgtgtctctatgatgtcggcgtcgccggagttctacaagccggcgccggtgttctcgccgtgcagctcgccgctgcggctgctgcagcagcagcacggggaggatcatcaggaggagtacggctacggcagcagcggcggctgctgcaggacgccgacgggaggggagagcaacctgaaggcgccagggacgtgcccgccggcgccgaggaagccgcgcgcgcccgccgcgccgtgccggaagcggctgttcgaggtcgaggtgttaagcctccgcctcgaggagctcgagcgcctcttctggcgccctccgccgccgccgccgacgacgcagccgcagccgcagccgcagcagccgccgcagaagcgccggagggtggccaagctcggcagctagctagctcgccggagtagcacacgtgtgcgtggatggccataagtggtgttggttgggttagttactagagctaaagctagagtagttcggagttggtaggatttaggcgtactggcgtttttactgctgtacttgcactatatttctactgctcaaattatctccatggctagtatagctggttgtacactttgtactatacctgcctagctaaggttgctactactactactgtagcgtatcagtgcagtttatactagtatctgtgtatgtgatggcattgggggtgtgtactcctggtacgtattagcaatcaataggagcttagcttgaatttgcttccatgcatatatggcagttgcagtgcagcctgtgaagtaatgacaagttgtatgatccgtgtatacatccatcaatgtatcagtgaatcaatccttgcaacgaatacaatgagaagcagctcaatcctcatatgttctactattgcttccgtcctaaaatatagctacttcctattacatgttttctctactttgtgcaacagataggagtagttctcgaaagtatggagatactgatccatctgcgtagcaactggcaagaacgcaagatggatggattcagtttcagagtgagctgcacctcccaggcacagcacgcagctgggctgcaggaggtgcagggggagaggaatcattcaggaatgtgagacgagagcagaaggccaaagcatcgagtggtagtagcaagcagtaatgatgtgtgtcgctgctgtggctggctttgtagtagtagtagtaccgaaaatttttctgcaggcttggcacccggcaaggctgcagcaggggagcctgtgctggaggtacgagaaggaataattttggccaccggtgccagtaaatgtgaggacgtgtggtgttgggggtcttggttggggatccgagtccatctatcatcacaggagcatcgcaagcagcagctgtccatgtgttctggacttctggtgcgctcgcagatagagcagcgaggaatacggtgatggcgaaatgcatatgaacatcaggctaaagcatgaattgaaaaaaaaataatactgtcactccatatgcaaatgcaatcgtaattttacggtatgaatttattatagcatcattagttattattactacagtaggagtgaggtttaaagctgcagtgaatacggcaatttaagcatctatgacgcatctgtacactacagtcatttaagacatctggagcgagtttgcagggtagtacacactcctattgaaacagttgctccgttgcccctttgtttatgagttttgaggacatatgggacacgtagaaaaagattggtatttattgagccaatgctccatgtatggtgtacatacatactgttatttttgctgttgagtacttaccccagtaatatgatacaaagatcgacgcttcaatatacaccaagggtgaatcatggggttagcttcaaaatgagccgaaaggtgaaagaatcgacaagaaaaaaaagaaataataagaaaaggaaaaaaaataagggagcaaaacacaacagctctatatgcagctgaagaaaacaaaaacaattacagccgttttcgcctatggtcctgcctcaatcctctcgatggtttctaacctcgttttccgtttccatcctttcatagtcgcaaccaggttaaccaacccgacaacctgacttttgctgtattcctgtaagatcagacaacaaaaacataaatcattttgtagaagtatcattaccaaaagtgaaaatttactcaaaaaaatatatagattaacagggttcttactggatgagaccgtgcccaatgaacatactcggtctctggcaaataataagcctgtaaagagtaaaaggctttgtcaggttcttataaatgaaaaggccaaatgaagcatacaaaggcactcggtctctagcagatagtacgtggttggcatagcgggagtactccaagccaattactactgcagaagcgtggtgtaaatgaagccttgactggtgcatgcaacgtacctttatgaaagtatccacaatttgcagctttggcctaacatttgcggatacaatgtgcagcagcccattaattagtacctgaaggagcagagaaaatctttatgagtattcatccatgcctttcaatctagataagctactgggtaagaataaaaaagattacaacctgaaggtccagtgacatcaaagcccgtccttcatctgtgcaccgttttaccctagagagaccttcaactaaaacttctgcgatgctatctatgccatactccagcaagaggtcttggagctgggaagaaaatttacaagttcaatcacctttaacatcagtataacatcgatatataggctgtgtttagttcacactgaagtttggaagtttggttgaaattggtacgatgtgatagaaaagttgtgtgtgtatgaaatgtttgatgtgacggaaagttggaagtttggaaaaaaactttggaactaaacagggccatagtttgaaaaccgaagaactatcttaatgacgaagcagaatgaagtactccctccgtcccaaaaaaaactcaacctaagaggggtgacccctcctaggacaacgaatctagactaagggtaatccagattcattgtactaggggtcaaattccctcctaggttgaatttttttgggacggagggagtaggtccgaaaacattgtattgctcgccacataaagaacacaaacaaagcacattaaccaaaaagggaggagggggtgcccttggcttgtactaacctccttggaaattcctccatggtccaatctagttttgtagtgcttgaattcacccaataacaaatcaacatagctgtaataaaaggtgcaaacaacatcatcagtggcactccaggtcacaattaaaaaacaccactatcaaccataatcctttaactatgcaatttgtaatcagatccctaactatgatactaagaattaaacacattcaatgcagccctgaattattccaaatgcatgtacaagttacagattttttgatatatcacagcatggcgaattttgatatgttggcttcaaagtacaaggacctaatactccacccaatttttttagcacactgcgaaaggaaaggtgtggtttttcttttctgtaagagtaaattcaacaagacccaatatttccaaatgatcagtagtaacacatttccatagaatacctaccgatattgcactcataaaaaaatgatggagtacaacataaataacaaagaaaaaattgctagacatcaaatgaccacaaatcactattgaatcagtcaccaaagacatcaatataatgcat

SEQ ID NO: 58282 - DNA, 9183 bp, Oryza sativa
tgcatgccacaaatgttcagactgaatctgaaaatctgtttattttgtttgaaggccaggcagatcatactcctgcgctttggacgaggagaaacagatgaagaaattaaacaaatgttgatttcccttaccttcaaagctgctgagtgcgcgaatcagcttcaacgctatgaacaagcataccaccgctatcgtgaggtgcttctattaacaagagaatattcctttcccaaatgttacatggtccaattggcattcattgggcgctttttgccactgttaatcatacgctagcctcctgtacacacctatgagcttattttttacaatcaaaacagatattggagtatgaccctggaaatgtgaaagcacgggaaatgacagggcgggcattccctgaagcatctcttggaatagacactgccgcaatgcataggggcttggatcaggtacttttttttattgttgttgtatatcttttatacaaaccgctaaataatagaggactgctatataccggaatcccgttcataaacgggatgataccggttaggtatcagatcctgatacctaactggtatcatgcgattctaccacgtgttaggtgatacttgtgaggtatcagatgatacttattaggtatcatgcgattcttaccacgtagaaggtgatacctgtgagatatcaggtcctgatacctaaccggtatcgggtgatacttatcagatatcatgtgattctaccaggtattaggtgaaacttgcgaggtatcagatgatacctatcaggtatcatgcgattcttaccacgtagaaggtgacttgcgaggtatcaggtcctaatacctaaccggtatagggtgatacttataaggtatcatgcgattctaccacatatcaggtgatacttgcgaggtatcagatgatcctcgtcgtctccactgcaccgcatgcccattcctcccccctccccgcggtgctccaccaccagcaatgcatcggcaccccagtagcaggaggaaggatcccttggagtacaaggagtacatcgtcctcctgaggctgtggccggacgccgccaccgctggcatggacgacgacggcgcgcagcggagctagtacatgcccttcctccctggcaacaccaccgccggcggcaagccgcggctagttcgctcgtacaagcacgtcgttgacggcttcacagttgtcgctgtgtccaaggagcctgatttccgacgctgcttccaggacggcatcgcttgcttgcattgttggtttaagcaggaaggaggatggcaaccttgctggatccggccatggcgacaacgcgctgcgcgcggcggcgagagcacccgaggcggagctgcggcggatgcgtcggggcagcggcgttggcgacgcgccgcctgcgtggcggagatcggtgaggtgggaggacgcgagggatatgacggcgccgccattctctctccaatccaatcccttcatctcgtgctgcagggtggatgacacggtggacgaaaggggatcctgtcccgtcccgacgggatcctgttgtttagcatttctgaaataataacctttcggttaataatgttatcctcaaaacatacttttcgccgggccagcaaagacgccagtcgaaatcttattagagtaagtttaatagtatagccaactattagctccaaatcatctatagtcgatttaatagccaatccatacaatagttatctataaacatgttacactattaatatatggtcctgcctatcatatatacattgtgtcttggaatccgtgctgtagctggctacagatctatagcccactgctctcctctcctcttttatctcctcggtatgtgtttagatatgtgtttatagctggcttgtacctgctcttaagagagagagagagaaggggggggcaatagggtgttggcctgggtacaaacgtcgaccctccggcgacatgctagagctcaacaacacaaattttacaccaattggtggatcaatggaaaatatagccctcaaaacgcactgttatgctaaaatggggttgggcccttcagggcagaaacaggccacaccacagggttgggctcctaggttgagctagttgttcgaacggttttaaaaaacagaaatttgctgtcagcaaaacacttgagaggatggtatccatatatgcttacatctacttatcacctatcgtagccgtttgaccgaaagaagacatgctctttctcccatgtttcgtggcatgtctagtaggtttgtacgatgaaacgtttctctcctgactcctaacgttttttagcgatgaaacggttccctcccttatttagcccatatccaaagcccaatctcctgacgtgctggtctgctctctcgttggcacgcttgcatagccaaccaaagcactttctttctaattatatattaagcaattttagtcctaattgtatcttatatagtaattgtacttagcgctcatttatcatgtggcaggttaagcaaactactcatacatatatgttccttgcaccttggacagggatagcatcaaccctagttggaagtagattctaatggccacaatcagaattggatgcagacaaagttcatatatgaaccaatgtcaaacagggtttgcatatgtttagatacatagaatttctagagacaaacttaaagccaaagtatagtactgcttagcacattaattgatgtcacatgctgatgaagcagaacttgttcaaacattccactcttcagattagatagtaaatttagttcgatcagttagaaaaaatcatgagatagaaggtccaaaatatcttcttttcccttcagattagatagtaaatttagttagattgaatactaactgatagatcgtgctaacataatctcaagtatagatataatcctcaagttagatgcaaagaggttaattgggctttagggcccatgagcgctccggagtcctcactaccgtgtgtgcgtgcgccgtgcgttcgcattaggtttccctgccgtccgcgccgttgcgtttgatcgtacaaaaatcggaattaaaaatcgtatgcatagcattttcctatcggtatgtattattcaatggcgttgtccaatttatgatcgcacacaacgccactttggatttttcggattactctacaatttaaatacttatatttgttttggacgtgtggaagtttaagcagactgctcacatttttcttttcctttaggtgaactactacgtacatgcaactcaataaaatgttctttttgttttctgaacttgacgctttgaaatacttgtagctcaccatgtgattgaggtatgttccaaggacaggaactgccgaactgaaacgagcaatgctataacttcaatcaggcagtcattccatcagaagcattcaatgaaaagcccaaaatgatgatttttttttcttgtgcagccatttaggccgaaagaagagtttcgcgtgtgcggcggctacatgaccccggagttctctgagatgagactgaagcaagggcataaataccatggaagtataaatatttttgtccctcctatcccaagaccagagaccaatgcaaatcaagctgttccagctgctcctacaggccacaggctcacacacagccctactacacctccaggtccaaataatgagaaaagaaacagaagcagtcgtgttccagtcgctgccaggaaggggctagcttcttgcttcagatgcatctcttcagattgtaactgaagacatgttccctgaaagcaataaagaaaaaaaatcttgaccagcaacagggctgtactaacactagtttattttttttcgaactaataatttaacttaggtcgaaattaatgacgattctatggacacaacccaacggtggagatggcctgaagaatagaacgaaacacccaaaatttcatacatgaatatgttccctaggttcataaggaacaaatatttctgatgtaaaatcagtaaggaaattcagtgcaaaatactagtaggcgtctagttgcgtcaagaacataagaaaacgttgttttgggttggagagatgttcagcaaacccggttgaaagagatgctaagtagaggaagaggtagaaattaggcaaaattggttatatagcattgaaagttcacgcttttaggccccctttgaatcgcagggtagaaaaaacggaggaataggaaaaacacatgattctgacaggaattgaagtgtaaaacagaggattgcaaaacacaggaaaaatacaggaattgtcgtttgattggagcgcaggaaaaacacaggaatcggatgagagagatagactcaaaggaaattttccaagaggttggagctcttgctaaatttcctccaaaatctacatgcaatgtgccattccataggaatttcataggatttggaaagcttcaatcctttgaatcaaagggccaaatagaaaattttcctatatgatttgaatcctatgaaattcctacataaatcctttgattcaaaggaggccttaagtttatagcaccgaaagataccggttcactttaataacacctaaagttcaccctgttcccatgcatttttaacgcttccgtcaattctcggtcgtgcctttgtgcctggaatttttgagaatgtttcctagtgtttttgtgcctgctctcagtttgtgctagtacctggtcctggccagtcttttactcttttagtctctcgcttgatttgttttgattttcctaactaaaacaacattcttctaggtacggaggaagtactatttctatgttctcaagtgtttaactgatagccaaagatttaaaaggtttatccaaaatccagaggcagtgtttggttaaagggatagggaaatgatttcccacccaccaaaagacatatttaaatcctaaccattcattctcccttttccatttaattctaacccttcattcatttcccaatctcaatcccactcctcatttcccattatccaaacacacccaaagagtactcacaagttacaaatcttttatgtaactagcgaggaggatggggcgcgacgttgtggggcggcgcgagcgcggcgtgggtggggggcaccgatattttttcactaattgcggatcgcgatccggaggagtcgtgcgatggtggcgcggaggaggagcacgatcctgcagcgtccggcgataacccgtcccgcgcgatctgttgctagcgcggtggaacagccgttggtagggagaagagggatgcgggagcaggtggtgggggcaccgtgggaggagccacccaatgacgacgacctagagccgacggcgacgtggagtaggcgtcggcgacgggggcagccagggaggaggaggagtaggcgtcggcggcggggaggaggaggagtaggagtcggcctggcagggggatctggagtgggctcgacgggaggggattcggcgttggttgcgggtgggtggaggattcagcgtcggtggtgggtgggcggaggagtaggcgttggtggtgggtgatggggaggaggaggacacggcggcggtggacagaacggcgcgaccggtgttggggacagtgtctagggttttggagtccgccgcgaggagtcctccctgcgccagcggtggtttgacggaggcggtggcagtggggactggatggagtgggggaatggggtggagggaacgggcgacgaagcgggcacctcccagcgctggcgacgacgacagcgactgcggatgccctccccgcgccagcagaggagattagcaacgtcgtcggttggatcggaagccggagtgcgccacgcagagtccttgcgccagcggcgggggactggacgacgtgggggaatggggcagggagcggcggagacgagcggtgtcaacatttgtggtgtagggggtgcggcggagacgagcgcgtcggtggttggtgatgggggcgaggtaggaggagcgatggagtgatgggggcagacgcataggaggggagcgcgtgggatatcggaagcgttggatctcacgatcctacgcttagtattacgtgtgtatgtcagggtgagtcactgccaccactatggactttttaagtagtactccctctgttttagcttataagacgttttgattttggtcaaagtcaaattatttcatgtttgactaagtttatagataaatatactaatatttataatagtatattagtttcatcgaatcaataattgaatatattttcataataaatttactccctccgtcccctaatataagggatttttttattttgcttgcactttttgaccatttattttattaaaaaaattttggaattattatttattttatttgtgacttactttattatcaaagtaatttaagcacaactttttattttttatatttgcacaaattttttaaataagatgagtggtcaaataatgcaagcaaaatatcaaaatatcttatattagaggacggatgtagtaatacttttctctacgaacttaatcaaaattaaagcagtttgactttaaccatagtcaaaatgtcttataccctgaaacaatgggagtagagattttacaactctcaactgtgtgattgtgcttaattaccaaattcaccttttttcaatggaaacatggtgaagtaggtctgcataactgcgagcacgacggcgactgcggcggcgacgaaggagatggccgaccacgggctggcgaagtagtcgcgccggagcgccgccgtcttcctccgccaccatgtcccgcagtagcggtccacgtccttgtagagcccgacgaaggcgtggctgtcgtggttgacggcgccacagtcgccgaggtggttgaagaaccgggcggcatcgtcgtcgttggccagcatgttctccagcacgccgcgccggcggagcagcgcgacgtcgcgcgccgtgacgatgagctggcccatcagcgccacgtagctgctgaggaggatggcctcgtcgttgcccaggctctgctcgaacgcgatcaggttcgcgagcagcggcgtcttcgcgtcgtcgatcaatatggtgggtatctccatgacgcccctaagggagtcgaacaccacgtcgtagccgttgtctgagttccgccgcacggcgaaagtcaccccggcttcgctcatctcgacggcgcacggtagcactcgcggcgccgtggtactctgttcttgctgcggcgtccgctggctctggggcacgaagctctcgtagtacaggtgtaggatgtgattgacctgcccgttcggccatctgattggaacttgacggccggcgatgtactgaaggagaagctggaggaggttatttccggcctggccatcctgttcgccaaaggcggtaacatataacttcttgaggacgaagaacgggagctgattctccataaggagcaaatcggagatgacgaacgtgaggccccaaccaacgtcgcatagcacatcgggctgatttctgcgccacttacggaagaactcgaggatgaagcatccgtccaggaggagcatctggacgaagtcgtcggagctgaggtcgacgggttgctcgctgtagcaggcgcgcgcctcggcctcgagagaccgcatcttctcaaccaaggcggatgcggagagtccggagacaaggggtggaagtggaacgcgatggttgggttccggcggtccttgcggagacagcaggtcgtggaggtagcgccacttgtggtcctccatggcgcggagcgcggcggcgccgtggtagtaggggccgatggacaccaagcgcggctcgtaggaggtccggctgctctcgcgaagaaaggcggggacgcggaagatggtgaacgtctgattcgttctcgattggactcctcttagaacactcaaccttgcctccaccatatcttccaaccgcgccatgcttgcaactcactgggagaaatacaacagctttctcctaaaatataaagtcactggtacttagcttgatgttaatacttatttcgttagttgagatttatagcactaggtgatatctaattaaatactatgttgctagtacattttaggatggacaaaagtttgtttagtttcataatcagaaatgaagttaatctatctattaacttatcaaaggaatagaaaaagaaccctccacgttcgctctcatagcctagaaattctcacattaatcggagaaaaagaaaaaatagagtccatatagaaatacaatttaaaaatagtttaaattcggaattagaaaataagaaatattaaaaaagagactgaggccatataggaatacaatataaagctaattaaaattcagaataaaaaaaggaaaacatagtctatacatgaatacaatttagaaataatggaaattcgaaatcggaattagaaaataaggaatattggaagaggagactagagtctatataggaatacaatttaaagctaactaaaatttggaataaaaaaagaaaacatagtccatatacgaatacaatttagaaataatggaaattcgaaattaaagataaggaatattgaaagttaagtttagagtacatatagaaatacatataaaatttacatataattgaaattcggaattaaaaaataagaaaaattaaaagtagaatttagaatccatatagaaatacaacttagaaaaaactaaaattcgaaatttaaaaataaaaaatattagaaaaagagtctaaagtccatatataaatacaattcggaaataactgaaattcaaaattaaaaagaaagaaatatcgaaagatgagtttagagtccatataataaaaatacaatttataaataagagaaattaggaattaaaaataagaaatattaaaaaaggagagtagagtttatatagaaacacaatttagaagtaactgaaattcgagatattaaaataaggaatatggaaagaagggtttagagtccatattgaaataaatttgtaaataacatgacttcggaaaatataagaaatattagaagataagtttatagtctatataggaatagaatttagaattaactaaagttagaattttaaataattaataaatatcacgtatacaaaatacaatat

SEQ ID NO: 58283 - DNA, 2800 bp, Oryza sativa
ctaaaattcgaaatttaaaaataaaaaatattagaaaaagagtctaaagtccatatataaatacaattcggaaataactgaaattcaaaattaaaaagaaagaaatatcgaaagatgagtttagagtccatataataaaaatacaatttataaataagagaaattaggaattaaaaataagaaatattaaaaaaggagagtagagtttatatagaaacacaatttagaagtaactgaaattcgagatattaaaataaggaatatggaaagaagggtttagagtccatattgaaataaatttgtaaataacatgacttcggaaaatataagaaatattagaagataagtttatagtctatataggaatagaatttagaattaactaaagttagaattttaaataattaataaatatcacgtatacaaaatacaatatgaatattacacatcagtttggtcaagtcagtacaaaattaaaaattatgttatcattttaatatattttaataacaaagtataaaaatatatatgctattatttaaaaagatataacgatactagccgcgcaatctatgtgggccaccatgctagttgtaacgaagacactagtatcatgtgcatgaagaaattggatggggagacttcgtgataagggagcaagtggctaacccataaatccatttgtaaattaaaatatgctataattttacttatgttgatttataatgggttcacgtgttaaccacttatacccctacttcccgattttcattcagtttagctgttgaggtaaggctgtttatgcctcgctttcgcgtgattgccagggatgaagtagtccacttcactggtgtccactaattttagtaccttgcgtatgataaaatttgcatttatgggttatttaatcttattcaacattactatatattcataaaataattattttattatcgaaacaaacatggaggtaaaaactattattttattattgtagagatgttcgacggaggagtcgtgaccaccacgggctaaattcacgtgtttgtagttacgtacacatggatattggaagctcattgatttatcaccaaatatacgtaataactttaagctttgcgtgcattaagagggccgtacttgtgggtatgtatatacagtgtgcatcttccaagtatataatgaagaaaaagaataggatcgagcatatcgatgcaagtatcttccacagagaccacgtaccattcacgtagagtaaactagctaggtggacggcacttatataaaattatctatttttacacatatttttttttaaaaaaaatattaaatagacatatcgttgtcttatattttaaaaacaaaccttatcagcatcgggttttttatttttataatttttaaaagtcacactggtcaccacccatccctttatttgcttgtccagtcagtctatcacggcttcttttcatcttcattaaaatctataaaattcgtcggacattaaaatatatttttgtctcgaccggcgaattttatagataaaatcaaaccttatatttttgggttaattggatctatgccattgcaaatttgcctcgttagaaaataccattacaattcgtctattcgtagccatgccgctagaattttatagaattataaccacgccatcaccatcacatttttcatcgttttctccatctatacatggggcctacctgtcagaatcatcttcatcctccatcctcccctattttcttttttcctcatctctctccattgcgcagcatcttcctcctcgtcccacacctccgaggactatgacgacaaggcgttgaccggagcagagccgatccggcgacgggtggttgcttcctcctcggcggatgccgctgccgtcggtgcccctgcacgatggaggcgagctcgacatcgacatcgtcctcccctaggtcatcgcaccgtcgcccttctccgctccggcaggtagcagcaagcaccttatcgtccatctcctcgtcaccgagggggaggggggcggccctcgacacctcgtgtctcctggacttcccgccgctggccagcccctcggcggccgcacgctgcgagcaccccgtcgaggccggcagcaccccatggccgacccccaacctgctccggcttcgtcgtcgacgccgcactgccatgaagggatctgggccacctctgcatgcgtcctcgccggctccgcctcaccacagccaatccgtggaccccgcctcggccaaccatcgtcactcggcgtcggacctcgtttcctaccaccaccggcgggtggcccgacctccagatccacgccgccctgcttcccctcctcgatgaagcgccggatccgcgatttctccttcccgtcccgtcatcggcgcggaagaggatacagagggacccatctccgtcggctactcctccgcctatgctgccgccgcctagatatcttgtggccaccgccgccgcctatgcccaccacaatgccgggagctagagtctgttccgccgccctcgcctccaccagaaccgccaccgcctaatgttcgttgcaaggaagaagacgcgagaagaaggaagaagacggaaaaaggaatgagttgatggaaaatgtgacggcaatggcacggttctaattttgtaaaatttcaatggtatagctataaatagacaaattgtaatggcatttttctgataggcaaatttgcaatggcatgatccaattaaccctatattttttgtgctcttggaattgtaatgccaccgggcatga

SEQ ID NO: 58284 - DNA, 892 bp, Oryza sativa
cataatgttcgttgcaaggaagaatacgcgagaagaaggaagaagacggaaaaaggaatgagttgatggaaaatgtgacggcaatggcacggttctaattttgtaaaatttcaatggtatagctataaatagacaaattgtaatggcatttttctgataggcaaatttgcaatggcatgatccaattaaccctatattttttgtgctcttggaattgtaatgccaccgggcatgacagtgttgaccccggtaaagaaatcacaactacacaactacataattgattttcgtggacgaggccaacctccagcctctaggctgaccataacatcatccacttgcgataatatcgatcccgaaggaaaacaagatccacatgcaaaaaatcaattttctcatgcgagccaacttaataggccctccagcgaaaataacttatttcacaagcgggcctgttaagtggcatgcctatgccactagcccaccaggccgacgactgtcgacgtctgatatcgcgattccggtatttgcatagtatggggatcgttggtactagcatatatatatatgcgagactgaggtaaaagagacggagatgaggatttttatacaggttcgggcccctgaattatcaggtaatagccctacatcctgttggccgaagccggtcgttgctcttattcaccataatcaaactagtacaatatttggggtagcctatctaactattgtcgacatggcggtctgaaggtctaactcatagtcgacaacagggtagtctttctcctcgaatccgtgcccggcgatatcagagacagtgcattcgtctctcctgacagtatccggagacattgcaggggactagccgtgcttatccctgaagtcgatatcc

SEQ ID NO: 58285 - DNA, 899 bp, Oryza sativa
tgtacatctttacccagaagacacatctttactccgcattccatggccttggaacccgtcgtaaagatgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataatccaatcaattccaaagtgtccaaatgatatgagaattcccaaagtctaaagttataaaaccacctaatgttgcctaattaatcagcgaagcatctacctaaattcatactagtggaaccataaatagagtactcactagttggggttttgtttaacctagggtgaacaaagtaataatatcaataacaagaataataaggtcataacaaaggtaagtaggtatggctagataaaacagtgataacgcgggaatttaaataaagcggtaatgcaataatttaaatcaacataattttacaaactgggattcaatatgttcaaggatgatgtgacttgccttgctcgctttcccaaacgtcggcttaactttcacgaaaaacggatctttcgaagctgc

SEQ ID NO: 58286 - DNA, 623 bp, Oryza sativa
ttaataggtccgtctatgaaaataaaaatgttttcgtcggcggacccactaggtcagctgcccacccttctctcacttaaaaagtctaagtcctatcctctcctgtctcccctcctcctttcccctcctctcctccctcatagccttatctcctctcctccactctaggaggtggcgaaggatgcgacagtggcatgcgctctaggaggtggtgaaggcggcaggagcgtcaggtgctacgcgaggtgatgaaagcggtagcaacatcgagtgctccgggtgcgacgatccagcagccctgacccttggaggggtggatcctccgccgctggccttgagtgtggtggggtctcagcaacgatgatggcggcggcggcggcggcggactggatcaatgatgatggaagcggctagggtgaatcgaagctaggttttgaattttgtgggttttttttaggtgagtggcttaacttgaccgcccgtgaaaatcggattttgcacgcagttgtgccacccatttgataaaatactattttcgcaaacgcctcttggcaggtcgtctagccatttgtgaaaatgtgtttcagcggtttgtaaaaatcgtttatgtagtgtagtgcatg

SEQ ID NO: 58287 - DNA, 544 bp, Oryza sativa
gcacctcggctccggccctggctgcgtcctggatgacgccgaggagctccgcggccggaatcgggccggtggtgggggcggccaccttggggcacttgcccctcgcgcgggctgctccgacgccaccgccatcacggggcgagctttgccggccctggaggcaagcgcccggaggccaagaaccggtccccgcggcgaggttgtgccattcctgcggtgtgaagaggcggcggcagcggcggcggcggcggcggtgggaggacggagaagataccgtgccattggtgctcaggccttcgagaagatgtctctgctttttttttttctttcacctctgcttcgattccacatgtgtgtgcttttcacttgcaaatgtactccatggagtaatagttgctttcatttggatttgaaaaaagaaatagaacttctaaaaataaaaaaaaagtctttttcttttttttttagaattacacagtacaacctaccactgccattgcctcgctggcgaggacgtgtcgacgggtacgtcgcctaaattcgc

SEQ ID NO: 58288 - DNA, 1346 bp, Oryza sativa
ttattactcattttcacaattcattattcatcaatgttttcattattcagatattagaaagtattgatgatttgacactaataagatatctaattaagtggattcctgcccaaccttgggccgatggggagatttatctgtattctccagatacacatagttggtcttctcaaggcatgaagatgaaattctttatcatggatgaaaagtataatatggaagccaaagggatttataagaagattgatgagttggtcagcctggctaatcattcaatgtttctggctccagtgtttgctttgcatgataagaagatcggtcgtattattctgtgttatccaaaatttgatcaactgcttaaagattggctgcctgctcaagccttttaaaggccggtttataccacccatatggatgcatcttataaagtaagtataattttattcattctatttttgtatctctctcggttgatgtgatacttatatcttgctctatatacacaaattctatttttgtatctctctcgattgatgtgatacttatatctttctctatatacacagagatgtcatatcttacatgagcaacattgataacttggctgcaagcttaggaagtattgactcatatgtgttggagacaaagcccgagagaataaaggtcatcctttttccttttgagtcaagagaagtaaattggcgaaaagattttgctacatttctgatagacatcttcggaacaaatggaaatccaccatgttggatcacttcatcaacatcttacaaaaagatttcaagtacgtaaacagtcatatcgtttctcttatgcttttgcttatattagtaacggaaaaactaagttgtgagcaaaacttttatatacgtgtacttattgattcaaaagtaaatattgtaaaataaactatgatgaaaaaaactacaaaaatcaaatacaaaattaagttctagaattcaaattttggcttataagcataagtgaaatggtagggctgaaagagtcctgttgtggtggcagcgaatctgtcacccaccattgtttttttgtagttcttacaaagtgctcccatatattttttgatattatgaaatagtttggtatttagttcaaacaagtaaataccatatgttgataagcaaactagtgatactaagatattttcaccattgttttttttagttcttacaaagtgctcccatatattttttgatattatgaaatagttcggtatttagatcaaacaagtaaataccatgtgttaaggtaagcaaattagcgatactaacatactccctccttcccacaatataagggattttcagttt

SEQ ID NO: 58289 - DNA, 6593 bp, Oryza sativa
ctttgtatcggccactccgagcagcaccatcccggcctccagggggccggtctgaccgcgcatgtgccgccggtcagatcggccttatgcgccggtcagaccgccgttgtggcgccggtcagaccgccacaatgtggccggtctgaccgcccttggtcaggccgagcccagtgaaagggcaaatgattgtgtgtgtgtgatgaaaaagatagcaaagtgaaaatgcaatgacctaatgtggcaatttaatcatctctttgctaggtcattaccccccttgatagtacggcgaaactaacaaataaactagcaaatttgatcgccctacacctcgatcaattctaaattaaagcactagttttaccgtcttctttctctttgctttgcgccgtcaattttaatccattgataatcatccatgcgcacatatgacttggtcctaacttaaaatatatagctcaaagacaatagttaatccacaattagtgcttgtcattaattaccaaaattaacaatgggggcctagatgcttcacctttgccgctaccgctacaagagagcagatcgaagatagcgtgttcgaacttagaggctgttacaacgtttcaccactgcaatagcatctcgctatagcgcttcagtataaattataaatttttagttaaacttgatgtacaatgtaaatttatagttatttgaaaaaaatccgctattggaatttagtgcccgctatccgcaatccgctaactagacactaattcgctactaaccggctatatgctagtatttatcacaagatatttcaattttatttcaaatcagtacaagttaatattcaacacgtgaactggcatcacaattcgtaatacaaagtcaattattagatcctggatagtagacgtatagtcgaaaaccaagcagcaaagctacaaacgagttggatttgtcgacaaactcatgcacaccgacattggttaaaaagatttggaaatttggaaaataaattacacatgtaattattttagtattttcttgtctaccctacaacagtatcctacgttgaatttcataccaattgacttatggccagctggtaacgtaaacttcttcatgcaagtcatgtcactacctccaatagtatctacaatgccttgataagttgcaaaacttgccgtttgatcttccgttaacaagttagaaagtcaaatttgatgattcgtgtctctttgctactactacatgccatcccctgacaataacacgtaggatcctcgagtgaacgacatcaaaatcagaatgacagatcatcaaatctccgtagtgagtgacaaatcatcaaattgagacgattttcacgttaagacgaaaactagaccaagatcattattgagcgatataatatggaacttttccgaatatgaaacaatatttttacgagaaatagtctcttcagtagttttgtcgttgtaatcaagccgtgaatatatattccgcattcattcgtcctgtaacttttgtgataactgggtataacttctttgaaacaaaagtcggaataagtttcattatctaagaaaaatatatcgctataacttctttaaaatagaggccaagataagtttcattatctaaaaagaaattattagaattttgcttcaattcaaatttgcatggttagcaaatgccacaagcaaaacgaggctatcaactgcgcaaatgccacctatacccaagataaaaactctcctccgcctcctcgcattcccaaagcccaaacgcccgcaggaagctgcacccagagcgcgtcggcgtcgcgcacacagggcggccagagcatggccacggcgccgcgcgcgaggcgcctggccgccgccgacgtgcagccggccacgccggcggtcggcccagcgtccggcgggcggccccagttcaacctctcgtcgggcgcggccaccgccgtggtattcgtctccatcgtcctctgcttcatcctgctctgcacctactgccgctgcgccaggcagcgcgccatcgccggcgcgcgcagccgcgtcatgcgcgagatccgggagcgcgtcccgggcgtcctcctcctccgccccgccgccgccgccgccgcgctgcccgtcctcccctactccgccgccgccgccgccgcgggcgccaagaaggggccgctcgtcgaggactgccccgtctgcctcgaggccttcgccggcgacgacggcgtcaaggtcgtccccgcgtgcggccacgtgttccacgccgcctgcatcgaccagtggctcgccgtgcggaactcctgccccgtctgccgctgcgccgtcgtctgctactacgccgaccgcgcgagggacacggcggtggtggtcgacgacgacgacgacgaccaggaggtcgtcctggagcgcgtggttgcgatgatcgaggcgatacgagaagaacagagggaagaggaggcggcggcgaggcgcgcgccggcgagcgatggcgggggaggcgaggggttgatgacgtcatgatgacgcacgcatccctgggttgtgcaggtgcagctaacttcactaggtgagttcggtttgtagctttggtgtggcacactgacattagagagatagaagggattaaaattaccccatgtttttgcagcatttttgtgctggtttgtgtaaattcgttttgaaatatatccaaatgctccttataatcaaaattctgcagcaagaacaacttggctctttgatcaagaaatggttgcgaggcatcttgttatttcatttctctaaaacacgccttgcacgttgttaattccagcatggtaggttaagaggcaaaattagagggaagcatcagaaaaagggatcaaatttaaaacttcgttgtaatcaagctgggggaatataatcaaccaccaactttagctggagaaattataagtccagctaagtattattcccaagtacatcatcattaggatttgtctatatatatgacacaaatatgcagttagagacagcaaacctgaaattgagaaagaagtctcctcctctggtggcaaaagggggcaagaatcattgccttcttccccacctgcccctccagattataatataatcaaattgtcaagttaattggatagagggtttggtggttgattggattactacatttccataacatcacaagtccagttataggatttgccaatttgtcatttgcaaaatattcaagatggtggacagtgacagctccaatggaagcaaacccaatttctgggctgccctctctccccctcgtggcagctggctctaggattggtggtcatcctccagggtatgtttacctgagcacctccgcagcggcttcgactccttggtactcctagtctcctggcagctgtggaaggaacggaactccaggattttcaactccgcgctcgctttgatcgcagtggttctggagtccatccgctcggagggccagctgtggtctttagccggcgttactttttttgggatttcttgggagtgtagcgtggctctgccccgtcccgctatttggagttgcgtttttaaccgtcgtagtagttcctagcttcaagttccccaccccctttaggcataagccagtctggctgattgctttgtgcaacaaaaactcttttcctgataatatattgacgtgcaattcttttgcgcgttcgcaaaaaaaaggaagcaaacccaatttgagccatcttatttcatctttcgtcacttacacgaccgattcatcttcagtttcatgtatttcctgtctccgtcaaaaatgatttgtgtattataaccaccatctgttaaacgtcaagcttttgcaagatcaatgctagaggctccactatttcattgcaaaatgtagcagtgggcaaagtatcaaggcttttatcatctgattattggcttatcagctgtagccaaaattcaaattttgaaacataattttagagtaagttttacccacaaattgtttcggttgcttaaatgagcctacctacagcctggaggctggagtttagcgtactaggcacgatgacacgacctaccaacaaaccaccgttccctaccttgctcgtcatgttgctgttcaatgttgatatgcaaaaggaggcaaaacatccatgtgcatttaaggtccatacaaccgttaaatgtcatcaaatgtatattgaaattgaggcagactttcagaattctaaccaacaaactcaatttgtgttcattactgctacatatttgcacgaatgacaaattcccacatcctttgtacttcaaatggatcaggcaccacatggtcagccgttgacaggagcaggaatgcacaatgccaagaagggccaggcgacaacgatcgccgtcacggccatcactgacaaaattgagaaatagtactagtactagcataataaaccaaagacaaaagacaatccttttctcccagcacggtcgatattttctgcaagcaaaccaggtgacatccagtccaggcaaatacagagcattcgattccttctgcagattgcgatgttctcaacatggcaacatccacaactgtcgttgtttggcatcacaaatgatgataacaataataaaaatcgtagtttgggctatacaatgattgaactgctttgtctaaaattaccatgagaggtagaattcttgcaggaactagatattatatgtaaacttcatgctatattcatgtaaaattcctgcgtttaaacaacggtttagaaaaaacccaggcgcacatgagactgattattcatgctctccaataacggatgaaccatgctttacttgagcacaagaacaagaaaattggtagcttttattcagtcgctatatccttggccaaaagatcagtaattgctggaacaaagaatcgagtgtgtatatatacgtgaaaaaaacaatagcctacaaagtgtagagggagatgaactatatgctacctacttcttacacataattcacccaaaaaaaagctacacttatcaacaattaggatattaggttggacctgcataaaggccagggtgattccagtggtcatatgaaccaataattttactctaacttacagtgattggtcaaaaatgagttatttcttaaccttgcagtgagaatctccactgttcaccaaggcctcagccaaatttacagtcctctactctttggggtagagcctttagtacagtcaggggacatcatttagttctgcacttgcttgcaattattcagcttcttgcaatttgtagccgccaaattgatttcattcttcctgaaaattacacaaccgtgttgttaaatggacagggtcacataatactgtcttgcagtactcacctatttgggtggataagtacagaattaacagtgtttcctgcatggacaagggatttccttaccaccagcattcatgatattgttgagctgattaatggtgtaaatctatggctacgaattatttgagaaaatctactagctttccaaggtcaacataataatatgggatgaatcactaaattatgggtccatatattcatagtgctatgctacaagagtaatttgtaggggtaacttcctcatgtacagacatacagttcatgaataagttgtaagccggcctgcaaatcctgataatgacttggctcattttaggtgatgcataatacatttttgcaaaattatgtttaaattgtatcaacactgtatcatgcacccacattgatgctatccttcaaatactgcatctgctgagatatgtttgatagcacaatataaggtacatgttaaatggtggaaaatattcatcagtcataaacttacattgaacattcatgttaatgctatctttccaaattgtaattgcacatattcagatttctgagaagtgagaagctacaaaatacatggagtacctgtactgtgagggccttaccattatggcacccaccgattccctatctcactaaaaccaccgcccctttttgcattcgctgttctgagctccattactaattcttcacgctgcgcctctacttctgcatactgcaagctcacgttgagtaaccgttcttgcatatctttcagctctgactctagttgtgatatcttggcatcatcattctctttgacatccttactagcagatttcccctctggcattggactgtagatgataaagaaaaagagaaaatgatcctttggaaggtcgcaatatcactaatcgggtcattgaaacattttggtgagatattatttagatatagaagaaaatctcacaggctctgcatcaaaagatgcacaaagccataatcttattaaatcaagtctgtgcatagcagattgaaaacaagattacaacaaacaagagtttctgtaaaagattgaagcagctctcagcttattacgaaatctccatctgttgttcttaagaatcaattaaaataattcattttggtgagctataagaatttgttactaggggtagaacaatacaggagtaattaggcattagaattagtcccccaaaaagatcttcacggattggat

SEQ ID NO: 58290 - DNA, 14578 bp, Oryza sativa
gaccgccggccggattttttttcttttttttttgagatgtgaatatgtgatgcatttttgtgtgagatgtgaatctgtgatgaattttttagaaccctgtgatgtaatttttttaagagtttgtgatgtgtttggagatgatttgtttgaggatttgaggatttggagatgttctgtgatatgtgatgatttggatatgggaggggatggtgtgaaatcaatattcaatattaaaaacagaaaaaaaaaagaaaaaatatctttagtcccggttggtgttgccccatatttagtagatcgatttttagtcccggttatttgaaccgggactaaagatagtgatctttagtcccggattcgtagtcccggttggaaaaccgggactacaggggggttacgaaccgggattaaaaagcacttctccaccagtgacagtatgcacgcatgttgtaaaggatgttccataggggatgtttggttgctagttacaatttatcacgtgcacgattagataagtttgataaacttgatagttgttcgtttgtagctgcagttgtaacaagatttttttcccaatactagcaaaatacccataattcactatgggtaaaagaaaatatattataatatatcatacacaaaatatattttttatcagatatgttagcatcacttgtttgcttatttaaatatatggtattcacttatttgaaacaaatattagagtattccataaaattaatgaatatcataagctaatttataaaaactatgaaagaagtggtgggttttggtagtggcaaattcaccgccgccaccactagtgccttaaaggataatagaaattgggtctcatacatcaataactcttcaagagtaaagtgtacaggcgatccttaaacttgtagaggtgtgtcatctagatccctaaactctcaaaatgcatatccaaatcctagaacttgtcatagtgtgtcatctaggtctcaaatcgccacaaccccttcagaatcctacgtggcgctggtgtggcatgccacatggacatgacgtggcataatgttgattgacaaatgggacccatttaacttttttcctttttcttttttcttctctttttttccctttcttcttctttctctgtgacccgagcagaagaaaggaaaaaaagaagaatgagaagaaaatgaaaaagaaaaagaaaaagaaaagaagaagaaaaaagaaaatgacacgtcatatccatgtggtataccacatcagtaccacttaggattctagaggggatatgccgatttgggacatagatgatacgctttgacaagttctaggacctagatatgcattttgagagtttagggacctatatgacacagccctataaatttaaggactgccaatgcactttactcctcaaaaaaagtacaacaagatttccttagatttgctatggtgtagtaaaaaatttgacagtctcaacttaaataaacgtggtaatttttattggtaagtggtggtgaagtgggtgagaaactatcttctgttcctcatttggaacggaggattcctagaaattttggaagaaataaactagttcatgtgaaaatcctataaattactgtatttcaaagaacccttaattgactgtagcggccaatgtagaaacacaaataatgatagatgaacccagacttatcaaatatataaagttgtagctttttatcaaatcgtatattattattgcaattagttaaaatattagttaaaattgtagcaaaattgatagttttgataaaataatcgtagattttttaaataaaccatatacgcatttgttcgaccgatgtaagactaaaacgacagaatgacgcaatatgtgaagcgtgagatggcagtatgacttggtcctgtatatatagtcattgacatcacacacacattacggtcatcctataattaatcggacgtgttggtcgtgtgtataatattttccttttgaaatttactctttaaaatatagaataatctaggttggcataagcccattaattaaacagtgtattttctgaacaatgtgatcgatgcgatgcacagtccagccagcgtgcacgagagcagtctagcacacgaaagcttctcaaacatattccttcagtgcggagagcgaagtcgaatccctcccgccagaatcaaagcacaaaccgaaagcaaaagaagagcacgacttttcccgccaaaaaaaaaagaagccaacgacgcggcctctctagtagagtagtagtctctacaaagcagagcatgcagtagtagccgtcatagcatcgatcgccagttcgccacagcacaatgccgacgaggaggcgagggatcgcggagggggggcacgccacccgggcggccgtggtccggtgcatcgtcgccgcgatactcgccgccatcgtcgtcgccggcctcgtcgcgctcgtgttctggctcgtcgtccgccccaagcccatcgagtacaccgtcaccagcgccgccgtgcgccacctcaacgtcacgccgcgcgaccgcggcccgggctgcagcgcccccaccgtcaacgccaccttctacctcaacgtcacgccgcgcgaccgccgcccgggctgcagcggccccaccgtcaacgccaccttctacctcgccctcgccatcgacaaccccaaccgccgcgtctccatgcgctacgaagacagcgtcgcgctccgcgtgctctacggcggctccgagctggagctcgccgccggctacgtcgtgccggggttccaccagccccaccgcaacgagacgacgctgccggtgcgcgccgtggcgcgctcggcgccgttcccggtcccggtcacggacctggtcgcctgggagctggagcacgacctcgccgccggcgagctgagcgtggacgttgaggtgaccacgggcgtccggttcatagtcggcggcgtcgcctccaggtactaccaagtcaatgtgacctgctcgccggtgaacatcggcttgtcgccgtcggcggcgcggtccttcaacagcgtgccgtgcgacgtcgagatctcgtgaggcaaccaaatgcatgcatgtttccgtgtccgaccaaagtgatcgtttagtttggattggatttgtttatattttacagcacacgatctactatacttttgatacgtactacctccgttccaggttataagactttctaatattatccacattcatatatatgttaatgaatctaggcatatatatgtgggtaatgctaaaaagtcttataatatgaaacggatgaagtatttgcgaggttgtaaatttagctctagttggagtggccttcttttcttcatcatctcttttaggggattatttatttatttattacgcgatatgccattatattgtgctgtgattttacatgtttgacacatataacctctatttttttttcatatatgacacaattgatttttttctcgaactttgatcaataatatttatttatttagttgcgtacgggttccaatactaacattgcctagagatgccatagcttttctttttaagattgcctaaagttagatagtcaaatttgataccacacttttgctagcaaactacaatcttttttttagacaatgaggtgcggatttaagacgttgaaaagaaaatattgtcataaatgtgacaataaatcaaacgtatggataacttagtcaaaactacgtaagttaagatacgtcaaagtgtaaccatataccacatgtaaattggaaaagggtatgactagatcttttatcgaaagtattttaaacatatttaatatgtttgtccatttgtacaaaaacttttagaaaaatacgaatagttaaataaattagaaaaattcaagtacattgtgtattaaaaaaaaggaggtggtatatatactgtcatgctcgtttgctgagagtggcgctcccatttgggagagttgatcctcctattcaatgccttatcccaaaaaatggcattttttacatatatttattcagatcaaactcatctccttttgtttttgcttctactatattgaaggtattgcgccttttttttttgtcaatttgttctggacttctagctagccattgtccttggtcagctgaccttacagctacatatattctttgagtgtggctttcatttcctaattcctcaagtgaacagaatatatagagtaatagctagtagctctttctaatcctttccactttattaccttattacctttgtctttttggtctttttcattgaacacagtgaccaccatgctagctagctcgtcagtgggggcaaaaacaagtagcctctcttcttcatccagaatgtcctgcaggtagccgttgattcagggagacatttgatgtaatgccactaactaattattaccacaataaattatcattgcttgagtatcgtaattaacttctactttggacatgtggacacagcaaaacgtacatagatactctgtctgctgaactacgtacacagatggaagcttctagtatgcgatcatgctaattaatcaactgatcactttgctttgtgtgaagaagggagagtccatcagattatgcaaactgatgaactgatgtaataatcttcctcgaccacatgatacatggtccgtttgacattttgcagctagcattgtgatgaatatcatctctgaatcttcaatgggttcttacgcacacggcactgatgcagagttaacataactagctagctagttccatcatgctggagagtgtgtcagcactaacgtttccttctctgaccggctttctttctttcttctctgtcaactaatttctctcttgcaagataggattatatcgcgccgtcagttcagatttcagaggtcagtctatcttccattatgcttccaagagactcgaatttctttctcgcaagttgaaaatgaaataaagggcgacaagttgtcctgaagttagaataatggtcacggcctatatgaagtctagtggtatatcggtgaagtctgaactctgaagactttcagaagctacaggtaatgatgcacatggagcctgaagatgttggaatgtggcctggatagatgatggcaatcgtaactttgtttggattacgcgatgtgtgggttgagatgacagtaaagtagtgcgatgcggtgtggtgcgtttcagtgcccattcgttcagtttgaaatgatgagatgaactgacgaccatagagaaacatgaaggcgttatgcttgctttcagtctccactatgcgtttttggcaaaaggagagtttttgattctatacaccgatacgttgttcaatgtgctaaattaatctttataattatgcatttgtggagcgaattcttctgaagtagtgaatgagacgactctcctctccacacattgtgcacatacctttggatgtttgcttgtattgctaatataaattctgggacattctcagatcagtgcagctttctgaggagcctgactcgctgacatagagatgggagtcctcagcggagtattctctctgtcaggggagttctcagatcagtgtcttgttcttgggaagaattcgcttctagcacaagccaatttgaaagtctttgatgtctcctaggtgccgctactttctatggttggtcgctctgaataggtgctggatggcagaccatcttcggagccacggcctgtcgcaccctgattgttgtgttctctatgatcaatgcgagaagactatcgatcatcttttggtcgcatgtgcagagtctcatcagctgtggtggattgctcttagagcgattgggcattcagactgcttgctgatcaatgaatcctcctttcacctgtggctttgcgacagccggagaaagatgatcaaggaactccatcaggggttcgataccattgcaaccttggtagcgtggacagtttggaagaaaataaacaatagagtctttaatcagcagagcagaacttgggcggaggttgtaagggccatggcaggcgaatcagaactctggcgtttggccaaagcagtaattcctccattgatagttccaacggatggagcggggtcgccaaatttatctagagaataggcttttgatctttggttttctttatgtactctacctccctgttgttttcttttttcggtctgctttgtacataaactttattccttcttaataaaatggcacgctccttacgtattccaaaaattaaattgctaatataaattcagtctacatttcacacggaacaaaatctgtcccttaattaaaagattgcctccatttcttcaggtcagatgatgcaatctttagatgtgattttaaagttcggtttgaatcaaaatctccatgatctctcctagtatatctacctacagctacttcctcaagagtcaagccacgaccagagatcgtgcatacgttgatagctatatctgacagggttgaatctaagaggatatagatatagatgaaggtcgaacaggtggagatggaggtgttatcgcaggattggccgattgggttactgatggatgtgacggcgagcacagcccggcccggccgggtcgccgtcgccggtcgtcacaggtggttcaattctcccctgtcgcctactctctccgtgtaaaaaaaaaaaaaagacaaaccccttccgtgttcaacatttgaccgtccctcttatttaaaaaaatataaaaaagtaaaaagacaagtcacgcataaagtattaatcatgttttatcatctaataataatgaaaatactaattataaaaaaactcatataagacggacagtcaaacgttggacacaaaaatttagggtttgtttttttttttttatagaatggagggagtacgaggcgaggctacggatgatgacgcagcgcgcgtggcgcagtgggagcgattgcggcggtcacccggtgcgccccaacgcccgacactcggcgcgtcgctgagatagtatgatcttggcgtgtcatcgccggggatctgccctacctagctcgctttgccgatatggcaagtgtgggatgtaactaataactacccaattgtttcctagctagcagaagttactggctaaatgcagataatgtttttgtgttttggttacttctagatgtaagatatttttgtctgataaagtagtacatgttctcttattttcactgtttgtcctaataaaatataaaacgtgttttttttacacagtgcagggagtaaataaagcacaacatatcgagttatttgattgtttttctggcccatccgtctccagaaaaaaaaatcccattttataagaaagacaactcgtccacgtatatataatccattaagtgataaaataaacctgacctctgcatcaactaaacatatattcaaaggaaaaagaaagggaagaaacataagataatatgaatgtatcacgccctgaaacaacgccttcaataaggatccaaagtttgttcgctgatattgttcgaacctaccagaacaattggtattgaatttttatctagtgacatatctagaataacggcttcaacaaataattgacaaacgcttacattgtcaaagctagatatataaaccagataagggattgatcacctcgaagattcttgccaatggatcacgatgcaacctaccgcaaaatactccctccatcctaaatatttaacgccgttgatttttttaaacatgtttgaccattcgtcttattcaaaaaatttaagtaattattaatttttttctatcatttgattaattgttatatatacttttatgtatacatatagttttacatatttcacaaaagtttttgaataagacgaatggtcaaacatatttaaaaaagttaatgacgtcaaacatttagagaagaaggaagtatatagcaattggtcacaacatatgcccatcgtcttctgcccaccaaaatataaccagagaaggaccacacttgtgatcagtcacaattgccaagccaccttgaaccatcctcgaccgatcttctcgatcgcaacgaatgtcatcccccgtgtgactaccttcgaatgattgtcattagcttatagtaggattggagttgagtcatccatctagagaggcaccatcccttcactaacctgtcacaattggatatatgcatgaggcatgtcgttaataactactcatccctttcatattataagtctgtcagagttatgaataccacatatcaaatagtagttgactaaatttcggcaggacccaccacatatcatatcttatatgaaaacaaccttcggatatagaaggagttccacataaggaaagataaatagagttctacatggaaacgacaaggattactcagattgtatccatattggtttccctagttctacttggaaaagggaacacatatgggtataaatacaagaccctctaggaggagagggggacggaacaatagatcaagacacgaaacaataaatcaacatacaagccaacatatgccaagacaagacgccggatatcgacttcagagataagcatggctagtcccctacggtgtctatggatattgataggagagacatagtgttgtctttgatcttgccggatgcggattcgaggaggaaggctaccctgttgtcgactacgagtcagcacttcagaccgccaagtcgacaacaattaaataggctaccccaaatattgtgctggcgtgattatgatgaataagagcaacgaccggcctcggccaacaggagtagggttattacctgacaattcaggggtccgaacctatataaaaatcctcatccccatattttttattacaatctcgcatatatcctagtaccaacgatccccatactatgcaaataccggaatcgcgacatcaaacgtcgacagtggcgcgccaggtagaaaaataacaacacttataacaccaaattagtctcattacatctaacattgaacatattttgacagttttcttattatgtgataaaaatattactatgtttttctataaatttagtcaaacctaatgaaatttgaacaatattgtagattgtttgaagtagggagcagatcatagcggctaggctaaaaaatgcctttctttcaacaaactagatccactaacgtcaagtaggtgtagaaaaaaaaaggccatatcacgaataatgcctgatgcatgttatttaaaacgggaatgctagaggacgggatatcatcccccaacggaatagctcttctccagaacgcgattcttatccatacactcactcgccgccgtcgccgtcccccgccgctgccgcgcccgtcccctgtcgccttcgcagccgctgccaccgccaccgccgctgtgcccgtcccccgtcgacgccgccaccgccgccgcgcccatcccccaccgccgcggcgtccgtcccccatcgacgccgccgctgccgccgtgcccatcccctatcgccgccgcacccgtcccccgctaccgccgccgtcgccgcgcccgtcctctgccgccgttgtcgccatcctcgtttgcagggggcgaccgcgcgtgtcggggtgctcctcccccaacgggatgcccagctatatccagtaggaatcacctgatacctggtaggtatcatccgttaccttgcaagtatcatgtgatacatggtagaaatcatctgatacctcgcgagtatcacgcgatacgtggtagaaatcgtctgataaatgacaggtatacctcgtgagtatcacgtgatacgtggttgaaatcatctgatacctaacaggtttcacatgatatcgagatcatcttgttgtgtagaatcgtctgatacctgataggtatcacacctgatacctactcgagatcaacccgttcgaaaacgggattccgttatatagcagccccctatttaaaaaggagagaattatgcacacaaatgtaaaacgaattgtgtttagagtcaacgggagtgattataacctttgctcattttcttttggctaagtagtaggacctgtaaaaagtactcgtaacaaaagctgtaacgcgtgtcacctagcgttgggtagaaagttgcaaacttgcaaatgcactgagacgttgtcgatgagcaaaggatccgaatattcgatcactgcgcgatatgtgtaaagagccaaagatcaaattaagagtagcacttcatagttcaggtaatggaatccaagtcctttcctaaagtttctcattgcaatttgaaaagcagaggagtggcaaatgcagtggtagtagtacatgccaaataaactggataaggcaatatcgccgaagtgaacaaacacaaacaaaactaactaccaaaaaaaatcaaaataaaaaaaacaaatgttaatattggaggagagagagaggggggaaaatactgcccaaaaatggggaagcgaaaacgaggagttcgcggctcatttgctaaaaaaagatgccaacatcctcaccgcctcctacgatttcctcgcctcggcgccccaattcaatcctcggctccgcctcgtctccgcattcgcagcttggcggccatgaatcgatgatccgcaccgcaccgcgccgccgcgcgcgcggaggagggcgatccgggcggccccgctttggggacggggggtgattcggtgtccgtttgggcgcgaataggtttggggaattgagagagggagggcgagatgtcgacggagctcgatcgtcgcggctcatcggatcggctccgcgagcgggtcaagttcaggttctccggcttccgcgccgttcaggtcaaatgtttttttctcttttcttttttttccgcattgagcagcgctgcattgttgagcgattcgtaggagatcagtctatccggggaatagcgatgaatgtacgaccctatgtcgtggtctgttgcgagattgagcattttactatcgataatggtcaattgttgtgtgaaatttactagaaaaaaatcaatgttgtgactggtgctaatgcgttgaacagttttattacaacacgcattgcttgtaagtaaaagaaatgtatatggaatactttccctccttagccatgctgttttgttttgattcggcaagagaatgcgacgatatttgttttagatgaaaggtcagtgtaatgatgatcgtggaaagttgggatggacctttaatctgattatgcatcatggggtgttctcaagaaaatatgtatcgcgaggttgtgggaggttaaattagtacgatgtgggaggcaagttactttatgagcattttttgcaggctccaaatatgtaaggtcatctttggtaagtggtgacaattcttttctcaaatatgatattcctaatgtaactatgatagtttgaatagaaaagggacatccaggtttcaacatttctgctaagttcatgtaactatttttctagtagcaatttcatcgagtgtgacttggtgtgcacaacaatgagtgtacttgagtaccggtgcaaaatggaagacatatgtttctttcccgatgacatttcttattcccgatttgtcagcaggttccagtagtatcagacaggctgatgctttcaatagttgcagtggacactggaaaaacaattgccaagtccactaaagccgctgcacttagtggagcctgtcaatggcctgattccatcctggaatcaatttggttttcccaagatcaagtgtctgaagaatttcaggagtgtcagtgcaggtttgttgtttccatggtatggctattgttcgcatgaacttgccttcccgatttgcatttatgcactgtactgttgttttactaataacaaatcttatgttatagggatcaacaaacagtggtatcctcggggaagttttcctaaatctgactaactatcttagttcattagaatctactgctatctctttgccactgaagagatgcgattctggaacaattctacaggtagattttagttaaccatacttgttttcttctagatatttctaattacatctttccccatatgattattttgttttattcctagtagtaacataatgccagctcatttggattttcccaaaagagaagtttttcacatgatcctctctttcagatatgctttttagtccatctaactgtaattcaaactaaaccatgtgaagttccctacagttgatagttctctaataaagctcctttcatgttctgtacttctgtttgttgacctagcatataagctatttggttgttggattttcaaaaatgggactgctattgggcagtcgtgtatgtgttgtacatacctgtgagttttcttcttttgtttctaacaagaaagttgcaatgcaaaacattttggcttttgagatgctcacttcatgtgctagctgactggtatgaaccacctattgttatatgagatgccacaagttctactgccatcggggtgctgggtttgagggactttctaatggcagcttatatactatatttcgtttcttgcttgaatcacccacccacaaccaaccccccaaaaggtggttgacaagtaattttccccatgtgtaccacttatgatgatctccaatgtttctcatgtgcagcttaacattcaatgtcttggagcaaagtctaaaacaaggtaactgaatctcttttatattcttttaggggatgttagtaatgccttttattactccagttgattcagcaaacatctgtatcttaggtctttagtggtcactaagttgatagccttaactgtcactatttcttgtttattgacagctcataaaacttgtttttctgtttcatcttggcattatatggcaatgtgaaataatggaatgaactatctcctcgttttgatgattgtagtcgaaccaatgatgatacagagtgcacatcagatggctttgacagcatgctgaataggactactcattctttgtcaggaaatgacttaggtggttcttatcaagatgaagctggaaatagggtataattcccttactcaaaactcattaatgccaattctttttaagcaatattatgttgggggacaactaaagcttacatgttttgtgtgagttagtccagatatactagaaactagaagagccacaaaatgtagtgataatgtttggatgagactctacatagcacagattgcaggagctcccggtgtggtgctcaacagcccgcatttgattctctccaaagtccaaactaagtctttatacaccaaatcaatacccttcttaaaaaagccatcgacactaagtccctccttaatgtcccactttttatacactgtttagatgccctaaaaatatattatttttttgcttgaacagtcatatccattgatgagcagcaggtttgaccaaaatagtttttttttataagctgaaaataagagctagtcttgttatagctaatatgctgctctttatctgtcccatcttcgaatgcggatagaaaggatctattacaaaatttgcatccataatcttcttacatcttacattttcaaagcacactttcattagacttagtgatagcttcgattgtcagctatcttgttattggatttcagtgcctgcctgccgctatgctttccatattatctttataatgtaactacttccgtatgttcaaaagagcctattgtgttttgtactcttctttcttacgtactatgtgtaaatggctaaatgtggactgcatacatgatttcaggatgcaagtttgtcagcatcaaggtcttattctggagatagtaccactgatagaacaaacatgcctcctagtgacaacttgaatgatgaattgaatacgcagaggcataattttgctagtccagatgccatccatgttagtgcagatcatgttgacgaggccagtagatcaaacaattcatcattcagttctcaaactccatctcgaaacatgctgcagggtaataatgcacaaccatctgcaagtgatctttctcagttatcatcaggggtatctcatgcatccaaagatgtccttgaaaatgctgaagagacaattgatgaactacgtggtgaggcaaaaatgtggcagaggaaaactcgcaaactcaaacaaggtctagagacattgaagaaagtaagtactgacaaatctaagcaacgttctgagcaagatctggaaaaaatgtggcagagaaaaactcgcaaactgaaacaaggtctagagacattgaagaaagaatgtgctgacaaatctaagcaacagtctgagctagagctggaactttctatttcaatttctgagcgagattccctaaggcaagaaattgaagaactgaaacgttctttggaagaggtaactgcacgccaaactatttcacgaagtcccagatctggggatgcgattgagctccagaaagaagtggaagatgatgtgcagtttctgaaagaatcgaatgcaagcttagcaacccaactgaataaggcccaagaggccaacatagagc

SEQ ID NO: 58291 - DNA, 8332 bp, Oryza sativa
ccgccgccggcggactgtacagaggcgtcgtcaaacgggcggcgcacatagtttccctggggcgtgcagacaccgaacgctccgacgacttgcacgctccatgcatcgccgggaaacctgtctctctctgacggctcacgagcaattcgcctgacaagtgaccacccctcatgctcaatgttctgcatcacaaactgacacggccaatacaacaattaatactggtgcttaagtttaaactgcttgcttgtgtccatcttgtattcattgtttgctggctaatttggccgatctcactttgtatatctccagtggttgagcacgtgagtcgtcaaacatccactacaggcggcaattttacagcaaggatgatcaaatcttcagattaataatctagcacctgctactgctttgtcccttgtgctgtgtcccatctctgcactctgcagcttcagatttggaccggttcattgatcccacattccaccactcgatccaaaacatctcacatactcacatgcctggatgctcaatcaaaggtagtagtatcatctgcatcttcaagtgcactgtgtgcagtggcagtccataaccaggacacgaactccatacatgcatgcacaaatgcactggatgcagaagaattgtagacattcagagttccggataaatggccgaaggatgattgatggaggcgtagacgactgtgagcggaacaagttgaggtctgtggtagttagaggtcttttgttccattttagatgacgtaattcatataaaataccgttataaattctaagtgttttctattcggtgtttcagttagatatcatcaggagggacataggggtttgtcccataaccttgagtattttatttatcttttcttgactcattggtcatgtacctgatggcagagaccagagatttaaatcattttcatgtctaaaaaaattagaaaatctgagaaggaacatctcttaatctcttatgcatgttcttacagagaactctagcaatctgaccatatccatcagccaaccaccatttgagccattatggttcatgtttgacatggttaatctccctctgattcttagagccttcccatcttaattgtaggcattgtaggtactgacgtagagtaatgcacccacgactctaatacttttggcaccgacgccatttaaggaaaaaaaaatcctagtttacacatataatcctaacacttggagctggtgatttcagtaggtgagtttgatcactgctgcctgatttctcttcatgggcctttccatcagcttagcccagtggctacattagattctcttcattgctaattcgttcctgtatgcagattgtataacagagaacatatagctcaatttctccaaataggaaatacaaaagaattatacacaagttagaacaatcagaacaaaccagcatctcgtggtcacccattatttcctcgatcacctcaccaagaatcttgtctgcactgttaggaacaagtgctgcaaaagcagctggttccaaccctgaacaacaagtagcagctcattaattttgacaacacatgatctgcaagcttccaaagttcatttatatgatcccagttaagtgtaataaatttcacagtttacataggacaatcgagttaccagtttctgggtaggaattgatgaacatcatcatctcttcaccagtcaggccagaaaatatacaaattcttggcattgactttgcaatctgccaattgaaaatgagtgttaaccgttaacaagtgctcaatatcctgatctaaggtcagagattaattgattggcatttggtatctgtaacatcagcacaatagtgatgtgtcagctgttagcagattaagactgaaaagaaacgtgaaaataatgagaatgaatgattcagaccttgacagcttctatactaggttgctcagtgtgcatggcatcccacaacgtttgctttgtcatttcttctgtacaatgaatcacctgaaacaaagccatatgagcatataactgacctttcagattatccatagattcatataagcatggttgcatttcgtcctttgaatgatgcacttgcacgctatgaattttctccctgaatttcatcttagatgattcttgccgatgagactaaagctgagtccccatattttatcccttcttctagcttctatttgctctcatcagaagtcagaagatacatttttgttcaagtttactacatgcgcaagaacaaataggaaaaactgttctatgttttgatgtcataaaaaccaatatcattacatgcgaatggcatcagacaactattttataccttgagaaattctccgtcaagctctctcaggaactcctgaacctgcacgaattatgcatttcaggtaagcttatcgaacattcagaacaacaagaagcacacacaccaaacatacaaatcaatgcaccatatgtctggtaatttcagacaaacaggaccgttctgttctgcgtgaacagttcattgactgcgtatttaccttgttggtttcgccttcctcgaatccgatgagcaacagcgcctgacgaacacaaccaattcagatggagatcagcacagaagcagcaaatagcaaggaagaggagccgcagctagcaactcaccggcggtccgtacatgggatcctcggcgttcagcggcacgaacttggagtcctcctcctcctccatgagttcgccggggacccctgcggcggacgtccatcagatcaacgcaaccaaaccaatcagctaaccgtggatgcatccgcaccttcgggaggcggcgacgatcggagcagccgccaccttctccccctcctccgctgcggcgccaagacgcaagcggaggcgcgcggagatcgagatcgagggagtaagatggtggcggaacggcggaggaggaggagtacgggggtggctgcggccatggccatcgtcgccggcgccggcggtgaggacgacgacgaggggagctatcctcctctgtgtggtctccgcttcgtcggcgttttcccgccaccaccacgcaatctcagccgtccgatcaccatcctgcgtctgagagtggaggaggcagagcctgcgagaaatcgcgcggttcgtgttgggcttcgcgccccgctcccaaatgggccgggcccgacccaatcgcttctggcccagtacggcccatcaagcggcgcattacacgcgggccaacgccttcgcctctccggtctccgaagcttttctcccccgcacgcgacgacctcgccgtcgccgtcgccgccgccaccaccgccatggggaggcgatccggggggaggaagctgccctttttcgcctcgaacgcctccacgtcgtcctccaccaagcggacccgctcggcgcgccgcctcccctcgctcaccaggccgcgcgcgtcgagctccccatccccggcgtcgccgtccccgccgccgccgtccgcgtcgcaccccgcccctccgtcccctcccctcgccgtatctcccgccggcgccggtaaggtcgggaagaagaaggccggggcgcgcctctggatgcggctcgaccggtggggcgtctccgaaaccctccatctcgacaagggctccatcatccgacgcgccggcctgccgccgcgggacctccggatcctcggccccgtcttctccgactcctccagcatcctcggtgagctcgaccacgcccccattagtatcgattgctgcttagggggtcgcttttgttgtgacaatacacaatgtttaattgtgcagctagagagaaggcgatggtgatcaacctagaattcatcagggcgatcgttacggccgatgagatccttctactggatcctctcacgatcgatgtgatcccttttgttgagcaattgacacatcatctccctctcaagaacctggtgtgtgggaatggtcaacctggtggtgatgaccatggggaaaagcatgatgactcgcatggagatcaggtgccccgccttaacgaggccaccggagcagagcacgagttgccatttgaattccaggtgctggagctcgcactcgagaccgtgtgctcatcattcgacgttaacgtgtctggtcttgaaaggcgcgccactccggtacttgaggaactgaccaagaatgtcagcacaaggaatctcgatcgtgtgcgaactctcaagagtgatcttacccgtttgcttgcccatgtgcagaaggtactattagagatagagtagtgcgtgcctttggtctggcaaagttcaaagttttcatccctgtttgactgtctttattattgcatattaatttgactgatcaaaagctatattcatagtatgttctagctgttcttttctgtggttaaagtttaattgcactaaggggcatggatgatccaaacaggccctaagacaataatatttcttctttggagctatgtggatataactgaacttaaaagcagtaccgaatatttgttcaaaagaatagtgtgcctgacatagccagtataattttaccatctcaaacttataatagttatggttcaccgtggaccaatcaccaactgaagtctgctgtgccgtggtcctgtgtgcacgggggaacaattgtttcatgtacatagagatgttgtagtgcatgtgttgaaagagccaaagtcttcaggtgtatatactttggattatcaaaatacatgtttatataattttagttcttactgtatggttggaacttggggcatataaaacaaaaggtggttataaacaactgattttttttttgttcgtgatgttctatgtacctacctattcatttctttttaaagcttgttgattttattttatatgcagtattgctgctgggtagtttggctgtacttttgagaaccttgatggttacctgcatgctgctctaaacaagggtttcttctgaagatatgtatcttaaccctcatatcatttcaggtcagagatgaaatagaacatcttctggatgataatgaagacatggcacatctgtatctaacaaggaagcaattacaaaaccagcaagttgaggctttaatatcatcggctgcttccaatagcattgttcctggaggaacaagtctgtccaggttgaacaatagttttcggcgcagcgtgagcatcgctacaagcatgcatttggataatgacgtggaagacctagaaatgttgcttgaggcttacttcatgcaattggatggaattcgcaacagaattttgtcggttagtccttttacccatattgaaatggggtagttgcagttttacttggatctacttaatgctatatgacttatcctagtgttcatttggacttattctctgctgacttatcataatgaatataactgtaagttcttgttggagataaattgtaaagatacacagccacgtcttgttcctaaacatatatttgagttagtattcaagttagcatagatgttgaattctttaactactagaagttgctaaacatatatttgagttagtattcaagtttgcaatagatgttgaattctttaactactactagactagaagtagaagttgctaaacatagatttgagttagcaatagatgttgaattctttaactactagaagcacatctctcttttctgatgaagaaacaaggaaagtatatcacttttctgtataattctttggcgcccttatgctatatcttggcgtgacataatttctcgtttgggaattaaacaggttcgagagtatattgatgatacagaagactatgtcaatattcaacttgacaaccagcgtaatgaacttattcagcttcagcttacactgactattgcatccttcggcatagctgtcaacaccttcatagctggggcttttgcgatgaacatccagagcaaattgtacagcattgatgatggtagcttcttttggccatttgttgggggcacctcatcgggctgcttcatgatctgcatcgtcttattatggtatgcccggtggaagaagttgctcggtccttgaacacaatgtaacaagtcacgactcatgagaactgtctcgctgtaaagggcatgcattttgacttgtaacgtctgcagaaaggagcagtcatttgaaacataaaagagaatcctaggattagggagaaactctaatgcatttatgtttcactggtaaataagatacattttctgtagttttcccttggtaaaaatatagtatactaacatgttatgatcatcagcacccttgaattgattgtggatttgtgggttataggggatccaatcatcctgaggcagcagtatgtcttctttgcagagagatagctgatgaatcactgaactttatggacaatactgaatagtatatcggtatgtcattaactcattatattccagttaaaccatatttagacaaatattggttatggccaattgaagctttcttccatggccctgtgtacatgaaggattgacggggttgtttggttctacaccattcttaacattaccaaataattggcattgctcaaatttgtcccttatttggcttggttaagtttggcactagcccagccctaaattttttgccttgccaaatcttgccaaataaaatggcaaggctaggaatggtagagaaccaaacaaacctgaaataacccagcgaaatttgttgagggaacccagacatttgtggagagtgacgtgcatttttgcttgagacgtctgtactctgtagaacgggagcatgcattttcacgtttgaagggtaaaagaaaaccgtagagactatagtgagagactctgatgttctacgtttcacgagcagtaaacaacacaaatccattatataatataaactcattttatcctgctccaatgcaatcctgtcaattcatgacacggtttttgcattagttctaaattcattcctgtgacacgattacgaaaatgacacgccaaaagaaacacatacttctgagaaacgatcaaaccaacaaacataaacaaatctctcaaaccccctgaagaaatattccaccaagacatcctaaattatttattttcccggtaatctgatcatgctagttggttattcagatttcatagtttcgctaccgagcgttggtacgcacgctgagcagcgcaggaaccagttaaccacgtgccgcaccaaactagcaacagatgcatcaactgaaaaggtgaacacaaaatgcatgcaatcacaacggcttcaccgtttcatgctgcccccaattttggttgacatctgtcataatcatgtaaacagcatgatgctgacaaaggctgagttcaacagatttttgcaatcatcatcttcacaggccacttttgattcatcattgaattcatggtggctggaaactattatcatgaaagcaacctgctgctcatagaaaaggttgtctcaaggtgacgcgataaaacagcattgtgatttctgaaggagttaacaaaataagggatgatgaactattatcacaagatgatccagagaatgtacaaccacctgatatcccatgagcgtgaaaaaaggggtgaaaaagaaaagctaagaataatctaatcttataccttgctatcagtacactagtcaccaagtttgaatctaaaaaggttttacaagaacaacgcagaagaaatcacgcaacagttaatcacaactgatgctctcttccttttccttttcttcctcttttttttctttttttttcttttttggtcttcttgcattcttaaattcggtgctgtttttaaaaagagcttcttagctatgtaggaactgagaatggagcaagggaatttgcagggagagtaacaccaccccctcgaagagaaactgaaggtcggctccagttagcagtggttatggcattcgaatcaaagaacaccacaacaactgttatatcatcatggaagtgccgccttaccccacgatcaattttcttcagatctgaatacctcatctccctcttttttgctgcctgctgcattgcagcctttactagtcttctagcaatcccctgatacgcaggaagttatagtagcattagtaagataagcaattaattgttatctgtaagatgaataaaagcccaaaaaaatagagaacaagatttcatttgatgaggctgggttgcactacatgatctggaactaataagtttagaaaaccatttaagatggatccgtagtgagcatcttgaggtggacagatatagtgtgtgaagttgcaaggaatatgaacaaattagc

SEQ ID NO: 58292 - DNA, 74809 bp, Oryza sativa
ttctggaaggcaaacaagaagatggttggagtgtagattcattctggccattctgcgatatgacctgctcattcatactaaagccatcagatgttttcacactctgagaacattctgtagtcaacaacgagctgactctgggagaatgcaaggtatcttccagttttgtgtttccaatgccttttacatctgttccattaagtgcaatggaagagtcacagcaattcactgctttgggaatgcaactcttggactgatggacatatgatgggagatgaggtgagacatgtgttgcttcaacaggtttatttggagcttctgtagcaatatgaggagcatctgtcttcaatgtgccagatccagggttctcagttttcatcagattatggagcttagtttttcctttacgcttatttctctttttgctgttacattggttcttgcagtcacccaacccaacagtttgctcctaaacatatggaggttatcactcatattcatgattaaactaacgcacacaaaaaggggggggggaattcggataataatgcttaccacctttggcgttggtgcaatttccttgcaaagattatcttcagatgcatgttcaatagtagtgcacacaacagatggaccctgttgatctggcaaaaccttaggatcatgactatctgagctactgcatccgatgtcctggaaagatgtccttaagtcagctaggtaactttgtcagtgaatcacatagatctgtgtctatatcaattgaagagcaagcaaagcatcaataccttcatttgcttagaagatgttattagctttttcaagctactggacttcttctttccttttcgagaaccaccgctgatcttttcaacatctttctttttggcagcctttggtgcttcatccccaatgagttcaagatttatactttccgttgacaccaccatgagaattcctcgtaatttcatgagtatatggtcagcaacagtaccagctgacattaatttagtgaaaaagattgcatcaccactacggttagaaatattgctcttcaagtacactatctcctgaaccagcatcagcctttgcaattctttcacgaaaatgggattcttcttacaagacagtgtgcttggaacatcaagacaacaaggtcgattccttctgaaaaaagactgccgtgtgctttcataataagtctctgcaacaaatgactctggttcacctaagcagaaactgaatttctcgctagaagcaatatatgttccttcaatgatctcattagcctgcaaacttaagctattagcatattaggtgtgcctaagccatagcaacttaaccaacttaactactaccaacttatgtgattttcttgccaaattataatcagtatgtaaaacaagcctgaacaccaatacaccacatcaaatggctaggtcagcaacaaagttcatatagtaacaataacaattgtttgattcattagttataacaagtctagtaagggcacatttgttgcaaaaaggaagattaattatcaatccacgtgtataatggaacagaataagtccaaaaggtttcaacttgttatgctatatctaggtgagaattgtgggtacatcaagtcatacaggccaaaagtaacctacttgtgttagcttggtagtaactataacataaaagcaatcctataaagacaaacaaaatatctgactcaacaaaacttcaaaatcatctttatcagaaacaaacaccaataagacgtcattatttgatatgatttttagagaccaacctttttggggaaaaaatgatagagttgagcaaaagagttattcttttcttctatgtacgtacagtacataacaacaagaattccgtatatcatttccaacgccagtaaagcataactaatgcttagtttgatcacccattctttagatgatagcaaaaccttgaaatctttccatggaaagattcacagattttcccttctattcaatagcccattaaatcttcttactgacttaaaatcaaacctacattgtaaaagttagcattaacagtttaacacaaaccaaatcatcacttctttctttcccatgattccatgaaaactagggagcacacgtttctacagagttgtggagcgcatattcagcttgttttccaacaactgattttagaatagcataactatgcatcagtatctttgcaaatgttactttgatcacatatttgctttatttccgcaccacctttctcacaatcgttccttttacacacaaaaaatggcaaagctaactacccaaaatacaagcatcgatgctttcgacttccatagaagatacaactgagaaatggaagcactgcagtatcctaaatccatgaatgcaaattatttcaaaatgcagtacaagtaagcatattaccagtgctgtagtgcccttcccaaagaatgctcccatgatccttgctctcaccctcggctccagcctcatccaccaatccacataccctttctccctccagaacgcatttgctgccaatccagctttctccttgacacccttcccaaccctcaccgccttcctccccccacctccacctccaccacctccccccgccgccgcccacgacatccgcagcgcgatctccacccaatttgccacgaactcctcgatcacgtagtaccccttggccttcagccagggcagctcggggaactcctcccccaccattgccaccaggtccacctccccgtcaccgcataggaacctcccacccgagatctcgtccatggccgcgacgaaaccgtcgaggtcgccgaggagttcctccgcgaccgtgatcgcgtcgaggcgcgacgacgacgtgggggaggaagggaagaggaggaggtggtcgaagacgagcccctgcccgcgggatgcctccgcggcgcgggcgaggaggccgcgggagagccgcgagaggacggtgggcgccgccgccccctcctcggccaccgccgcggaagaaggggaaggaggatgcagcacgaagaaggaggagtggccgcgagcgcggaggcggcggagcatggagaggagcgcggcggccgcggcgggggtgaggagggaggtcgcggccgcggcgcggcagggcggggagagggaggcgagccaccggaggatcgcggcgcgcggggaggaggaggagggagggggaggggtcgcggcgtggtagagggagaggtgcgcggtgagggcgtcggcgagctgccgcgcggtgcgcggcgaggcggaggcggaggcggaggccatggtggtcgcgtggtcggaagtggggaggtgtgcggcttcgcctccggtggggttggtcgggacctgggaattgggggaggagggaggagtatggccagtgtgggctgggcctgcgttagaggtggccaaatgggccgggccaaacgggccgcgcgcggcacggccggacctgtagcaggcacggcccggcacggcctgctacagtaacgggccgtgccggcacggcccgtttagccgtgccgtgcttgggccgctggccgagcacgcgggccggcacggcacggcccggctactgtagcgggccggcacggcacggcccggggcacggcccggcacggcacggcggcggcccgtcaggcgcggcaggcgggcggcggtccaatgggacggcgacacgtggcactaacggctatttgaccgttgaaatttgaaaataaccgttgggaggctaaaaaattcataaaaatttcaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggaggcgacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcattgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattctactctaacattgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttccttatacatttcctttcctttttttaaaaaaaaaaacactgtgcatgcactgtgggctggcggcctgccttcacgggccgccgtgccccgaacggcccgtgggccgcgggcgtgccgtgccggcacgggcacggcccggccatccacgggccgtgcttgggccggcggctcggcacgtgggccgacacggcacggcccgtttcatcagccgtgcctaacgggccgtgccgaaacgggccgtgccggacccgtgcccgtgccgtgccgggccgggccgcccgtttggccacctctagcctgcgtccgtagacgggggagagacatgtgaagctgtgtagctggcaggtggggccagtggggacgtgaggcaaaattcttttgcatttttcacctgttgttcgttattcctttttctagacttggattgatggttccaaatattttgcacttattttgtttttttactaggtgaaaccccgcgcattgctgcgggaatttcgtatgataacaaaaaaaaataacgtgtaagatagctagataatatcagattaagtaaattaatgtgatttatgataatttaaattcaaatagtatgtggaatggtgattcaaacgtaaaaggtaaggtggtatgattttatggaagaaaaaaaataggaagatagtttggaccgtagattaatcatctaaaggctacaaacaattgatgtgatatggcttaattagaggaaaaaaaggagaaagataatttggaccgtagattaatcatttaagcactaactaaataaggataaactatataagtatataggatatcataaaacataataaatatatacattgaaacattatgttaattatgttggacgataatttaacatgtttgtatttgaaaagctcttaaattataaaaactataaaaatatagcatgtttgcatgatgtttaaatgtgatgattgttagtggatgatgatgtggcattttgttaattagtggatgatgatgcggcatcttgttagtgaaagatgatgtgtcatctttacatgttaagcttaaggaattagtgggagataactttatagtaagataggattagaaacacggtacaaacatagacgcttattatagcgcacacacacttaccttacccttatgagcacctccggaagactggagcgatatatcttgagattgacgaagtcaccacgcgtaagtgcgagcatccatatcaaatctagaatttgaatccaagtggcctgggttcgtcaaaagaaacctaactagttgagttacgctcacttcgcttttgctttttgtttttttgttccttttctagaagattggtggttccaaattccaaatctagaattggcaccgtgaccgtccactaatctggtaacctagtccttgtgaacttctctcttatattaagatgggtgatcaactaattattagatgccagacttgagtaatttgtggctcaggccacgattttcattgtttgtggttcaggcttgaagagcgatcaaaaccaacgaagttgcaggtttgatagtgttgacaggttttggtacatttttggtagcacgaatgcacgatcaactaaccaatataaatttaacgccaacattaatcacatcaaaactgtgatcacagctcagatatgatccgttggacaaaatttgtcgttgcatgcaaaatatatcaggcaaaatttgtcgttgcatgcaaaatatatcagggacacaagcacaggaaaccaaacatgacagcgctatcattttgtccctgcatagttgatatattaaatgaagttgcattgacaataattgctgatgatgtaggagtactataaatgtgataaattgtcgaatttactaaggtcagattggaacatcaaaaaagtagtaattccatccaagccattaaaaagcacgcacaggattgcctgtgaaaggcacaccctttgtattctaccattgtacgagtccatcaccatgaattttcccggttaagaagtgattgcaagaaacctttttcagctaattacattttataattaaccaagagtaagttacatgtagtatgccaaaaaatccggccggcaaagtaaagttagtgtacaccaagaatcgaaaatatgaacatcttacagcatgttccattcctacaaaactagtgggatttaggcagggagagctgccggcgtggctgggggaacccggttctcgacagggatctccgtgaactcggagagaatcgccctgaactcgtcaccactcaatgtctccttctcaaggagcacctccacgatcttgtccatggcctcccggttgctcctgatctggctcaaagcgatctcgtaggcctcatcggacaaccgcttcacagcggtatcgatgtcctccgcgagcttctccgacatggagttccttgccatcatcctcatgatgacatcgccgctctgagctcctgagtccattagcgaccacggaccaatgtccgacataccgaatgtaaccaccatctgcagaagcattgtgaccccaggtgtaattagcaaaagaaagaaaggggaaggactaagaacagatgtttaatatatatgtaaatgctgtcagtttttctagcatgttattttgcagcaaatttatcctccagactggtttgtaagtcataaaaggtgcagaagcagaacagattacatagtctactgcttcaaagtttctgtagatcaattagcaaagttctagaatagaaatatagcgtacctgcttggctaggccagtaatttgctgcaagtcaccagcagctcctgtggtcacctcaggctccccaaaaatgatctcctcagcagcacgaccgccaaggccaccaacaattctggcgaacagttgttgcctggagatgagcgttgggtcgtccattggaatgaaccatgtgagaccacgagcttgacccctcgggatcaaagtaaccttttggacagggtcgtggccaggcgtcaaagttctacaaagaatacatttccagatatgaatagttgcacggaattttgatatgcaagtaataaacaaaagcacagttagcaaatatgcagattatctcttacccacaaattgcatgcccaacttcatggtaagcaacaagacttttgctcttcccatctgtcatcacagttccttccataccagccactattctgtcaattgaatcatcaatctcctttgaggaaattgctgtccgaccacgtcggcccgctaatatggctgcttcatttagaagatttgccaagtctgctccactaaagccaggtgttctcattgctatgacttcaagagagacatcagtatcgaacttcttgttgctaccgtgcaccttaagaatctctgtccttccgcgtacatcaggaacatcaacacttacctgtgcaacaagttaaaaggtatatccataatgttagcaaggttttggacatatgaggataacaaaattctaactttgagaacactcaaagataactcaagctcgaaaccaaaagcatccaaactgattgcgtgagtaagctacaaccaagaacgagtatttattggacttctagcctaaaaccacgtgagaacttcaataatacagaacaaaggtaaacgctatagctgaaacatttttacttaattgtgtcacaattgaatgagttaaaaactagaatacaacagatgttcacatccaaaagaatgttcagtggataaaaactaacctgtctgtcaaaacgtccaggtctgagtaaagcagaatccaggatatcagccctgttggtggcagcaataacaatgattccagtgttcccctcaaaaccatccgtggtcagtcagcaaatgattcagagtgtgctccctttcatcatttccaccaccaatacctgtccctctttgcctcccaacagcatcaatttcatcaacaaatactatgcaaggagcattctcctttgggcccaccccttcttgaagagatcacgaacccgggaggcaccaactccgacaaacatctccacaaactcagatcctgatatcgagaaaaacggcacaccagcttcccctgcaatagccttggcaagcaaagtcttaccagttccaggaggaccaacaagcagaacacccttagggatgcgagcaccaacagcggtgaacctttctggtttcttcaagaactcaaccacttccatgaagtcttgctttgcttcatcgacaccagcaacatcatcaaatgtaacaccagtgttgggttccatctgaaacttggccctagattgaccaaaaccaaggggaaagccaggaccgttaggtccaccaaggccaccttgtgctcttcttgacagcaaaaatagaccaccaataaggataagtgggaaagccaagtttccgatcaggttgaacagaagagaaccagagtcctcctggttgctgtgtgcagcaaaatcgatattcttttccctcaacttctggagaagctcctggcttagaccaggaagctgcacacgaactctctgcacacggttgccgagctcaggagaaatagcctctacaatggcaatcgtgccattctcaaacaaatcaaccttcttcactctgtccttgtctagatactcaaggaacctcgagtaagacattctcgacgacgagacaccttgctcttcagcaagagctctcttagcacccaacaaggtgggaagcccgaccccgaggttcccaagcgcgagctttaggaacttccttctggcatcattagtcttgtgctcgagggaggcagtcacagaaactggcctctgtgcaacgccactcgaaggaagtgtcgagaagggaagcggcgtctttgcagcaaggctcatggatgttggagccatcttcgctcactgttaaaagtaatgaaagggagatcttgtcaatcatacaagtgttgtatggcagaaattgcttcatccgatacttcaactaagctaatcacttcatatcaatccaacttagctgtaactaacaagctgtcctaccgtaagtattcaagaacaaaggtaaagcatctcttcacaatcacccctacaagtagaagctattgtaatcccttctcgaactacaaacagctacaaccatcatccccaaaccagtatgaaatccgaattcagtagctcaccgtagcttctacttgctgattaacctatcgattggaacgaacacgctaacgatctcagtcccaccatctttaccagtaaaaagctagaccagtactccaaattccgaaaagcatactggctaacaaacagaacatccgcatcgcatcagagaccaaacgccacacacttacacactggattcaagctagaaacagaaccagacgcacgcacccacgcacgcaagcgaaatcgtaaagggaagcactgaatccaaagcaaacgagcacgcacctgagtggatcggagcggggcgtggaggggagagggggggggggtgggccgaactaggaaggggagggaggagggagtggagtgtataaatagcccgacaccgacgaggagggtagcggcagattgatttttcctcctccgctcgcttggcctctctctctctctctccggtgcgcagttgcgtggggatttggggaggaagaggaggagagggggatgggggcgacgtggccgcctccgtgcccacagcgtcgataaggaagagatgagcccacttagacggaagccaaagcccatggagacgaagtgaaatatctctccgtcctggtgaaattggcaaatggctcgtattttttgcgtgccattttcgtagccagtggggttttcctccgatggcttgtagtgtcgtggctgctggactcacggctcacgcaagattggactgcttggaatcctggagatgtgaaggcgacacactggtcagagcatggcaatatgacatactaagttgctgccaacattagttattgggtaaacaaagccagagccgtccatttcccttgcacgacctgccgactgaatttttttcctcgtcgaatttacacatagtgtagaattttcttctatgatgatatactaatgattattctctatctgtaaggaatacgattacacaggcaaaactctgtagccaagatgcagaatggtaaagaattacaagcacatgtcaaactgtcaaccactcgtcggcaggatcagtttgctcaggatgtgggaaaacggtggagggatggatgcacacgatgttacagggcgtgaacaaaccaaggcaacctttgtgtttcactaatctgatgacgagatgcgccggatcttgcagaccagatgggcggtggggaggtcgagctggctgccgccgtcagacttgatgaggtcgcggacctggtctctcggggtggagatgcaggtgtggaaggtggcgaggaagggtgggatcggcatggacagcgccgagaggacgttgctcaggtactctatgtccgccgccagctgctgcgcgcctcggtcggtgatgtaatggatccctcgcagctgctccatgaacagcgcggtggcgccttccgcgacctggttcatcatggaaacagagatcagagacagttctagattaattcatcaaaagatttgggttcggtgtttatgttgtggtcagattattggggttttatgtaatgttgtattcagttgcaatgcatgtagttctaaatggtcaactcttctgtacggaatttgcgaaagtcgcagtgtgaagtatgaatggttttgtcgatggtatgttgcgaatgtacacagcatgatgaaaaaaaatgctttgaatatattaccttaaatatccattcagtagcaaagaactgagcctcctcgttgccagcctcaccgcctgagataccttctgcaagtggctccaactgctggggtaaagttaggagatactccccaacactggtcacatatgcctgcgggtaggcactgaagcttggaaggggaaggccacctggttcctccaccgatgaccaaattgggaggcgagcaacctcattgagacgctgtcggactttagatatgagcacgtcatagacgagttcatttactgtgtctgagaaggccgcaactctttgtgatgtcagaggtagagcatggaaccttggatcttttgactgtataacagaaatgttatctttaaattagccatgaagacaaacaaagagttacttgtgatacttgggaaattataggtcaaaaaataggttctatgccacatatgagtagcttaaaaaaatgcataatagaaaaggaaagctaaaaaagatctccgaatttcctataaaaccagataatctagcttaatactaccacctaagtttgcaatcaggctgttcaaacaaatcagagaaacatgtgataactctagtgttgtgacactagcaagataatttaaaaatatataacttgcctgttctagtacagtgaagagcttcttagacttgtctggtagatcggtgaggcgaatagctgcaatatcaagtgctgccctccctgtgataggcacttctgcattctcatcaccatttgctgcagttgatttatctaggctagaaccaaaaccagaaatagaaaagttggttccaatcctggcaagagtagcccttaaagaagcttcaaaaactgaggttctgctagttaggcaatcagcaactgtaagaatctgcaaagcaccctggacaatagaccattcttcctcttcagagacatcgaccaatcgttgtgcttcttttttctctagtcctgcttcctttttagaggaatcactatgtgcagtattatccaccccacatacaatcctaagggattttaaagtttcttgtaggtttgatatgtactgcagcataatgtcatctagagccaataccagttcatctgcctctgaaccaccagtaagactaatgcatctctcgacagctgcttcaagaagcactataatttgtgggatggattcctccattctacgaacagtttcactcagctctataccctgtgcacccacaccacgagcaatggccccacggatatctataccagccatctcagcagaaagtaaagcacgctccatttgcccatacctacatagcatgaaacaccactggctgagtactacagcaatagcaacaaaaaaaatctcaccaatgcagttaactgcatgcaacagaatttttcacaagttttttttttaccttgctttaaaagtctcatatggggaataaatagctttcaatgtattcagcagaactaaaagatctgactctgaaaataaatgttggatgttccgagcaaaagtgcccgtcatgttgtgcaggtcgatcagtgctccaagatgcttattctgcaatttggtactttttggcaagtcacctgataaaacatctagtatacctgggtacagaggacataaaatcaatttattgttacgaaagaagtacgcatatgtggcaaacaagtaatatccttttttaattgaacagagaaaaataaaacatgtaattcaatcatgaaattagtatagacatacaaaaatgaaataatacgagaagtttatgcattaccttttgcaacagatctagtttcaggaacagcatctccagttgctaggttgacacgagagacaaaacttgaattcaactcactcatggtttcaacaagtacttttgggactagtgatttgtattcttcagggaaagcagtcaggcaccttcagcattagcattgtagaacatccattaatttttggtggagcaaaaatattgtccgaatgcagctaaaagatgctgccaaaaactggcttctgtttacaagggcaaacattgctgattcagaacaaaagacaacagggtacaatgaacataccacttccattcttgttcaaggtaaagtagtgtctcatcatagaaatttggaagccagctagcaaatgagagactgtttatgctttctccaccatacttctccatctctacccgcttagctctctgttttagatcaaaatcttcccaaagtttctttagaggcttgacatggatcttagtatattgcacctccagtgacttgaatctgccaatacgtatcagtattccacgaagatcttgcacagcatcgaccttccaaccaaaatttgtaggctttagatgaaatagagatgcctgtactactgtttaacaaatataaatgagattagtaagaaaaaccttgcggttagaaagtgcatccaccaaacgaggttgaaccatgtcatctagccgttcttccaatacttcaagctgctttctcacattagcgaactccgcaacctgaaagcaacttttatataagcaaaacaaatagcttctgcatataaactcagtgtactgtgcatgtttgtgtgagagagtacaatacctcaccaactgccgacaagcaatgtctcatggttgccagggtttctgcagcttttggaagatcaccactagaaaatacatcctcaacactttggctcaactgagctagtccagccgcatcctggcattccgaccaacaagctgttaaatctattaaaagataacctaccactgtgagtgaagcatttacttcagtaacatgcaccatagtccacatacaacttacctgtaatgttgcatacgccgcttccattcgttgtttcacagtatcaattcgtgctagtgcagttattgactctgcagatgaaccctcagcctgattgaagaaatcatcatcatcagtaatacagaatttatgaaatgtagatgggactgaatacctagttagttgatcatacatgcatatgtatgtcatatttcattcattaacacccagtattcagcattggccgttacaaagaaggaatcactcagtacccaaaaaaaaaagttctagtgctagcaaattcattccagtgtattctacaaaatgtcaagctaaatgttatgagaagataacgctacacgtaacaagaagtacatgctacaggagaaaatgttttgcttgtgatttgatgtagcatcctgacctatcacctatatgaactaaatgatataagtgacggtatcccattataatagactataggcatagttttatgggcatcactgaactgctggatttgaatgtcctctacagcatactcaaagtttacatgcacataactgcattgcataagtacacagcattataacatcccgacacatgcaaggattttgccaacagagctccagcttggttttgccaagcccacgcaaattctgacttcagtttcagttaacagagatgatcaaattaacatatcatttgataaaagcgtacagcgataaaattgacatgactaaatacagttctagttgtacgcactgttcaatgcaaagcgtacaaggataaaattgacatgaccaaatacagtacgtgagatccagatccaagtgaaaaaacggggggtactaaaagcggccagaggctgaatcatacgcataaatgaatcaaactaaaacctattgtgccaaattggttcaacatttgctcattcgcaccaactattatcgcaagttcgtaatcctccaaaatgatctgggtttcgcgtgatacacgtacaattgtgcacgagtgaactgtgagatccagatccaactagcaggcgagcgggggcgcacctgggagagcgactggaggacggaggcgagatgggaccggagcgagacggcgtcgtcgcggaggcggagcgcgtcgcggcaggcgagcgggacgcggcggagcgcgtcggcgctgtcccgctcgagcgcggccgcggcgtcgtcggcggccgagcggaggcgctcctcggcgtcggcgaggaagcggtcgagcggctccgacgggtggcgcgcgtccagcgccgcgttgatccaccgcttcgggtcgaacccctccgccccgaactccgacgcgtccaccaccaccattttccgcctcccctcccactcgctgcgcctcctcctccgccgccgccgccgccgcggctcgccgtggacttgggcgagggagacgaggaggggtggctttgagttcgctggattgctactagtccttttgctaggtgggagagtcttccgtctccgcggctactcgtagctaacggccgccatgggagggatcacctcggtggagttcggagggggaaacgcctgccaaaatggcgtgttctcttgtgggagacggagtgtattttacagcggtttttcctccaaaatttatgtcttgttgtttccagccatcatgtttttattagtatcaaccaaaatataatttatatgtaaaacttttagatcagttctaattaacttaaaaataagcggctctatttaatgagcattttcggctgttgcttttgtgactgcaccatgatcgacacgaatagtgccgcactcactgtgcgtagctacaactgcaaccattgtagccggccagaagaacgctccctatagccttagttatggctgcaagcagcggcattacacccttaacaacaaaaaaatataagttaatacaaccatagccattagcagtgaacccgctaagaaaattaccgatggtccttatgctcatctaacttatgaagcaaccttctcatgtgttcgatttaacttagtaagggtgtcccacatggtataaatacataacttataactgtaaaaaaaaaatcaccagtattcaatgacctctgttgacccttactaggtactccctccattccatgaaaaaacgaatctagaataggatatgatattttatgtccaaattcatagtcttaagatgtgtcgcatccggtactaggttgttttttatgggatggaggggtacgccgctaacagccatgaattccgaataggaacatgctgaattcgggaaaaaaaaaaacaatcttggaagtggttaatattccgtagaaaataaatgtgatggaatatgattttagggtagagttttacatttctacttttatcagcttaaagaaaatgatgaaaatgacacctagaataatttaaaatgaagtttaaaaatttcaatttttaactgcaacctgtaaaccaaagagcaaatgatgagggtagaaatgaagatgcacttcagtttcagataaaatgaaaatgcatatcaattcagtattcggatacaaacaggtgccaagaaggtcgaaaatgtacattggggatgggttgtacaacagcagctatagaaccatagcgcaatcaataccagctgcaaactcaaacgaacttagatgaacacatatctcgactaggtcatagctttgaagatagtccacaacttcagagctcacatttcacaacagtggggcgccctagagactacacccgagtgccccactggtttattgtattattacctcaaatcagtcaacagtatctttaagcattacatgatcacacatatttacatacatgtatacaaagatgtacacatacaaaaacatttcgagccatgccccaccccgagggaaaaagaattgctgagcacacaaaactggctatctacatgaacatgattgatgagcaaaactagcctagggttagagcattattggaagctatacagatgccacggccacaacacgtgctagcgttggtaaactgccggatcagccgtccacaactccagtacaaagagaacacaagaacgtcttgtggaaacaactgaagcttcgtccgcatacaagcagttctccctcactcacttgttaccctggagtacgaaaagttgcttcagcaagatgggataaaatcagattacaagcacctagaaaacgagagtaactgaagtattacatgaacgggagatggcaactctgtggagatccaagattttccatgccttcagacttaattgggtccccaccagaattacatgatgacagcaagctcagctgcaatcaggtagagtcaaaatgtcaggacattgcactataacaaatcgaagtcaaatgcaagtgttgtgtagaacataaaatatgcccttattgacatagctaatgcatttcatatctgtagaaactatataccacgaaaccatgataataatatcctatttagttattcaggaaaaagaaaagttccgtataaagtttctatggctgttgtagccagcccaatcaggatcaaatcctgcaaagtaagtttgagaggacatggatgcggtcaacttgacactagatatccagaagaacacaggtggatgagagtaagcatgtggtaggcaactaatgcaatctgatcacagtaatcatgaaagtagccagtcaattgtttgttatttaaaacattattagctaccccaaacttcgaacacaaattcagctaacaagaaccctaaccacaataactagccaaaatggcaaaccttaacgctagtacagttcaaactctaaattactcataacatgtttagatagctacaagatgcataatatcagtggagaacaaatacaaaaacagaacaacttacatgtgccgcaaagttggggctagttaagttcatggacagatttctcatcagcagtagtacctgtcaatttgtcagatcaaccagtgttcattgcaagtgaaataaaatagttatgtgaagaaaaactagaagtaacaatggtacggttgtccataaaatagaagaacatgaattgatcgaaaccaatgcagtagaatggtgagacaacctatatatatattgatacaatgaattcctactgtgtttagcataaaatatacgaataacttctttcaaatgtggaaagttgcagcagatgattttttagttaagggtaagagctatgaatggaagagaatgcaaagtcttattttggccttactgaacaaagaaaggcttctaagaacaacaatagtgaagtgaaatgttagtatcactgaaacttttacagctgttctacaactggggccccataaatgcacatctgtctaacatttccgctacttcaaaattaagaatatctgtgttgggaaaaggatacgatataatcatagaacattcagaaactatatctcaaatctcaagaaacataccgtttcaacatcaattggatccatcgcctttaaagtctgcaaatgcccactagtatctggatcaaatatgcttcccagaaagctgtatacttgtgcaaaatctggcatagctgcatgtgtaaccagagaggaacaaaattataagaatatagtggaataaagcactgaagcctacctcaaggaatatttaacaatttaaatatgatataatatttcacaataagtaagtcaaggacttgttgcatgacaaaataacattttcaaatttcaatacacgtgaaactatacgtatgtgaatagtcaggcctcaaaggtagatgattacttgcaaccatgcaaacaacatgagaaacttagtttccattgactatagaagactagtctaaacccccccatcagggatcatcaattatgaaatgtgatgcctttgtggaaccaaatcattaactaagttccaacaccgttggtccaacatacaaactaagctgttgatcaacatgcatttgccaagataggtctgcaaaccgtatactaaataaaggaaactcaccacgtagtggtcgaagcatattttcttgttcaactgcttcagaagttggccaagtagtagaaggactctctatgctactagagcagttatttgtagcaacagcacctgtacctgccaaatttagttcgtcaatggcatttgttggatttttctcattaattttggacagaggtttatgagcatagtaggtaaacataccttgcgtgcgacttgcacttaaaggttgagcaatagaattgtcccaggagggtactacagcactggcatttgtatttctgatgacaggagatgtatccatggacataacacaaccttgctcccccagaggagggggttgtgatatagcagctggcgaaactgcacaagctaaataattccgattactacttcccaactagaaatagttgatggcaaaaaatattacaagactgaggctgctgagcagtacaaaccatttttagaggccttctgtggatatggatgagctgccttccgctttggcctgggtggaggcagatgttcacctgtaccatttttctgaaccttcaaaaagtatttttgtgcatggctccttatctgtcaaaagaacagctttttagattttgcagagagaaaccaaaatggtgtaggagcatttcattttaattggcacaaaaaaaacatcttttaaacttgtaggatactaatatgcattttgaacttccagaatatggtcatactcccaaccgttcagcatagggtagttgtgcctgctaatgagcacttactatatttcaagtttgcaaatgtaatttaacttcgcgctcgagaagtgtaatccaagttgatttgacttgaaactatatttgaactaggtgcatagattacagttgcacagaaatgcctgtttctttttaaaaaaagaaggaaagtgaaattccaaggcttcaagcatagcgcttcaattttcatatcaggcataagattctataagtcaataaaatgacaacaattaacagacagaatacaatggtgtgtttcaaataatatgtggcgtgcataaatttcaaatgatgtgtgacactgccaaccagatacatatagaacgcctcaaatcaaacatcaacacgccactccaaaggctagcagagaagaatgaaaacgttaacttgaaaggtagctatgaaccatacctgtatcacagtttttgagccaacgtatgcttcaatctttttccaatcacgatcgaacctaaatcaaacaaaagaaaaggaagcacatttaagaggtgtgtacacaacattgaccaccctaattacaattaatcaacaagaaaattttagcgatcaaataaattatacagaaaagtcaccctaacagccatgtgtatgatatgtagctagttaagttcgaaaagtttagcagtaaccagcaacattaagagatataagtcttataaaataaacaggcccacgttaattcaaattacaagttcaataagattaccactactgttgtatgttcccacactgtcaatatctgtcaatcctctaataataatgttagatctcaaaggttaatagtgataacaaaccagcacatccacattttagaactattttttctctgaattattccaagatgcaccctttaccgtgtccaatcctaccatgcagaaacaaccaacaagagacattaacagaaacctttctactgaaaacatctcgatccaacctatccccactactgtcatgttttcctttggttagcctatagagatcagcctagtgcaaaggaaaactggtctgaatgaatacccacactgtccagcgtttcaaataactggttacataatagtaatactaagatgcaagactgctggaagcctatggcacaaacttggtatgctcgagaaagctaacagttcaggtaacctattagaattcctgacaagtatgatattggaagttcaaagcttgcaacaactctggccaatctgcttcacataaaggactgtttcaggatgaaaactgttatctgtcgcctgctaacaaaaatcatcaagtgatcccttgcatttggatctatcgagcaaaacaaccacactatatgcttattaacaggtgggtattctaacatttgatatcattgcatattgctctttcccttatttataaccttttcaatttctgtacaggttgtaccacctatatccctttatttcttttttggtttagccctacatggcattttgtagcacattttaacttccattaatacaatgtttatcaggtagagcgacctctatcatcccacataaaaaaggaagcaatgaaatgcttgttttaaactaccatcagatgctaattgagttcaggaaaaataaatattgtaaccctaacatgcaggaaattctataaccactggtacatttagataataccaacagcactcttcccaacattaaacccagcaacttggttcacaaatccaaggatcagaatatcataaacctccctactcctacagctacaacgagattgtacttcctccgtccaaaaataaaccaacttttgtaaatgaatatagacatagcctatgtccatattcacatacaaaagttggttcattttcggacggagggagtagacatgaaagaagcacgcctgtcaagctactggcccctactgaacgcatggattctagcaccgtaattcagttaaaagatcaatcgaaaatcaaaacatcatagtctacccaaaatgtgagacctagaaggtagtgcctcccaaccacgactgctcagctcaacagattcgaccacccaattcgacccagcaggctaaacctatcctcaattgaatacctcctccaaaaaaagccgtctttcaaactacccagggttagcattcgcaggaggagcagatgcacaatcgcatccaaactccacaacgacacagacgccaccatacaagattaaaaaaaaaaagcagcacgaaagccgccaaactatccccaaccacggggggcgcgccgcgcgcgcgcagagataagagggagagcgagagacgggggcagaattgggggcactcacagctgcagcgcctcgaggaacttgtcgtgctcgggctccgtccagctctccctcgacttggtgatggtgtacggcttcctcaccttcctcgcctcctcccccaccgccgccgccggtgcaggcacggccatcggcggctgcagcggcgcagccaccacctgcttctccttctccttccctcctcctccccctcccccatccccacctcccccgccgcccgcgacggcggcggcggcggagacgacggaggcatcgatcggattgggcgtcgcgctcatcgaaaccatcagccggggtctctctcgcgcgcgcaggattcgccgcggccgcgagctagggtttgggtgcttgtgctgctggtgtgcgtgcgtgtcgatgcgggggacgaagcgaagagaaaataagaatgcgaaacgcgacgctgtgctgtgcgcgatgtggatgtttctttatacttcggggcgcttcgttgctggccacaagaggggggtgaggctgacgtggagggcccacgtgtcagtagagagaggggtggagttggttgggtttgggttgggttttgtgcaggtctggcacgtcccacgtagtgtcacacggaatgatttgtttgtgctgctgcggtggaacgtgtcctgtgtggtacagtgcaggttggttgactactctgtgtagcgttttttctcttccctcggaggcaggcctgggttgttcatgggccggccaaaacaaggccataattgggcctaaattttgggcccaaaactaaacaacatgcaagattggttgaagtctgagaagtttgtgagaaatgcggcgccatcgtttttgcttatcatgggaataagccaaatggcatatttgtaaacggaaaataatttgtgaatatttttttatatgtgtattcttagtgatctaaaagcaaaggctggaaaataaacttcgacaaaacaactccaaatttaagttgaaaattttatttttggctaataagtataagcataagcgaaaagataatgccgatgatttttctacgtgaccctcttttgtattgcttcaagtttgtgagattcttactatgaatgaatttatatatgaaataaaagttatttttatctatgatataaacaaaatgtctcgtctctaacaaaacaaatgtctcaattactttgatctaccatcggctcaacttttaaggatttctagcgttaacgttctctttgtttaaacttataatccaaagcaaaaaaataggtttttcgtttggcttttcaaagttataacttataagtcactcttacactattaagccacaaactaaattggagaagttttttttaatgtaaagtagatgtataacttcacccttaaacttaaaactttatccaccgacttatagatcattgaaaaaaagacttaaaagcctaaaaaaaaggccataagaaaatccaactaaaaataagcgagttaaagttatgtcaaacaaaacacgctatctctgtgtggagtagcactagtacagatagcttacaagttagtaatctgtaattcaccattattttctcttcaaactgtcaacaaaacacgcagcctctgttcaattcagaactactccgtataagctggtacaaaactgggtctcgattgcctgcgagtagtaactttttcctatttccagaagtttggcatatagtagaaagttgctgtcggtcacccgcaccgtcctctactcctctcaacgtcagatactaagattaggccccgtttacttcgcgaaatgaaaatttttgggtgtcacatcggatgtttgaccggatatcgaaagggattttcggacatgaataaaaaaactaatttcataactcacatggaaaccgtgagaagaatcttttgagcctaattaatccgtcattagcacatgtgggttactatagcacttatggctaatcatggaataattaggctcaaaagattcgtctcgcaatttttcccctaactgtgcaattagtttttgtttttatctatatatataatgcttcatgcatttgtttaaagattcaatgtgatttttttgggaaaaactttctagaaactacacagggcctcaggcatgtgcaccatcagaaacttttcttggttgttgcatgaacagtactactttgaacacagcggaatggcagaaagtttcagtggcactcctgttgttgctagacagtgccagaaagtttcaggcaaaattaagcctgaagcttcttctccccacacaaaatcaatgcggttgatagcacagctcgatcggtctgaaagcgttcatgtccactgatgactcagcgatttctgaatcacctgaaatcctgaatataccttatggtcagactgcacgtagcaacattttgctgtgagctcactgctgaaattgctgatgtaccgagtacgacagtagtagaagggaaggggcatggagacagaccggtagatgcaagtgggtgatgagcattgaagatcttcagaacagtgaaaggacaaaatacaccaaaatcgccgcccaaactcaaattatcttatttctgaattttttaaccgcaaaaaaaaaagaatctaattagtacagtactaagcagattttttttaaaaaaaagagagaaaaaggtgatggtgcttgtgcggtgagtgagataagcactgggaagaaaaatactgtgcctgcctgacgataactcaactccaaggaggcagtgatatttttggattttttaaatatattcatcagtttggtggtcgacccacggaaataggtcatagaaaaacagcaaaaaggcatctttttgaggggtttggttacaatttcttctcccaatttaaaaaccaaaagaaaagggaagaggaaagggaatgaaagatggcctttctctctccttcgctctcatcagctcgagccccgacagcaagtgtgagctactgaactcgagaccctcctgtcgcgcggcgcggcgcggcgagagtggccttttgatccgacgaagctagtaagttccctcgctcatccgatcatctcgtccgatctgtgagctgggttgctgattgatcgtagttgggctccatgagcatcagggtttggccgacctgagtgatgaggctttgcttgttttcctgggtcttgggtggcttcttgcttttgattgttttgattggattgattttttctttctagattgatatctcaatctgatagatatctcttgggttcaattttcactgatgagtaaagatccccaggtggtcgtgttctgagttaggactgggtaggaaaaaaaaagcccctttagatggattcatccaagatccgattagttgattggctaaatctgtttttggaatcagttggttacccaggtgaggttattggcaaaaaaaaagacggttactttggtccccaaatggtagggcatgtaaaagtttagcttatctgcgactaatctgctatgtggtgtgttcctttgtttctttattgtctggtcgatcagttcgattccttggaaagcactcattctgagtaccgttctaccaagtaccaacggatcacctcgattcgattaaaagcagtttatatttttcggattctaatatggagtaaaagaggttataggagttggaactttttagaggcagatcaattacactgaaagatacacactgatgattgtgttggagggaccctcctttggtttgcagttgtgaaaacacactgctgcttgcttcttatccagtccattatcggtagtcactttcataagccatttgctgattggaattggaatccgtgtccagaagatcctagtttttaggcattaattgtgatgagatgtaaggaattcaaacgtgatcgaaatatatccttacaggggttgttaagatctgtatacatttgctgtccaaaaattttaaaacataacggcatgtttccatcttagaacatgtgttgcagctcttaatatcaatcaggcaagaagtgcaatgtttttatcatcttgttggttgctacaagttgttttgaattttttcttatcatgcgaatgcatgttgctggactcctacaataattttctgctacttgttttctttgaagccttttatcagtctaagaccctgccaatgtccatttggagataggatgtcggaacagcaggatagtactagtaaaagctctagctcaagcatcagcagcagtacacaggagagcgaggaggaggtatctataacaataggtagcctcctcgcccaagcaaagaacaacagtgggcatagtcttggaaggcgcctctctcaattgggttcaatcccggtaatatacagtcatccatatttttctttgttccccccttggcatttgttcccttgaactcatcttgagctgtaccatgattaaatataggaattctctctcaattgtacataaatattccaatacagtactcaatataataactaatacgataattattacagtttttaactgcagattgttaaataaaaaaataaagttcttaatttacaatagtgtgccttcggctatgttttatgacaagttactaatgccctcatgtatggcagcacactcctcgagttaatggaaaaatccctaatcttgataatgcaactttggatcatgaaagattgtcggaaaggtaaaaaaaaaacagacctctctctctctctctagaacagtatggccattgcgctttcttatatttctcatttgtcctgatccttcttgacaggttgggaaattatggtttggccgagtttcaaatagagggtgatggaaattgtcaggtttgttttaccattgaacctaaatcatcatttcatttatagatacggtgccgcatcatctacactatttcagagtaacattttgaagcagctgttttttttttgtatttactgttttaaggctgctgccattatcttatactgaatagtgaataatagattggcctacattcttttgaagattaagtggcctgtgttgtttgatctttatagctgatactatgaggtgtttagtagaactacaccttcaccagtctgtacttaaacctgttcccttttcacttgatgccatattgttacagttccgagctttggcagaccagatatttcgcaaccccgattatcacaaacatgtgagaaagttagtcatgaaacaggtggatttcttgcctcaatcatgcactgtcatgaatatgcaactgtgctgaaacactatccctgtttttcagctaaaggaattcagaaaacagtatgaaagctatgtacctatggaatataaagtctacttgaagaaaatgaaaaggttataatccaccatccagagagtttttccattacttttggcctacttactcatacttcataaccatcaccttgcagatctggggaatggggggatcatctgactttacaagcagctgcagacagggtaatgttagctgttgtggtgttatgatggttgaatagtttgtgggaatacatctttttttaactgcaggtccccctttagacttttttttatgcagatatttctgattgtttttgaacgactgatctttctgattgttgaacttgttcatcgtttataccttaaatcctacttcaggacatcaaatgaaactgataaatgcatatatttatgattggcttattgctggctaacatccattataatgtccttaggaagacacctgcagtttacctgtttgataacatgtcattgtttcatactgtttggttgaaccatataaagaagaagtgaccagtcaggttttaatttgtattgatattcatatacccccatctgaactgtcattcaagatgaacgcatagtctgtcaccttggacatcctaccattatatatcatgtttctagatcatctaacacccttttatatctccaattgtacacagtttggtgccaaaatttgtttgctgacgtcattcagagacacctgcctaattgagatagtccccagggatgtgactcccacaaggggtgagaactgggatgctgtgttgctccgatcatcacatacttagttccatgcgacgctttttatctcaccgatggtatctgattctttcatgacccgcattttgtagagttgtggctaagcttctggtgtgaagtgcactacaattccttgtacgcaactgacggtgagtgtctttcttagactatatgaacatcgaattttcgcttatgattcttacatcattaaattctaacattccctaccatgatattttgcattgttagttctgaatgtgctcctgttatgtacaatgcagatctcctaacccgcaaaaccaagaagaagcattggttgttctagggcgtctcacctcgagcttccttgagcttctgctgctgcagttcttttcccttcaagttagcagcatctgtggtgcttactagttttactaccatggcaacccagccggcactgcaattccctaacctgaaagaagagcttatgtacagtttaactttcagtagtatgtttcgcaaggtacaaacctagaactgtgcaactttcagatccatgagtcccatgttctacccggcgagatgtagttttgtttttgcatagtatattgtgatctatccaggtgcttgctttgtaaaatcatcatgtgagctggctagattttttaccatatataagcttcagttgaattctcgaattccaaagatcgttttgctaaactgaagtctgaatttctcagtggtaaaaacaagcacagattcaacaccattggcaagcgttttgtgggatctctaaggtagtgtttggttggtgggatgggatgggatgggatgggacaaacccacttttagaggtgtttggttgaggggcgagtgggatgggttggtccctagagaggaatattcctcccagatccgggacaaatccatccggcaaaatcggccggacgagctcgtcccacttggatggagcacacggcgtctcctcggtgaccgccggcgctcgtccgcgcccgtgcccgccgcctcctccgtgaccgccggcgctccgccacgactgcctgccaccacctctgcgaccgccggcgctcctccacgaccccctgccttaacaccggtcgccgccgcgagcgagatgctcggcgccatcccgccgctcatcgtgatgctcgacgagagcggttgcggcagctgcggtgatgtcgacgcggcgggctcgagtggcggcgaagcttggaggtagggagggcggcggcggcggatccagagaagggggactcggcggcggcgaaacttggaggtagggagagcggcggcggcggatccggcgcaggggatctcccgatccagccgcggcgacgacggtgggccagcgggttgggtgctccggcggtggtggccgtcctgctgctgccgctgtgcttgatccggttgttccacgcgtggatgcaggtggcgcaggcgacggtcgttgacggtgatggcaaacggcgtccatcccatctcttcctcatcctttcaaccaaacaaaaaattggaattatcccatcctacaaaccaaacatgtgagtggaatcatcccaactccaaaatcagggatggtttcatcccatcccacttagtcccgaaaccaaacatatgctaagaaaatttttatcataagacacattttttttcgttgacattaatcagatcaaaattaaattactagttttctggcatttacgatagaacgctgcgaaatcacgtcactgccaacgggacaaatggggcgtgcgtgtccttgaatgttgcaatttgcaaatcaattttgacgcacttgataagcatatgtgtgagacgtgcacgcagcacgccgtaggtggcgcatgtggcatacgtgtttgcatgtccttttacatgtttaagaaacagtttcaacgtcattaatctacggaagcgtcctgtaggtggtcagaaataaaccgaaaaactataaggaataataattgaacattttttttcgtttatttagttttctttcttaagtgctcccttcgtttataattaatactataaaacacttaactttttttaacgaataagatgttaaatatttttaacgtagtttctttttaagtattgacttttaataatttttaataaattatttttattttctagtaaaccgttttgatttattacagaatatgagcaatcgatgatgatgacctaaattttagtcaagcctaaaatttaattaaagaaaaaaaattaaagtgtatagtactccacgctgtgttcggagtctagtgatgggagcgcgtgattaattaagtattagctatttttttaagcaaatttgattttttaagcaaatttgattagctattttaaaaaaatagattaatttgattttttaagcaactttcgtatagaaactttttgcaaaaaacgtatcgtttagtagtttgaaaagcgtgcgtgtggaaaacgagggagatgggctgggaacatagggatgcaaacacagcctatgaaatggaggagagagtactcaagggaaaaaaaaactagataaactcaggttgtagacttgtcgtacttcaccttggccgttcccaacttccatcttttacttccatccccttccctctgcactgcagcaacgcctgcgtggtttttctttgttttttccaacagaaattaatccggcttatatttttctcctgtgaataaaaaaaaaaccagaatctcgaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctgaggagattcttgcagtcgagggggggagggatggaggtgagcaaggaggagttcttgaggcagttcggtggcgactatggctacccgggcgcgcccaagggcgtcgacgagatgcgcgccgccgagttcaagcggcttgaaggtgcgcctaatctcgaccttgtcgattccctttttgccaaattctgggaggaaaaatggaattctattagtgttttgtgagaacaaaaggatggataggaacttgtggcgttcggtcagatgaccgcgtttcttgctgtaactcactgttgtatcgataaatctattaggtttgttgttgcggagagtgaagaatctagcatcctaccgaattttgctacataagcttcaacaattgtgcttgttttgatgtttggaactgcagtagtgtgagctgcaaactatgtaataagaattggctatagcttctatgaagcaaatccgggttgatttccattatatataaaaaaacaaatgtgcttgtatttgtagcaggtttctagatttttaattttctttctttcttgatcttgaggagcagggatggcttacctggaccatgccggtgcgacgctgtattcagaggcgcagatggcggatgtcttgaaagaccttgcatccaatgtatatgggaacccacgtatccttagactttgagacagtgttctggacacttcattgttgttaccttggtagaacattgcactgcagattcttggggatgtgttctttgacatgcttattagatagtcagagtgattcaagcatggctgcgagtgacctcgttactgctgcacgccatcaggtattgtgtgctagttttccagaacagttacttcgggagaatagtgaatttaggctgcctcatggcaatagtatttaagctctatcagtctatgccaatgctcagcattggcacattgcatgatgagtcatcctgcatccattttttttccattttacgccctagttattgctactttcttatctactactacgtacaatgatttgtgccccaggaagttgcatgaattgttttgattccaaggtactacaacagggtgcctgcacagctacatctttactatatccagttatgcgcatggtacaagttttgccatctgctaatttctttgtagtgatgttgacctgtttttcacaggttttaaaatacttcaatgcatctcccagagaatacaagtgcatatttacctctggggcaacagcagctctgaaacttgttggtgaatgttttccatggagtagagaaagctgttacatgtacacgatggagaatcacaatagtgtgcttgggataagagagtatcctaccacaaaacgtttctcagatcattataactctattatctgactagtcaaagcatacagaactatgcacatacatgcaaaactagtgggatatacagctggtttatgtacatagcttgatatcttgataccttcatcagtatgctcggtaatgtgttctgcattcaaacatgaggcaatgaatttctcctgggcagtttctcaaaattccatttattcctgtcagtctatgtgtaggatcatgaaattcacattggcacatagtatcttgtaaattttgtcttcccttagcaaatttctagatatgctctgagtaaaggagctactgtgttggccgttgatgttgaggagggtgctgatctggcaaaagacaatggaagttatagtttgtataagatttcaagacgcacaaaccaaagaagaagcaaagatgtgctttcacacaattgtcagaacggaagtctttcagatatttcaggtcagtcccttatgatttttatttttgtcctttacaattgctgaataacatattcttgatcaggttcaattattgatcaatattgtagaatttacacagagaatttgattgtcttatttccaatctgttaatgatgttttcagttttctctagctttcttttattctttatgagggagttaactgggaacacatttatcattcctggatttttccttaagaagtttgtttatttggtttattggtttgacatggtcatattgtatgaccatgcaatgtggaatgaacatggataactagaaatattgatagcaaaacttttggtttgctctcatttggaagattaattccagtgcgatgcttaatatttatgctcactccccattcatttcttctgtagggaacaattggaatatatttgcattcccgtcagaatgcaatttttcaggacaaaagttcagtctgagcttggttaagctcatcaaggaaggaaaaatcccattgcagcagcagtaagatgcattgaatttgtcttgcaggatcattgccttgttttccttggactctagtgtctttagcatgcttattaaatgcattaatataggggtaaatggatggttctgatagatgctgcaaaaggatgtgccactgaaccaccgaatttaactgtgtatcctgctgattttgttgtatgttccttctacaaggtaatccacatgcacctgttgtgttttgaaatgcttggtcctacagaagtcaccaattgatatcgatatctttggcaaacctgcagatatttggctatccaactggccttggtgctctaattgtaaaaaatggtatgcaactagcaattatcacttaacttagcatgatagttttttttttctttttacacatattataatctaagctacattggataggataagataaattaactaacaacagcaatctgtaaatcgttgccatcattattctttgcaagggaatgataacctttctaatgaccttttctatattttccattttatggcagaggctgctaatctgttgaacaagacatattttagtggaggtttgtggtcacagctcgttatacttggttttgagtaatctattttctatatcctggtttttaacttacctccggaattgttattaaattccaggaaccgtagctgcttcaattgctgacatcgactttgttcaaaaaagaaagaatatcgaacaggttctagaggatggaacaatctcgttcttgaacatagcttctctccgacatgggtttaagatcattgaaatgctcactacctctgcaattgaacggtacgtaagacagtttgggtcctagcaccctatccatgatgtatagtttacaccctgatgttcttttgtaggcatactacatcccttgctacttatgtgagaaacaaaatgctggacctgaagcacagtaatgagataaatgtttgcacaatatatggacaacagtattccaaggttccataactaagttatatctcattatatttctatcttcttattaagaattactgctgctttatttacttttcttccattggtttggattatttgtcatccatataagaacaagccattatgaataagatattctgaagtgcccacttgaattctgctagctctctgcacttatctattcttttctatgtattatgttttaggtggaaggtctgaaaatgggccctacaatcacattcaatttgaaaagagaagatggctcttggtttggataccgtgaggtggagaagcttgcttccttgtttggaatacatttgcgtgtaagagcacaaaaaatcatccttcccctttcctaagtctctgttttaacatctctattggggcatcttcatgtggtgaaattttacccacgcattacatgataaattagagctatgaaaatcaaggttctaaaatatgagaatccaattacgtttttatgaatgacaatatttctttatgagttccatccatagttaatgcaacagcagcacttgtagatttatgaacaagcagctacatgtgctgtgcaagtcctgtgacaggtgatggattatgcattgtggcgattagcttgtacagatcaatgtatatcttatctcaatcatatatctttccacacaagaaaactgatcataacttctgcccaatcaactccagagtattcaattgctcagtctaatttttttgcctctattgttttccagactggctgcttctgtaaccctggcgcttgtgctaagtatcttggactgtcccattcagatttagtttctaattttgaggtactacacaacacaacaataagcataccattataccttcagatgtttcacgtcttaataaagcgaatgcactgtatacatatcaggctgggcatgtttgctgggatgataatgacataataaatggaaagccaactggtgctgtcaggatatcatttgggtacatgtccacatttgaagatgcagaggtgcgaaattagtccattttatttgttaagggcatatataaatttccatgcaaacttaactttaagtagctatcagctatcgctaatctcacctttccccccgtagaaattcctgaagttcctgcagtcctcttttgtatccctaccagtacaattcaacaacgggtacatgttgaatctgaacagtcttaacttaataggtaattgccttataatatgaagccagtgatgtatttctttttttatgcatgtaccagtaacattaatatatttttgtaagttgcagataattcgagtcaaaaggctgtttcagatattcacttaaaatccataattatttatcctgtgaaatcatgccaaggatttagtgtaaagagttggccactaaccactggtggtatgcctaaattctgcacctttgacttgttctttcatttgtaacttattttggttaccttatatgcatagttcataagttattatgtgttttgttttaggcctaatgtatgatagagaatggcttctccaagggtcaggaggtgaaattttgacacagaaaaaggtaaattagcgattcctattttgtgtatctgttaagccttatgagttatgagggcgcgacatgtatgcatttatatggtgtttttatactgacactgcaaatctgcaacctttcttttatttattagatgtcttattcccttagtaaaacatttaatatatggtgaaggataatctgtttaaaattgtggagccaatgtgtcctcaggttttccctttaatgaattgactatattctacaggtgccagagttgggctcaatccgcacattgatagacctggaacttgggaaactcttcatagagtctcccacacgcagggataaattgcaactctctcttcttgagagtttggctgatctaagtgaagaagtagatgtatttggtcagaggtatgattggataattggatgcatgttgagcaaccttacgaatcacccatttgagtatttgattgatccaccatcttttgttcttcgcaaacttcctttggcactcattgtactttgatcacaaaaatgtaaaccatataaaagtggtgggtggattcctacaacattgggcattatatttggtttgcattttatttggtagtattactctagaatggtcattaatgatcgcttcctgcaaaatgctttaggtatgaggtgcaaagttacgatgatagggtaaacacatggttcagtgaagctattggacgtccttgtaccttggtgagatgctcaagctccaagtaccgttcctgcacatatactggcttgagagatcgtccatgtagagatactcaaagcaaacttaattttgttaatgaaggacaactactactaatatcagaagaaagcatctctgacctcaatagtcggctaaattcaggtatccaacctccttcattttccgctcttttcatttttaccgcaaaaggtcctctactcaatcatagaactaattgaactttatcattccttgttggctatgatccaacatagtcagtatgcaatgtatagctgcacattcttttcttgggataaccttgttatgggaacttattctgtagttacatattttgcaggcaaaggggactgtaagcaaaagttgcctgttgatgcaatgagattccgtcccaaccttgttatctctgggtcgagtccatacagtgaggataactggaaaaaacttcgtatcggagaggcctgttttacggtatacattttataacccttaagatcccattgctacaagaccataatttggcttttttgcaattgctgagttactcatttcattcattctggatggcttatgtgcagtccatgggaggatgcaatcgctgtcagatgatcaatctacaccaggactccgggcaggtgctcaaatcaaaggaaccattggccactttagcgtcatacagacgaaaaaaggtaagttggcatgcaaaattttcatcagtggccaacctgcagttgttcttcagtcatgtgatccacattttatacgtgaccagggcaagattttgttcggcatcctattaaactatgaagacattatggaaggggaaaatgagaccattgcagggagatggctccaagtggggcaacaagtgtacccttccacagaatgacttgatgatgaagtagctgtggacatatcacttgagtacatatatggaattgcaagttgcatcagcagcgaccttggtgatgatgaagtgatgattgttacgtatacaaaacacgtcggcatacaaagcattttcgtaattttccaatacgcataagatgaaacaagtttagttaggtgaaaacagaatataccttcacatgtatcacatatatactatagttctcaaaatgcttttatataacacacaaggggctctaagcctaagccctagctcaaacaaaacgaaatgattgtgaagaaaaatgtacagacggaaatggttcatatttcagagttctcatgattacggtttctgtgcacaggttatcagtcatattagcaatcttggtacactattgaatactatttgaaaaccaggtgtggtatcaggacttaagaattacgcaaatgattacatattaagtggatatgacagtatctattaacaaggagaggtgagggcatgttgcatacacgatgaaatgccttaactagaaggtcagattgctctatgctatacgacgccatttgaatttgatcccttgtacctgaaggggaaatggctctagaaactagaggacagctaagtaaaaacacttacattgtcaacctaaaggtctagaagtagaagcagttaagaaatcatagcaggtatagcccataccatatgtacagagcatcacgtctcgtaacaacagggagcaagcaaaagcacagtggcaggtatatgatgatgatgcaagagaaaacgcagtactgtaagttgtgtttcagtccactttgtgcaatgacatgctggtccacatttgagagtgcacaacttcagagttcgatgatacgatttcatccacgtttgaactcaaatatcgccacaacactctttcttcaggctcaaactctttcctcaagatagagaagccttccagggacaagtttcctgtgttgaaacatatgatttcacaattagtaccatgtatgacaggttctgtaaaagatgggtagacaaatttcctactccatccgtttcacaatgtaagactttctaacattgcccacatacatatagatgttaatgaatctaaacacatacatatgtctagattcattaacatctaaatgaatatggacaatgctagaaagtcttatattgtaaaacggaggaagtataagttaccttgtagggggcacctcctcgtcagacaaaacctttatcaacctttcctcaaagggtgtggaatgccagctgacatgttgatcctaacaacagtaaaccatcagaagttcagaacaagtggtgaatttacatataagcccagcttaagaaaatcactagatgagtcagtgataatacctctccatattttctacttgtgtttggaatacagtggcaatcccgagccttggacaacctcggagtatgattgtccacatccacattatcctcagaagtcataaaggcatgtccctcttcgataagattgttctcatcgtacatttggttcgtgtttcctgcgggtgaagatttaagccagcgtgatagactgcacacctcaatattttcatctgaattggactttgatctctctccagcatccaatagcctttggcggtcgagctgatacttagacacctcaagagggaaatgtgaagaattgagtgattctcctttaaccactgaatctgaagagatctgctgtgtcatcttggcagaatctgaaagttgcatcttctgaagcttgttctctgttggtctaaagatgggatatgcgaattgtttgcgggtccgcacacgctttccagacgatcctttatgtgaagtataaacagttctgggggtctgcatatcatctctcaatactagaggagtatgaaagggtgaatcactggaaccatcgttgatgcttttgatgttctggaagggggagttgcctcggatagctgattgataaactgatttaactagtggaagatgttcagtatcttcagtgttaagttgaggcgtcaagatatgatcctccccatattcaaagctgcatagtatgaaaatgaagcatcaattaaatatctcaccatgataatatattaaaaaacttcagacactaatggaaattagggcagttcttaccctccagatgatttagattcaaatgctggagttgcttccactgccagtacatttgtgggaattttatcatgctacatatcagaagtgaaggtatcagagaatgaatattgataaacaaaatattcagaaatgctcttctcacctcaatgtaactttccatattgatttgataggatatgttatggagttcagctggtgtttcaaatagtgtgccacataacttgaggaaatttgcctgtgtagagttaaaaagtgcaatgaaaaattcaacttcacagtaaagtactagtagactatatgtataaagagtatatctcaacagctcagtactcaacaatttaccatcttaaacaaggtctaaacaaaaagggtactggataagagcgtgacttcgagagcaaaaggaaaaactgcagaagataaaaaaatatgtagataacacatgtacaccaatataatcaaaacaggagtagcatcactgagctttccaatcctatatatgatggaaattctggacaaaatcttatgcccaaagcatataacataaacatattatctgcaaatgcaatgctcataagcccataaaaacatttactgaactacagtacaaaaaataaaactcttttttacaggacagatcttactacagttcatttaaaaactgattcaaccatacaccgtaactccaagaaattccacaaccatccgattattgttataacataattgtgaggtgatgtggcctagttatagaacataaggtggtggctgtcaagaccatgaatccaaatctccattctccttccaaaaacagtagtccttgtgatttctctctattttctcaccaatataaaagatatatccagccagcaatactgagtgtttaagaacatgtctactaggacatatacaaggaacgggttcccaggtcatataattgccggttaggacatatatagctcctaattcactgatcactactaggtgcacgaccaaacaaatatggataaacgttctgcagaatcttgcaacaaactctctaggtgctcactctagtactttacaatagaaattagcttagcacttttcatggaacttatgcaatagttgttactgccagtaaatcgagtgaaggcacggtataaagctaattctatcagccaaacagtagaaaaacacaacaagggatcaaaaacacttgagatctagtttctggtaagctgaaggttgcacatacacaatcagactgtcaacctcaaactagaacgcgacactgacaatagccatccgaagaagtacataatcagacaatagattacatcgcacttgattacggggaaaagaaaaatcattcgagcatacctcggatcgaagctcctcatcgctgccacaatcatcagccaaatcctcatgagatcctcccctccctcccaatcctaaacaatgccacaaacacacagatggggacaacgtacgcgcttacccccacacgaaaccacacaacgaaatcgatcgaatcagacctagctcatcgtcgtccgagagcagctccccgagccgatccttgtgcgcgagcgaatcctgcatcggaaacgccagagaacaatcaccacctcaatccaaatcccctcccaaaaccaaacgatccaacacgaggtcccgcaacgaagcgggagggatatgtgtacgggaggctagggtttaggggggttcccttacgcggcggccggagccggggctgtcgtcgcggtcgcggtcgcgggggtgggggccgaagaaggagaggaagaagccgacgaggacggcgtcgaggaactccaccaccgccctcgcgatcgccgccgcgcaccggcacatcgtcgtcgcgtcgcggcccttcccgccgacgaggagagaggcggaggggaggaggcgaggagaggggatatggtttgaaatgggaagcgaagctgcgaagaggagggaagcattattattattattttattatttttttattattttggggaagcgagaaggatagttgatgggccaggccttcgcgacttcagcccaactattaatagtttgggcctcttctgttttagtcagatttgtcaacgcaccgggccgtagaaaaaaatatgtttgggcttcagccttgctgctctctctgcttctttctcttttttttttctgggaacatatatgctgtttggactttccagcagattgtaaaaaacaaaaaaaaaaagatttctgggttccttttctgtaaatagaagatcaatatctaaggaaactatttaaaaaatattttctcgatttatgtctctgtacacgtacttacctcctgaatattcctactaaaacatacctcataccacatatatatattgacgaacccaaaacataaattaccgaggatcctatatatactaattattcaattatcgactgatattactaattaatatggtataatttagttagaactgaacaatctactcgtgaattcgtgatcctatgacctcgcggaaagttgcatgtcactatatatgtacccatgtgtatataataattgtagacaaagggattcgaccattaagctcgctccatcggcgcagttagtgtcgggccctccacagagtcgcgatctccaacagtagcagcttggattattggagatcgatcgatcgatcagatcaccgcgtctatggacacaacacctgcatccatctctccgcggtcgagaaagtttccaagaaatgacttttcgcctcaatgattcccaacaaaatcgtctcgatcgtctccgcgacaaaagcatggccgccggcgactaaacgcgaggctctatgcacagtgcacacacatgctttgttgttggcaccgccacattgacatttgtggcgatcgatttgatgctgattcctcccttccgctgcatttacatgtgtagcacgcggttttcacccatggataatatcgacacgctatgacgtttgtacgtacgctaactgcctgcactgtttgatttccaaagtgattttgccgctgtgtggtaattaattcgtgtacggctttgcgctgattcattgaatctctcacacactgatcaatcactcaaggtctctacaactcaaccaaaattaacccgtgtcaaaatcatcgagctgtactagagaaaaaaatatatatatttcacattcctagcgcgttgcaaataatatgaaattttcatcgatatattttgtgctattattaattaggagggacacatgatagagttcaccaaccgacggaaacggcatgtttttcatgaaatatcaggttttgagttggctcaggctgataattccgctcggtaatttttttaaaaaaaatcatagtaaatcttttctaaatttcacaaattgttttcaacctttttcatgaaaatcgagaatctactaataaggtgtgattctcgatctagtaacgactctctacacaaccctacaaaggaaatatatttagggttagacgtgcatttaggtacaccatacatatagagagtcgttttagcttactttttaattgaattgaaaattataccatatggtcagatctagtgaggccaagagaatgaagatcagttccaatcgctatcacaaattaaaggtagaaaagaattggagcttggatgaattctacgcagctaattaagcagctagagcgccatgaatgcgcacacagttgacggagcttgcagagaactttccaaaccggagaaagaatttttccaacttcgaaaaggtacatgcaaattagacaaccaacaaagcatgcaatagtagccgcgatccctttcacatgccatggaactgatgaaaattggaggaagaattcgacagcaaagttaattagcttcggctgtacgtctggttgacttgctcatagcttgtccactcaatcaaatgttcaaattgggtttgacatttctgtacttgattgatcagtcgttttgaccaaggaatagcaaatggtgtagctgtaggtttgaagaaataactggcccagaggtgaatagtctctgaaaggattaattggactgttgctgttgttcagggaaactgtcttaacaggccgttgaaaatgtagcaagctgcttagctgcaggtaattaatttgccgtacgccctggttagcactgtgtacacacatttcacacatggttaattagcaaataagtttacataatgatattaggagataaacccagaaaatgaatggtactaattaatttgaatgccaactttaatttctggaaaaacatttaaaaaaaaggcatctatcgagtcacttaaacacttctggtcattctctatagcaaaacgtactaaaaatatctctgaattccagacaaaaaaattacatctagatctatcagggttcacataaattgatctatatctatcaacacgtaatcctctatactacatgggaaatgaagcttgttgttgttgctgttgctactaccactataggatctaataggtaatcctgggaccaccaaaaaaaaatcctatcccaatgtatatttacatatgtgaaatatatttttgcaaaaagaaaaaaacactgtcttattaatatattatgatgcaatcaatttatatttctaaccttattatatttagggtattttaaaaaatatataagttggatcacccatataaaaattctagatacgccaactactattatgggagtgaacattatttgtttgctcacctaaaatagttgatttctctccatgtctagaataaatataagtcaaagttgaaaagttacattttggtttagaattggaaaaatcttacagatatgaaagaatatcgaaattgaatatatactagaaaaaaaactccaaagaaaattaatccaatcgatataccaataattaatttaatattacttctagtcaatgtagtgtgcatttctaaaataaaaaatagccgcgcctagtttttgtaacaaaccaagtaccaaaatattacacgagtgcaaaagcaccttattcacacgtacggcatatgtacacgtgtatcacacgatcgattgaaaaccgaatgtgattaatcaagcatcattttaagtttttaacgcatgcacgcacacggaaaatatgcacactgcatgcgtaatacggcgccgaataagcttaaacttaattggagtttagctaagcttaattggagtagtcatcgttcgtgcaagatgccggtacggcactacgacctttttggcttagctatagactatagtctctaggtagctagctgccacttttgccttttagaccctgcaattgcacgcttgcactattccctatagtttatccgtactcgtaaaataagtcgtttaaaataatatttaagttaaatcttaaaaatataaattataaataattctcaagttgttaagtttgaaaatgtaaaaattatatgaatagatttgtcttgaaaactattttttaaaagtatacatatatcactttttaataaatatttttataaaaataagaagttaaagttatgttttggagaccgtatcgctgtccaaaacgattttatttacgtgtacagagggaatacatttttcctttcgatttggcagctaggataaaagtcacacgggttggtgagatcaatttgacaaatatactgcaaatatattgccacacgtgcacgtgcaaatcgaaaagtttgtgagcaaaatataattaacccgatcaaatgcaagttacgtgtttgcacgagcaactagttaacttgatgattagatttagaatctagattagtctaatgagttcagtgcaagtgtgttactggtttctgttagtagattaatttaattagatggactagtaagggcattcacaatgtagatgaaaactagtctatagaaaataaaaaattccattcagctatcttaacacattgtgcaactagtctgtagcaaagaaataacaagcttcagctccggctgattttttttcctttagtgggacccaccttaattacacacattgtggtggtttctaaaactatggactcccatgtgtgggtaccacatctatggactagtttgccaaatacattggtgttgccctaattgaaagaggaaaaaggtagtacaagggcatatataaatatatgatgtctaatcatcggtggatcgatcgatcgcccgtcgaattgatcatgcagctcgagagaattgcggtacacgtttagactttggggacttgtagaaattaaagcgcatgacagccgaaaagctagcaaacagctagcggccattgtcacactaaaaccatgtgaggttaattaatttattagttatatgcactcctcgcatctcatcttataagtcgtttgatttttctattagtaaaattattttaaattcgatcaaaattttatagaaaatatagtattattttaaaaaacatattattaaaatataataatattagatttaataaaactaattaaatattttaggtgattctaaatttttctataaatttagataaacttaataaagttaacgaagggagtatagtacaagcatgacaagctaactagctagttagggcacgtatagtctacagactgccctgatactggttaagttatctgattaacatatttatataacattctacctactttctttgtcttaattggatagattaacttatctagtactattgttagtccattcacttacgtcttttgggcattgggtttatgatgtagctatatggattaattaatattagatctcttctgaaaggaattaatattaattctcatgtgaccatatggtcctgtttgaaaatatgacataatatatacatatatatagagatatatagagcagtggcggagctaggaaattttttaagcccgggcaaactcaaatatatctagtatttgttacaatatttttaactttaataatttcaaaataataaaaattcaatggtgtatttgccggcgagcccgggcggctgcccgtgtgcaacccgggcggtggctccgcccctgagagagagagagagatcaagagagcatttgctgagtattatctgtcacctattaattacccctggaagcacgctttagaatgtaatgctgaacttaatttataggatttttgtaataattagtattcagttcaattcccatatacccccccccaaaaaaaaatccactagacacgcacacgtttaaaaggggtgcacttagtaagtacttcatatggatatgggtaatgctagaaagccttaaaaaataaaacgggggagtatctttaatatgtggtgtgcatatatgtacgtggtttttaaaaaatgaaaataattaattacgatcaataattcttaaattaatggaccaacactcaagtggtacatattgaattgggagtgcaggtctttgaagcgattgtatatatcattttgatataataatcgtgtgaaatgtaaagctttcctttattaaaaaaaagggtacatatccgagtttagcctttttcagctcatgcatatatgcaactttgaaggggtatacgtcatacactacttatttggagaaactttaattttgcgacgtgtgatgagcgtgctaatttaagtttgcgtgcatttaggctcaggaaaggtggaacgttggaattgaagtctctccttttaattagctaggctaggggtgtgtatctatcaatcagaaaaatagatttgggtgaagtaaacgtaactcaactagttaggtttcttgtgacgtaaccaatccacttggatgctcgtatttacggctaactatttttttcagtggtaggcgatgtatcactcgataacgagacgtttgtagtgacttcgtcaatctctagatatgctgacccattattctttcagtactagacgacatacatgtcaacagcgagaccgagacgtccgtggtgacttcgttaatctcaagatatatcagcccagtctttcggaggtgctcataggggtagggtgcgagtgtatgtatttataggggtgagtgtgcgcgtgttatgggtgcctgcatttgtattgtgtttctaaataaaagaaatgaattaattaggatgcatgcattgtttttactctccgtcaactgcatgtaaataactcaaagaaaatattattttagagtggtctcaattagtagtaatctactatcagtataaacaattactcagtttttgatagttaaaaaattaagatacttagttctactactactactactatttgaggtacaaatattaatacatatgtactcctgttaatagagaccatatatactactactactatttgaggtacaaatattaatacatatatactcctgttaatagacaccatagtaaaatagctatgaaagagaatatggtacatatactggcagtgtcatgtcatatcatcactggcccgggcacacagtgatttaattgttttatttcagataatgaatgggacaaactattttctaattataatgtatatatgccatatctttttcgtggagggggatttaccacgtctcgagatatatgctttcatgtgtgtgactatgttcgtgtgtgtgtgtatatagaatgaagaatttgtcttagtgtagagaacacggcaggcatgcagtagcatatatagatgagccctaagtccatacgattttaagaggtcggcaccgtcttaaattagcatgagggcgacttaatagtataggcatctactagcttcaattcatctataaccaacctaatagctcattcatacaatagttacatactacactattaatatctggtccacttatcatacacatcgtgtgtcttgaaatccgtactacagctggctacaaatctgtagctcgctgctcttctctttccttatttatcttcttaaaatatatttgcagctagcttatagcctgctactgtacctgttctaatggagatatcaattaaaacatctagcttataattaagccttgacttacgattccctagctccttcatcctggctccctggaatatatattctcatggcattatttccgttgttccatatgcatgggctgccaagcctttgaatttttagtatagcaagatagctataacttaacctagctagcttaattttgattagctatagctaatctctatagggaaagaagaaaaacaaaaaggaggagaagaagagtactacacgtgcatatgtgtttctgcgtttttgccaaatgtacattttggtttagtcgcgcacgaatgcttttataagtaacgtaattactccctccatttcacaatgtaggtcattctatcatttctcacattcgtattgatatcaatgaatctagatatatatatatatctagattcattaacatcaatatgaatgtggaaaatgctagaatgatttacattgtgaaacggaggaagtactttttcaatagaaatgtattcaatagaaatgcatctgtcttctaacaaccaacgtctcggtcttgcttgcttttgagagtggtcctgctagctgatcatatagttttcttggaacagtttatagatttaaaagctgaataatctgatcttgcgtacgaatgctactacgtacatgcatgtgcatggaaattcaaactgtcattgctaacgcgacaagtgtacatgcaatatagtactacatgtcgaccatttcggcaacaaattcagtggcgaagcttctcacggcatgcgtggtttaatatattgtccatcgatcaacgtcgaatgtaaagggccaacaccaaacacgcatgatggctagcttccttttcgatcttttcctgattgttgtggggatagatgaattcttatataaattctctccgtctcaaaatataataagggattttggttgaatatgacacatctaggatcatgaatctattcacccaaaattttttatattttaggacgaagggagtatatgtgtatctaagtatgttatcatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgattttgaacttgtttttgttagattttgattctaggtatatagcatccatacatataattagttaggtatgtaatcatggattgtgaaataaagttaaatttgagttgtttggttgataggtataggtatgaatcgaattcttataactaggtatatactcacaatttgaaaattttgaaaaatttaagtgattttgtgcatttgaaaccatagtgcccgggcaccatggtgccccatatgagtaaataaaataaaataaaatatactcattttcctttgcagttttagtgcaattctctggaaagccacataacatgaagagtttatagtcaaatcagtgtgctaatatttctttttttatcgtaacggaaatattgtgttttgcaatgcttcaagtcaaacttagaatgatctttaaacgtaaacatgttttaattatttatatttttaaggcatgaaaataacctttgggccccttataatgggaaaatttaagtatttaacgttgcagttatttgtgtatgaaagtttattagaaaataaattaatccgctggtgaaagtatttttcttaaaaaaaattatatacatactccctctgttccatattattagtcattttgattatttaataaatttatttaggttgatcaagtttatagaaaatattggtattttcaacgcaaaacacaaatatattatcaaatacatatatattcaatctaaatttaacgagattaaattaacagtgttgttatttttttataaacttagttaaacctataaaagtcgaaaaaagaatcaaaataacttataatataatatgtaacgtagggagtagtttacaaatcaagtactcctgcaaattcaaacatcaaagctggatttgtcgcctttcgtctgcatgcttggaccatctgatttaatcggtgagtgctttgctatgcctgttcttttttttatcattccttgaacaccaaaggggccacatttattaattagctaatttgcttcctgataagtttaattactttgtacgtacttaattatgaaccatgttttggggaatatatatcaaaaaaatggaaggaattaatagtataaggtctcattcttttctccaacaagagttggatgaatattaagattttcatggcatgcttttcaaactgctaaattgtgcatttcgtacgaaaactttctatatgaaagttgctctaaaatattatattaatctatttttcaagtttgtaataattaaaactcaatcaatcatacgttaataccacctcgttttgcgtaaaaagcttaatcttcatcttcaggagaaaagaacaccacctaaataaataattgatctgtagttaaatatatacctcctcttcttcatgtgtatctttggttttatgaaacctctgatatagttctgaaatattttccttgagatggtaaagtatggaaattatattaatgttaatacttccatatacacaaacttcaccccttttcaaccttgctggcattcatgtatgatgcacgtacgagtgggtttgatcttgaaaattttctgaatagatattttttactgtcgtctctatatatgcctatatctattgttcttctggctcatttctttggtaagtttctacgcaatttccagcacacaggtaattaaagagatggagttagatgtatagtacgtattagatattccacattcaaaaaaaaatgttgaaaagacaatttcaagattttgatgtgtagagaacttccattaatattttttcttatgcatatgatatgtacaacgaaaatttctagatgaaaaactttaatttctggaggaaactttcttgcaacttaactatatatacaatttgatacatgtctttcatctggattaaaaatgtccaagcttctagctagctgaaattaatggtacacgggagagaatttcaaaagaccgtgtctacgtccctatccatgaccaagttaaagtgaactactgaggatgcatccatgaaattggattggttgggataggatcgatatgttgatagagagatgcatctttttgtcacctttttttatatttttccctttaatttgcacatccgatccctggacacaagaatgtgatccaaaagtccacaattcatttcccatacgtaccgaatgcttggcttttgctcgtcctttcattttccccgtgatgtcactgttgtaatcttgataggtaattgcaaactactaccttgacttagaaagcattttatcacgcaaggtacctatgccagtgtcagagcgcaccaagcatctcatcatcaagctgttgaggaggaggaggacccagaagatgatcaaggaggcgacaaggcgaaggacgaagtacaggaggaaggtgggaagcaagaaggcgttgtcaagagaggcaggcgtatccggatggagaatagaaaatacaaaggggccgaatgggccgtgtaacaatcgttgtaaggcccaactgaggctggtggcaaaggagaggttggagaggaagaaacgcaactatataccagctggcacaagcttgtaagaactcgatgaggaactcggcaaggtggcgatggcggcggcggctccgctcggttgagcgtgagaagtaatctacctatctagttcgagttccacatttctcgtgttcttcctggagtgccaagtcgctagggttcctaacaaaatttggtatcagagctcaagcgatcctaacctcttggttcgaccgtagaattaccgatcaaggattgagactggttcttcggagctacgtctcgcgaaaaggcaactcgccttgccttgattgggttggttgaattcggagcgattgcgagttctgagccggattcatggcgcccgatgagaagttggacctactgttgaggaaaatggaagagaatgaaaagaagagagtagcagcagaggagagatcacgagcggatctggcacaattgaagtcggcgatggaggcaaggttacctcaagtggagaagagggtggatgacatagcttcggtggtgagtacattgagccaaaaggtcgaacagcttgagggcgcgctgcagaaatttggggatgatgaccagaagccggaggaggtgaaggaagagcatctagcaactcctaaagggaaatcatcgtttcagattcaaggtatgagagatccagcccttaactctgcaactactttccaatttgattctgttcaagccactgctgctggtagtttgggaagcagtttacccccaatgacatgtcctcagtttagtggagacaacccgcagatgtggagagcaaattgtgaggtttattttgatgtatatggggtcctgccgagcaattgggtgaaggtggcaactctgaattttgttggcaacgcagcattttggttgcaatctgtgaggaatcagctcattgggataacttggcatgacttgtgtgaaagagtttgtgctaggtttactagagatcggcaacagtccttaattagacagtggtttcatgtgaagcagttgaccacagttgcagattatgtggagaggtttgatagtataatgcatcagctcaatgcttatgaaagtgctgccccaccagattatttcgtcactaagttcatagatggattgaaagatgaagtgcgaacagttgtattagtacaacggcctcaagacctggatactgcttgttctgttgctctgttgcaggaagaagctatggaaggtcagaaatctggatcatatcgaaaaagtgagcatgtcagtaactacatcaaaccatcttacagaaatcaaactcaaattggggtgacaactcctattctacaaaaggtgaccagcaacagtgggggagatgatagaagaacagcagagttggctagatcccgagatgataagttggcagccctcaaagcttatagaaagtccaagggactctgttttatatgtggagaaaggtggggtagagaccataaatgcgccaatgctgttcagttacatgtggtacaggaactgatggaggctatgaattcagaaggtggagaagaacttgaagaagagcctcctgaagaagttgaggaagtacaattgctagccatttctaaacaggctatttcaggcacagaatctagcaagtctatcagactcaggggttggatacagggaacagaggtactcatgttgatagattcagggagcactcattccttcattgaagagcaagtgggaaatagactgtctggggtggagttacttaaacaaccacttaaggtgcagatagcagatggtggtcaacttacttgtaccaggttcatacctgactgtacttggtggatgcagggacacagcttcaagagtaattttacactaattcctttgggaagttatgatattattttgggaatggattggttggtacagcatagtccaatgcacattaattggtgccaaaagtggatagaatttcagtataacaacagtctggtcagattgctaggactttcttccaaaccaactcagttcatggaaatatctggggaacaattgttgggaatggctaagaatggtgctattatgtacatggttcagttgacaagagtaccaccagagcagcaacaagacattcctggatctgtacaatccttgctccaggaacatcaggatgtatttgctgaaccaaaagggctacctcctagaagaacttgtgatcacaagatacccctgattgaaggtgctcagccagttaacttgagaccatacagatacaaccctgagcttaaaaatgaaatagagaaacaagttgctgaaatgctacagtcaggagtgatccagcatagccaaagtgcttggtcatcaccagcactgcttgtgagaaagaaggatggcacttggaggatgtgtgtcgactataggcatctaaacaatctgaccatcaaaagtaaataccctgtaccaatcatagaggaattacttgatgaattgtctggctccaagtggtttactaagttggatttgagggctgggtatcatcagattagaatggtacctggagaagaacacaaaacagcttttcaaacacattctggtcactttgagtacaaggtgatgtcctttggattaacgggagctccagccacatttcaaggagctatgaatcagactctatcttctgttcttagaaaatgtgctttggtcttctttgatgacatattagtctatagcccagacctgccatctcatttatctcatcttaaacaagtgttgcaattattgaggcaagatcattggcaagttaaattcagtaaatgctcatttgcacagcagcaggtgtcctatttaggacatgtcattggagttaatggggttgctactgaaccaaagaaaatacaggatgtgttgaattgggctactcctgtttctgttaaaaagctcagagggttcttgggactggcagggtattatcgaaagtttgtcaaaaattttggaattatcagtaaacccttaactcagctgttaaggaagggagtaccttttaaatggagtgcagaggcaaaagatgcattccaacgtcttaaacatgccttgacatcggcaccagtgcttgggttacctgatttttccaagattttttatgtggagactgatgctagtgaagcaggcataggagcagtgttgtcacaagaaggccaccctattgcgtatctaagcaaggctttggggccaagatctcggggtctgtcaacatatgagaaagaatgcatggctatactgttggcagtggaccactggagggcatatttgcagcatcaagagtttgtcatcatcaccgatcaccacagtctggttcacctagctgatcagcgtcttcacactctttggcaacagagggcttttaccaagctattggggctgcaatataagattatttatagaaagggaagcagtaatgctgtggcagatgccttatccaggaaggattgccctaatgacgctcaagtgttagctatctctgtgtgtacaccaaagtggatgcaggaaataaccaagggatatgagctggatccccattcgtctcagctactcattgaattgttagtggactctgctgccagggaacatttcacattgcaaagtggtctcattcgttataaggggcgcatctgggtgggtaataatgaggatttgcaagcaaaactgatttcagaattacataacaaccctatagggggtcattcagggtttcctgttacatataggaggattaaaaggttatttgcatggatgggtatgaaaaaacaagttaagaaacagctgcagcaatgtcaggtgtgtatacaggctaagccagaaagggttaaataccctggtttactccaacccctaccagtgcctgcaggtgcctggcagacaatttctatggactttattgaaggtcttccaaaatctgaaaggtacaattgtatttttgtggtagtggacaagttttccaaatatgctcactttgttcctttgacacatcccttcactgctgaatcagttgctaccgctttcatgaaaaacatttacaaattacatggtatgccaaaagtgattgtttcagatagagataaaatttttacaagtcaattttgggagtacttattcactaaatctggtactgaattacatatgagttcttcttatcatccccaaactgatgggcaaacagagagagtcaatcagtgcctagaattgtttctgagatgttttgttcattccacaccacataagtgggcagcctggttgcacttagcagaattctggtacaacaatgcttttcactcagctgttcagaaaactccttttgaagtcatttatggttatcaacctgctcattttggaatttctatggaggattgtgctgttccagatctgcaggagtggctcagggatcgaaaatttatgcaccaattgattcaacagcatttgcacagagcccagcaacaaatgaagttttatgcagacaaaaacagaactttcagggagtttcagcctggtgattgggtgtacttgaaacttcaaccttatgttcagacttcggtggcccgtagagctaatcacaagctatcgtttaagtactatggtccatttgaagtgcttcacaaagttggccaagttgcttataagttgttgctgcccagtgattgttatatccatcctgttgtccatgtttcccaactgcgagctgccactgggttcaagcctccagtacaacacagtttaccatccagtgctggagctatgcaatttccacttcaaatcttggatcacagaattgccaagaaaggtaatacaattgtaactcaaatattaacacattggtcaggttcttcggtggaggatgcaacctgggaggacaaggaggagctgaggagccgcttcccacacgcaccggcttgggggcaagccggttcccaaggaagggaggatgtcagagcgcaccaagcatctcatcatcaagctgttgaggaggaggaggacccagaagatgatcaaggaggcgacaaggcgaaggacgaagtacaggaggaaggtgggaagcaagaaggcgttgtcaagagaggcaggcgtatccggatggagaatagaaaatacaaaggggccgaatgggccgtgtaacaatcgttgtaaggcccaactgaggctggtggcgaaggagaggttggagaggaagaaacgcaactatataccagctggcacaagcttgtaagaactcgatgaggaactcggcaaggtggcgatggcggcggcggctccgctcggttgagcgtgagaagtaatctacctatctagttcgagttccacatttctcgtgttcttcctggagtgccaagtcgctagggttcctaacagccagccacagaattcttcttctgtaccctgaccaaacacgcatttatcaatttatcaccagcgacatgtgcatatccaagaggagaaattttgagcatctctttgaagatttcaaataaataattcacgcaatgtgatttaatctgttgccaaagtcgtcatatatatcaagctaagaaggaacttaaattctctggctatattaataaacggtcgagaaaattctttacctagcttgctatatagatacttccctagccatatctctcttcctaatttctaatgcaaggtacatataatatatgaagctatcaatttgaactcaatcactagctaacaagtgactagctaggaatggaatttttaaggaatatatataaatatgctcaagccgatctttaagttcatgctttcacatatgcttttgatcacatgctgccggtgctagctagttatatatactgtcgtcagacataagtcatgatattgagatatatattcatatatatgcagctaattaataagtcgatcgctgcatatccctttcccattttattggggaaaatccagagaagagagagttgaattgacctcaaatatataatttacttttgcatgaagtctacctttgtgaattcaaaccaatatatatacaattaacccgtacatatcaagttgaaaacgtacgtagacacactagtacattagtactagtatagtatatcttgaataattttgtcaaacacatactagccagacaaataagatggctaattaatgttcccgttgaacaatgtaataattcaaagaaatatcaatatctcattttcagtttgtcaaagagagaactattcacactagcaatagtcattgtatgcagacccagacaaacctatcaatgaacagtacatgtcgatcccaatgggaaatgcatgagctacttgaactcatacttcgctgtctcgtgaacagggacagcccccaaactcttcacaaaactggggttcctatacttattttaaaactttttttttcttatctgtgttcagtaaagtagcaagtgagcatgaatgtttgaccggacttggtcagaaaattcagccttctctctcgatctctctcctctccacacattcgatttggtacgtttctgcacggtaggcaacaaacaagtacttgaatatatatatacttcttgggggtgttctccttcttcttcttcatatatcatcatcaccatctttatctccctctctctctctccctctctgcatatatatagctacttcgatctctttgtagcaaccatcagttagctagctagcttgaggtagctagcgcttgtatttatcagaagcttagagataattttcagaagcttagagagctatcttagctacaaggaattaccggccaatcgacggcgagatcgatcgattgatcatgggagggtttgagaggagaggagttcggcagtacaaccggtccgaggtgccacggatgcggtggacggaggagatgcaccggcagttcgtcgaggccgtcgagtgcctcggcggccaggacggtgagtttgaaacaccaaccatggatatgcatgtttggtattgatcaattcaagctatatgagcagattgatcatgcaattgcttaattattgcatggacatggagttcgctttgatgatcaaattaattgggattttaatttgctaggtatagatcgagctatcatgtttttcaagggaactgattaaacgaagtgctttcttgttctttttgttttttggtttagaaagtttggtctccttaattattagttggtgtcggttaggcaggagtttgaaaacgaacacagcgtagcaggagtatagttaaagaaaaataaagacacgtgatattatatgtgcatatgcacgatgaacacccacggcccgttctcttttggattttctacggataattaagactgaattaagcatacaatttaataagagttaattagttagatggaatatcattagcacaataatttatcaattggagccactttcatcctcgactagctagatatatatctttttccaaaattaaattaatatatgttcttcttgacgattttttatttttagttttcatctgaaagtaatttagatcaagtactttagatatttttacactctttttctacctttaatcgtgcatatatttgtaccttgagtactaacagccattttcgtatgtactcagcctgaagtactgatcagttattatcatttgcaaactaaaatatttcaaaagtttcaagtactatctcatttgaacattaccgtaattaattattgtgtgctttatccagcacggtccggccatacgaagctgaacgtactatcgattttctctatccttgagggagacataatataatttttggtctcatgatacatgcatggaccatggaataacagtactgcatcatgatgatatttgtttgtagatcattcttcagaagtgctgataatttatctcctctcgcttttgtctgacagaagcaacaccgaagcgaattcttcagttgatgggcgtgaagggagttagcatctctcatatcaagagccatcttcaggtaattttgtagacccaggacttaccttttcagatttgtatgctaataatatacatgcatatgtatatatgcagcatatgctctttagatttgtatgctaatattagctagagatttgatccgtggctcaacctcttttttctctctcttaaataatggtcagatgtacagatcaggctctagcaacagcaatcatcctgtcagcctccagaagttgacatcagctactgttaacaacattagcaaacgtgagtttgtgaatagtgaagatcgctgcatttacgcgtcaggggatagaaacactgcatcttcagacaagaatacttacaccatactccgctgcggccgctcatcaatgtgagtgtgagagagagttaattagtcatttttcaattaatgttaattccaagtacatatgtgtgttatgaatttttcattttattcaatatattgatttttatacccacttgcaggccatcaatagaagaaatattcagaaactgggaacaaaccagagggcgtcttcttccatggaactccaacgtgattacaacagaacaggtgcctttcccctcactggaagctacgcctcaaataatatcacttaattgcatatatataatttgcattttcgttggacatctgtctgaatttttagcatgtatacatcttggtgtatatcctgtattccattcatgtagagagataggaaaaagctatggacaaatgcagacgtattttacttaaagaatccatcttccatatatgtagtattccctagaagtttttgttttggaaacatgcattaggtggcaggctgccaaactagcaaaccatactgccgtgtattgactgttcattcctgcttctgcatgcatggtcgaaaccatgaactatctagactatctctgaaacacttaattacaaatttaaaatccatatatacatttttcagcaagcttattaacactgaaacgtagattaattaacatatgtatatatctttgcaggcaacgactagagcaagtcgtcagactactaactacagtaagcctctgaagcagctgacagactgcgacctgacgctgtcgatcgggcagctgtgggacgacgccgccggcagcgacgccgacggctccagcacgatcagcgaggaggtcgccgcgccgtcgagggacgaagcgttcgtctcttcggccgatgaccacttcgccgccgccgccgcgaagaaggagagcaatatgctgaccactgatctgaacctggacctgaccatttcatcttcttggctgtcctgatcatatgatcattcagttgatgggcctgtgtatagctgcattatatttgtgcatatatgtagtagtatgtgtacaaaaataacgcggagagagagagcgtcaggctagtagtatttgcaggttacctgatgagatgatcttagagagtgtagtaatattctggagatttctttaggattattttcttatggtcagacacagcattttattaggtttttcagtagcgcatgcacgcgtttatctgtatagttttctttctattattaattgttcgttcgattagagaccggggacttcagacgaagacgggtgagaaattttgacagtttttgcttctcttgggtagacttctctgttgaatttctcacctttcatcatctgggcagttcccctatttctgatcgaattgtttgcgcaccactatctatactgattgagaactactccctcaattccaaaatataagggattttgatcggatatgacacatccgattcgtagtactaggatattttacatccagcaaaagtctcttatatttgggaacggagggagtaatggcgttacttgctagccattttacccttggctttcatagtgtcaatctggatttgtagctagctgctcttcgtcccaaaataaatcaacctcgtacggaatgtgacacatcctagtacgatgaatctggacatgtctcgtacgaagttggtttattttggtagagatagctatgtatcttggtattcgcaattttttttcctatagaacatgtcatcagttctcttctccagagtacttcctccgtttcacaatgtaagtcattctagcattttccacatttatattgatgttaataaatctaaacagatagatacatatgtctagattcattaacatcaatatgtatctatctgtctagattcattaacatcaatatgaatgtgggaaatgctagaatgacttatattgtgaaacgaagggagtactatatattgttctgcatgcagtatacttcaaacttcaccatatatctcaacgggacatttagtgcaaattatggatacagcaatcatcagttcagatccaaattttgaattcaaaagccggtcattatcgatgtttagggcaaaatggtcggaaacgatatcatttctctattaattttagattatggaatagtctcgatcgatacggtaatttttttccgtatttataaatttaactatttagtgatgacgacttcaatatgatgctgataaaaatataaaaaagaaaattttatatatagttagaaatgaaagtgatcggaaacaatattatttttaccgttcgatcgggaatttctataccattttcagcccaaactcccactgcgtacatcatatcatagtactactatgtttgtcatgggacatatagaactaaacactttgtctcttaattatatatatcatattacttcctctatttttttaatatatgacgctgttaatatttttatatatgtttgattattcgtattatttgaaaattttatgtaaatttaaaaacatgttagtcttttttaacatgttgaatgataaaacaatgcataaaaaaactaaaaacaaatgataattacatacttttgtaattaaataacagaaagttgaataaatggttttaaacagtttataggaaatgtttatgaaggacatttttttaaaataaatatagtatttggatgcttgggaagtgtactcgtgataatgggtcatctattagctaaaaaatatgtccttaaaaaaaatcttcgaggtggcttataataataataaaggccttttctactacggaatttgagaatttgccactcctaatttcaatcttgattttgcccttttcgatcagttgggagatttgaggatttaccacttctattgcaatctagagttttctatctatatgtgtctatgttatatagcatcaggaccatgcttaaggtgataagttgtgaagcgagtgtagctcttaacgcaagtacaaatctcaaattaacttcgtacgggtgctcatatttataacttttttttcaataataaataataaatccatcaacaacgagatgtatatgatggcttcatcaatctgaagatgtactgacccgatacggaagatgattatatagtactatgatatagtacgtgtatatgttgatagaaatgagtatgcacctaacatgcggatctgatcaacgcttgtgtctaaagtgtgtttggaaaaaaaaagaaagtattaaattttccattttttctgttgtgtcgacaaaatgcttatgcctccctattcgctggcaccatccatatgcttgacaattgacgcacgtcagcatacatcaatgggcagatgaaacggactgtaccagggtcagcccagaaaggccccccaaagcactatcaaacgggcctgatcgacactactgggctggcccgctacacggcccatttagccacctccagattccagttcgttcccgatccgtccacgcaacgcaaattcccacaaaagaaagcccagaagcagaaacaaatcgaacgctcatcttttttcgaagaaaaaagagaaaaaaaggaaaaaaaacctcgtcggcgatccgccgtgcgcctgccgccggcgggaggggaactccgccggagatgtcggttctcatagtgaccagcgtgggggacatcgaggtggacctccacaccgacatgtgccccctcaccaccaagaacttcctcaagctctgcaagtaagcttttagtttacccgcacctagggcttgttctatgtgtgaattttcgcgggatcatctggctactagaggtaacgagggtctcgtggcgggtgggttagccttcaggaagcagttgagcgggcaattttggcgttgtagagcgggtgctactgggtctggattcgatgtgaagggtgcgtgtagtgtagtgtgttggattgattgattacagttgaagctgctgccataccagtgtgtcgtgaatcattgtgaatgctcttgttcccatgttacttcgagtttcgattgcgtttaacttgttagtgtagtgctgttaagttgatagcatcttacaagtgctgttggtagcacttgtctgtggcgctcctcatatgacaatctgtattaaccatctctgtacatgtctcttggatattttcaacgttattcacccagtgtttgcatgatttttctttttgttgcaacatggcgacatgcttcatcagattttgctgtaggactttttttttcttgcaacggttttgatgcttctgcctgtcatgtatttgttgcggccgtagcccatagtaggaaattgtggcatttgtagtggaaaattgtttcagcggagtggacaaataaactggagcagacaattgtttcagctagaacatgccattgttgcgattgtagcgagaaatcgtttcagctgcaacaaggaaattgcttcaattcttcttttggaattgttgctacgtgagtagaatatcattgctagctaagccaccaatatttatatctaatcgttgatttgatttgtgagggatgttgatattgtggtagacattttattttctttatgattagtgataaatgaaagcagctgtggtacaatttagaagagccagaagttgacttccgaagcaaaagattacggcctccgtggagtccatgaattggttgatttaatggttgcttatatagtagcgaggatcacttatttcagaaacgtctgacaatagctctcggattgaacatccgagcactagttgttatcattagtatttggttctagggatgaggtgggatgaaacaggatggttctacatttttgggatgaggtggaatagaattgtttcgtttagttgtttggttgagaatgggatgattcaatattttgtttggtttaagcgagatgggatggaatggtccaatccagagtttggtttggagaatagaattagattttctttttagaaaatgggataaacccggcctctacatccaactggatttacgcagccaagaataagataggattgactcaggtaacctgcaccttagactggtgagaataaacctttttttttaaatttcccttatttccttttccccttcttaatttttctctctcccttatcatctgtaggaatgagctttcctggctacagcttcttccttgtcttcctctctcttcattattttgttcacatccaaaactatttgttctccagattcctgagtggtgctatggctagtgagtggaggaagcggagtggatgacgccactttgctgcacaagccggcgactctcatgagcgcgtcaaggcagtgatccactagcggcatcaatggtcgagtgcaagaaaccttttaacctcatggaggtggtagcccactgcttctcagcttgaggagagtggtggctgctcgcagtctcgcagatgggcggtgaacaaatccagcgagaagctctcccccgcactgctgaacattcttgcatgagttcatctgggcaaaagagtggtatcatctcatcctgaatcttgttggaatattcgtcaaaatgaaactacctcgtcctgaaatgtttcgtcccatcccaagaacagaacacatgggctcatcccaggaccataaccattcgttctatcccacttgatctcaggaaccaaacacatagaggattgttctttgattcttagtgtcgttgtctgaactaaaattatgtaaatatgtttgtctacttatcttgcaaaagttaaatactgcaaaatagcaggctatgaaatatgactgagttgactacttatggcaattggagtaatcattctctcgctgttcctatgattttacttaccaggatgaagtattataacgggtgcctgttccacaagatagagaaggatttcttggcacaaactggggactcaactggaacaggagctggaggcgactctgtatacaagtaatcaattaatatagcgcaataggagcctctccttctgtttcctgtaaaaaaataatcaattgctcagatgtctcactgccaccgattgtcaaatacatgcctgaaaacggattcattttttttcctgtagattcctttatggtgaccaagcacgattttttgatgatgagatccatccggagcttaggcattctaaaatgggaactattgctatggcaagtgctggtgaaaattgcaacgcctcgcaggtgtgatacttagtccctaaacttcctaccgaacccaaatgttttgattaccagtaattagtccattttgatgtcctcactgctgtttttagcctttcgtttatgtttgtgtgacttattagttctacatcaccttgcgggatggcgtggactacctcgatgataaacacactgtgagtagcaccttactattattacattgacttagagattttttttcttgaaaaaccctactttatctgcagtgactcacaagtatatcttcatcaattgtaggtgtttggcatggttgctgaaggctttgacacgattacaaagattaatgaaacatatgttgatgataaagggagaccatttaaggatatcaggtaaaatacctttgaaaagtactaaactgcatagttagaacatgcttgccaatatttacttactttctggtctttctgttgtttctgctttatttccattgctgaccttctgcaaaatacttaatgaacaggattagacatacatatgtcttggatgacccttttgatgatcctcctcagctcagtaaacttattcctgagaattctcctgtagggaaaccacaggatgaggtaatatgagttctgctattgtgctcatgttggaaagacaataatcaaaattgactaatcagaatcacaggctgtcttacatttgtttaattcgttttaccttccacattgttgaaaactttataacaatttatttgggcacatacctgtttaagagtatgtatggattttagttgaggcagccactgggtgtacatgtaatttattttccctgttctgtctgtaccaaattatgctaaaagttcctatgcaatgtcctgctaatgtactatgttatatattttcttttcaccgtcaatgtacagattgcagaagagcgcttagaggataactgggtccctccagatgaaacagtggctcctgaagaactcgaggatactatccgctccaaagaagcacatacaaatgctgttattcttcagagcgtaagtcctggtgccaaattaaaatccaaaactacgcttattaattattaatcatgttataacttgtgactcataaaacttgtcttattcagttaggagatattccagacgctgagatcaaaccacaagacaatgttttatttgttcgtgaactcaacaaagtaacacaagttagtatcggctcttaattgattaactctgttcgccagttccactaatttttttgcttatccatcctgctttggtagtagcactacgtacagattcttatgtatagacatttcattcatttaatgctcctgtgattatatcacagattattttggacatcataaatatcggattgatatcccatagcttatgaaatattttttggtaagagaagctaaagggctaatattcattgttttgtaggatgaagatttatatacaattttttctcattttggctctgtgacgtcgtaagtgccttttcctaagctcaaataatttgcttatcttcctgttgcttctcttgttaatttttttaattgttccttgcagagctgaaataattcgtgactataagactggtgatagcttatgctttgcttttattggtaagtttcattcctcaaaagctggggtgcattgacatacttcgatcaagcattggatttagacagagtcctgctatttttctggagtaccctgagcccagtttgttcatcgaatacttgcctgagctatatcactagatttcgtaggcattcatcatccagttattcagttgtgttgtacatcagcctcttagagctgttatcctaacagggctccaactgaattacctatgcaataactgttggtgtttattgaaaggcatatactttagttgcagcatgtaaacacaccttttattttgttactatatacccgtgcattgcaaatggtcccatactactgaaaatgggctaggggctaatatatggatctaacataaagtgagaatatatttttatccaacaactattccctttttttcccgtctttcttagcgatttctttttgtgtgtaacaatttttctctagtgattttttttatggttccaaaaaaagaaggtttctgctactgttgctagattttctaaaatagtttttttttgtgcggaacctttttctccagcaattttttttccatgagcgagggggagggggtgggaaggaggacaactgtgcttttatagtagtagagatagctagtaatatacccatgcattggaacgggtccgtactactgaaaatgggctagggactattaatatggatttaacataaagtgagaattttttttatctaacaacttttcctttattttttctttatttcttagcgatttattttctttttgtgcagaacaattttgctctagcgattttttttctggttcaaaaaattaaacgatttctactactgttgctagatttcctaattttttttgtgtggaacctttttttctagcgatttttttccatgagcaagggggagggggtgggaaggaggatgagtgtgcttttatagtagtagagataaactcgcaaatggataaaatacatgaattgtcaaagaagattaatggtgttttctcctaaaaaacaaacctaatgatttaagaaaacaaactgagtgactccattgtacacttctgaggtattaaaccatagaagttaactgatagctcaactgttctcagggttacaatgtcagtgcaacatatttggtgcagactcaagtagccagtagatggcctaagaaagaatctctcttgttccacctggattaattggcaagatcagaatgttgttacaaaatactaaaaattatcttggtcttttgtagaatttgagaaaaaggaggcatgtgagcgcgcattcttcatggttagttgcctaaattcctgtttccagtggcagataaaatttcttctcttatataattatactctataattccttctgccacctactccctccgttttatattataagactttctagcattacccacattcatatatagattcattaacatctatatgaatatgggtaatgctagaaagtcttataatatgaaacggaggaagtagcattctagcatattttttatatatttatttatgcttgactagtgaatgttacctagtttctgcattgacaattcagcagtctatgtttttgtaactatattagagtgttttcatgggagcatttgcttactcaatgatatgcttatagatggacaattgtttgattgatgatcgaagaatacgtgttgacttcagccaaagtgtttcaaaacagtggcgtcagttcagacaaagcaaaagtaatgcaaataaaggtaagataagtcatgtattcttatttccatggcttatcgttgcaattccagcttcttttttatttaagctaactgcaaaatcagtaggggaggtgctctactgttggttttttcctttaaggaaaagaactaaacaaatctattcctcatcaatattcttttcatctagacttactttggtggcactcaaatatgcatattctcatttcaaaccatagttgtagcattctgtgttcattagaaattcttgaatcctataaggaattttaccattttgtaccatggtgaagatgtcgagtcagtagctagtacctttaaatattttcaagtgaaaagatggcaacaatgttcccaataagttgggggcaaagaagaaagaacacgtcgatctgagtaagacttcaacatgtattttgtccttagcatttcttacttaaatctcttgcttgaacatgcatttgttctttggagttcatctgtaaataggagaagtgtgatatgaatacctcgtcttagtatatcagtgagtgtgaagatccccaaacagaatctaattgttacatgagtctttattttttcagtttttggcaaaactctgaagcacttgctgcatacagttcgtattttcatcatttgctaggcattctgatactcggattgttggtttctttgtatatgtaatatatgcgatccatgtagatagccctgcactgaacttaaccataaattcttccagaatcaacgggaccgtgttttgttctttacaacacgagctgggcaacggacttgaatgataattagatgctttaagaacattcctctactagagtaacttgtataactggtgactggtgagagttctcgtaacatctctgccagacaatattaagccatgaaatttctatttctctgtagaaaaagttgttttcaggaatacgcgagacgcacatttttatattaagaaggaataaatgaaattacaggggggccaaacaatttaaaaaagaaggggacagggtacaggtgtgggggggaaacagaaatcctaatctcctaaggagtttggcgacccgtgaacaaatgaaggaactaccatggccggtatggctgccctagccatccgccaaactgtagaaaaagttgtgatttatgaaatgatttttgacaagcaacatctcagtctaggttaaccacatcgaacccattgatctctaggtactaggaattacctcagtatgttcattgccgagtttaacattctcaactaggaccctgaattctggtattaagtcgagttagttgtgagaccttatgcttattttatcatgtgggagtttttaattcctgcatagttgattgcttctaatgtatttttttgaattgctgtgcaacaaaatgtccttttaatctcttccacaaacatactttaaagtgaaaaatacatgatgcatttctttctctttgcagatgggtgcttcaagtgtggcgcacttgatctcatagccagagactgtgaccagagggctgagcagaaaaacaaagggccaaattatatcctgaaagacgaaaacactcagcgcagtgggaacaagcgtcgaaggtgattttcccatccgccatcactcatattttctgattgtttcgccttttgataatatgttattattattttgtagctacgatcttgtctttgaagatggtgcaacctataatggtcagcaagatctccgaagcgctgaccgaagaaagatccataagatagatgatcgaagatcagggttg

SEQ ID NO: 58293 - DNA, 6133 bp, Oryza sativa
gggtaagtataaaaaacattatatgtcataatataacaatgcattatattaattccaaataagtttaattttagaaattaatttataatgtcataaatgtttgattctaaatgtgcattttttgagtgattgtagatatgcaataggaaacaggtacatccaattgagataatcgaagaaatctggccaggtgctattgaagaaatttatgagcttagtttaaaatctgagtggctcatgacttgacttgtgaatggtgagagtgaaaatatcaggtaaatgcacagaactatctatgtgttgaaaaattctgcaggaactttcaacatagtacctacagatcttgatggcctaattacaactatgtgttttgtcccacctagcatcttgctatacccaatagcagttttcattgcaagtaatagtattcttgtgttctttttgtcacttaaaaattaaaattagttttggggctgattacaattgacttcttttagtacgtacaattgtattctttttatactacataagtgattttacatttaactgcatgtgccttttggggggcaacatacgatttgctttagtagcccttataaatgcttgtaggagtacgcagaagcacccataaatttgtttcagggtgccactaatttgaatggttctagatttttcatttgcatggttgagcttcattgctgcctgtcaaaacacagctgcagttacttatctttcgtgttttccctttttcagtgctgaaggatctggagtactctgaaaatcatgaatgggttagtgttgaaggcgattatgcaacaattgggatttcagatcatgcccaggtacatatttagatgttctatcactctgagcaatttttttttaattttgcgtaaaccttattttgcttcatgatactgtcaccttgcataaaatggatttaccaaaatataagtcagatatataaggatgatgatagatactgggaggggcagttccaacacttactactagaagggtagagggtatccatgactgcaagtgggaccctttacatacagatataatataaggaataaaatcactcacttgtatatgtgtgccgtataaaaatcgtgtcaaccatgtccttgtcgcaaggcgagcaacgctttgtattttatcaagtccttacactccacatggtgcgtaatgatagatagtggtaagatggaagatgattttaccccatagaacgttagtacttggatttggatgggagatgatataaaccccatcaagatagtagcacgtggtggactagagtgtaatgtgctgaaataagagaagtgcattgtactctaaatattacaaatacgcgacttgtaatatatagagtgaatatgggtacagtgatacaagcctacacagtgctcaattaaatcgtgattcacgcatgtctcttggattagaggctacgggagcctattgtggtcctttctcactatgcaagtgattagtagtttttcttataaattaaatatggactcttcttacaagaatatttttttttgaagaaattataattgagaaatgatgaattgatatgatttatgaaatcgcatgccatacatccttgcaattaatactgcttgctgagtgcttgtactcacccttgctactaaccctccttgtttagatgcaaacacgttcggcaagctagcgagttaaatggtgggttggaagagctctacaggaaagatgaggcagaactagctctacagcaaaagatgaggcataacttggttgaacgtttttttgtttctcttttttttgggtgaggggatcgccttttgtttctattgcatgctatgtaacggtggagagaatcattatcttcactatttgaaaaatgattctacagaagatgattgttttttatggcagtgcttgaagggctctgcttcgtggtaaaaaagaacacttgcgaaatgttggatcatccttgaaccatttgaaacagatttgtttttttactgcctaaaatcacttgcaaagttcttgagcaatttattttgtttgggttcaggtttaaaaaaatttttacatattggctttactgtgtcaagttttttaattggttacacatttttttccgctgaaagtgctagattgatcagacgactgaagcataatcacgcatgttttgatcccttctgcttccatgagcttgctagtcggttctataatttgtgatcagattgttatacactcactgtatgctacaaggtttctgtgtatgtattcaaatttaacattcatctactaaaaaaatatgttgcaatgtgtaggtctcatctagtagattaaaaatcaatgctagatcactggaattttacctcaaattttcatggaaatccatttttcactctgagctacaaaaccggttctttttcactgttaacttttaaaacctagcatacatgccaatatgcgattgaaccatcgtgttaaacctgttagtcaaaacagcacaatcctattcaaaaatgacaacgttattctactcctaaaatgattgtcacaatgaaatttgatcaaatgtgatgaaactacaaaggtcataaaattacacccaccaaaaatatcacgtatttttttcaaactagaaaccaaatttgtattcttcaatcaactacaaacaagtcgggaagagaggtgaacctgtccaaatcaccgaaaaaaatagtcatttttacccaaaatttgaaaccattttttattttttagtgaatttcagcctaatttggtgtccactaaatttgattgaattcatatgaaggtttcactttttgttttcaaatttggttgaaaatttggaatttaagtgatttgggtaattctctccataaataaatcatacaaccaacaaaagtcgatggctgagtcaaaggacttcaataaacaaatattcagtcaagtacatggcattttaacataagatcctctgtttttctcttttcttctagtagtataaaatagctctgggtgaggagttcaacttaaaagtcggtagggtatttgtcgggtttaaaccacaaggagaaatcaattcctttcttcttaagatcttctgtggcagggccaatccgatccaaaagctgcaagtcaagtaacagggttgatcagcaactccataaaatttctccaaaagacgaccaaaaattatcattactcttggtgatgcatactactaccgtctcacaataggttcatttttcactagtcccacatatatcaatataaaaccaaaaagactacaatagccccactttatcaaatcccaatacggttattcttctttttatctactccgaatgaatttatctcctactttcacaaactccaatacaatgattgctcaaaataaatgaacttattttgagacaaacgggatgggcaaaaaataatcttattctgagatagagggagtacagcatatacacactgaacaggcagcctaagcctggaattctcctacaactagtatgataaatctttcggttggaattcttaagttcgcacggttggaattcttaagttcgcacaattggccctttagtggtatgacaatgaatgcttaagatatgagtattgtgatctttagcatgagagaacaaactacttgttaagacttaagaacaaacctgatcatgtacaacaccattggaaacaaggacagaacgatcaaagacggtaaactccccaccatccatgcgtgacaccatcccaccagcttcttcaactatctgtagtaaaaaaaaatgccgaattcatcaagtaattatactgaaagtgtgcataactttagcccaactatcaggatttggacgatatgaaaaggaactcataaaaatggattatatgactgaaaatgtgtatttaagattgaacaaaacaatcaaatccttgtttttactgaacttggatatcttttcttttatcaaagtttaattccaatcatgaactgcgggttctgatagggtaaaaaaagattaccagaacaccagcagccatatcccaaggcttaagtcggtattcccagtaggcttctgtaatgcctagggcaacgtgggacatgtcagcagcagcagaacctagtcttcgtactccctgaaaaaaaataataaaggaggataaagcaaaagtcaaagggggtaaatttgttgtgtaataatgaagggagaattcactttaccctgctaatgtctgtgtattccttgaacaaatttatgttggtcacccatgcatcatcatgttcataaccaaaaccagttaccagaagtgattgttccacctagagaatcaattagagacaatatctttcttcagtcaaatattctgacaaaattaaatcacaagaactctggttgcatccagaaccactacaatcaatagatagatacactgagcgtatgatcaaagagagattcttatggcttcataaaaaaagagctattatgacacgcatatgcgtgcgtgcacatagcaacatacttgtataaaagaaaaaaaaagttaccttgtctgtcttactgacatgaatcttttgcccattacaataagcaccaccaccttttcaaggagaaaggaaaaccttaaaaataattctgtagtgttctataaggaaaaaaaaagcattgcaactacagtgtttgaccaaagattataccagatgatgctgaaaccgtacgagtgctccagcacataggaccaccacaaaattcgacctaaataagggtatatgaaatgtgaataatccagagggatgcaatgaactagcatgggaagtttgatgatccaattgtgtctccggcgtttaatgaatcatatgattcaagaaaaacacatgcacatacataccacagtggaagcagcaggctttccgcgaaacagaactccaatggatacagaaaagctagggtaaccatgcgcaaagtttgttgttccatctaaagggggtaaaatcactgcattagatcccccaatgaagaatactacagaaaaagtctaagtttccactgcagtaatacaagttcagataaaccttcagttaaaaattaaaatcaatgtgatcccaatcttgtttcaaatttatgaacagttcaaatactctaacatccatttatatgaaaggctttttccaacatccattctcctaccaataatactatatactagaactaataacatcctgttcagttaccagcccatgcaatcgagcatgttgcctctactaaatcaaatatttcagatacttaatcaagagagcatatggaatcacccagtattcttaaatgattactaaatgatcaaactccactacaggaacaattggttaatgacttcatcatagtagaattacaaagtacttcctccgtttcacaatgctagaatgacttacgttgtgaaacggagggagaataaagtggccaaacctaaaggatcaatgcaccagagatactccgacaaggcatctccaataagtccaccttcctccccaagtatgaggtggtctgggaaggtcttcctcacaacttccagaatgaccgactcactcaatttgtctgtgctgaacaaaagtagagaacacactaaattcaaatgctaatgttttatttagattatagagatacatagatcataaaatatgatattagcaagtagcgacatcaagttccaatttacaaagcatttggagattgtaggatgataacttttttcttttgaaagatcaagaatgataaataacaaccaagttagcatcagatggggaaacaacaacacaagtaagaagcatccttactctgtgaccaggtctgcaactcccttgtagtgaatattgcgtggcttattaacagcttccattataacctaaaatgaggagaagacaatgtaagctgccttgagaattggcacatcaaaaaatagagttaaaaggaaatgagcttagctcactaggtgagatgtgtaccggtgtacaaccccaccaccgaagtccaatttttttttagagctgggatgattacatttcaaacgcctcggcctttgcaagaaagcccagaacacctaagtttaatttttgtttggctcg

SEQ ID NO: 58294 - DNA, 71375 bp, Oryza sativa
  unsure (1)..(71375): unsure at all n locations
tacagtagttcatgcaaaaaaagttttttttctaataaaagggtagtatatttttttgctgctggtatggataatgcctatgctgcatgaatcttaatttgcgtacgcgtgtggcattatcttaagggcctgtttggcatagctccagctccagctccacccctcctggagctggagctcagccaaacagtttcagctccaccaaaactaggagtgaagttgggtggagctctctcacaaaatgtactagagttgtggagctgggtttcggcaactccataactccactccagactcaactcctggagttatatttaggagttggagctgtaccaaacaggccctaagattcatgcgagcttaatttcactttcgatcttaattattttacctggttcatttgatgatttgcttactgaatgtctcgggtatttagttccaagagaacatctcagttctattggtaaccttcaagtaaactgatatgctcttttccaccattttgcaggttaaggatagaccgcatgaggctcaaagggcacgccagatagatatttttcagttttgtcctcttgcaactcctgcacctctctactcactatagtagcagtgaccacacaagcttacctgagcttgagagctcagcattatcttctcagtcttgttctcccttcacagtttcagatttatgctctttggctgtcaagactcgagcagtctgttgccttcaccttgtgcttatgtgagttagtttctgtcttctctcaattattactagtacttgattcttcagaggtcatgtgggtttgaccaattagcacattgcagttttctgtttgatgtccatggtgaatttgtggatacaccttatggttttcaaactagtgttttggaaacaacttacatgctacgcattgaaatgtttgctttctgaatatcttgggtagaagttctcaaagaacatacaccagctctattgataaccttccagtatgctgacattccttctcccaccattttgcaggttgaggatagaggctctgttgtattatcctgtcacaaggccaagatggaaaattaatgctagtcaagatgccacgcaagaaactggcctgattgatgcagaaattaattcttatgcctatagtgaaaggaagaacaggaaatacaacggcgcctacatcgataaagatggtgtatcaaggaccttcgatcgaaagaaaatatcaagaaaaaggggtaaatgctaaatatattatctttccagttgttcttccctttgttcttttgttcagcacttctacattccatgaagtatctaatcagtatatgtttgcaagtaaattgttttccctccttcaaaatgatctaatgtcttcaggtttcatgcagggggtgctatgagaggccggggctggaagtatggctctggttttgtagatggagtcttccctgtgctcagtccaatggcacaggatatcttagaatttgttcagaagggaacagacgttgcaaaaatctgggaatctttggataacattccttccacacacaatctttttgatgatcttgtgaatgtcgctgtccaattccgtatgaacaagaaatgggatctgatcattccagtaagtctgaaccctgcacattctcatcattaactaatcggatattcacatctcaatgtttcggttacctttgatcagtattttgatgtttaatttgtcaaaagtggatataggtctgcgagtggatcctgtacaggagctcattccgtcctgacatcatctgctacaacctgctcatagaatcctatggcaagaagcgtcagctgaacaaggcagagtcaatctacatggctcttctggaagctcagtgtgtgccaactgaagacacctatgctcttctcctgcgcgcttactgcaacgctggatcgctgcaccgagcagaaggcgtgatctcggagatgcgcgagcacgggattcctccaagtatgcagctcaattcccctatattgccaagagaaagaagcttgtaggttgacatagttgcataactcatgtcaagaacaatcttgcagatgctactgtatataatgcttacttggatggattactgaaggcaagatgtaccgaaaaggcggtcgaggtgtaccaaaggatgaagagagaacggtgcagagctaacacggagacattcaccctgatgatcaatgtgtacgggaaggtcagaattcagagcacaatattgtttttcagttcactgtaaaaatcttttcatttctctttctttgaaaacttacctctgaagaatttctgacatatattttttcatggtcaatttgaaaggcaaagcaaccaatgtcatcgatgaaagttttcaacgagatgaagtcgattgggtgcaagcctaatatctgcacttacactgccctggtgaatgcatttgcgagggaaggcctgtgcgagaaggctgaagaagtgttcgaggagatgcagcaggcagggcacgagcctgacgtgtatgcttacaatgccctcatggaagcttacaggtgaatatcaaattagcatatcagtcatccatggcttcacgagcccaagtttctgatcacaaaactccagtgaaatttgatcagatttttttgtaagtttgaattagcaattaatagcttgcaacctttcaatgcacccatagccgcgctggattgccgcaaggcgcatcggagatcttctccttgatgcagcacatggggtgtgagcctgacagagcttcatacaacatcttggtagatgcatatggaagagccggccttcatgaaggtacattttgcagttggtgatggaaaattttggccaattttgtggtcaaagaaaccaagaacatgagttccatgatgctactatgaactctgaaagtgaaagcctccgaatatatataattttgcccctgtctgaactctgaatatactctctccatttcaaaatgtacgacgccgtcccaaaataaggcaacggcgttatacattttgaaaaggaggtagtagtataattttgccactgtctgaactctgaactctggaagtagtgacagcttcttctgagaatgtataaatattcggtgttttcagatgcggaggcggtgttcgaggagctgaagcagcgggggatgtcgccgacgatgaagtcccacatgctgctgctggcggcgcacgccaggtccggcaacgcgacgaggtgcgaggaggtgatggcgcagctgcacaagtccggcctcaccccggacaccttcgcgctgaacgccatgctcaacgcctacgcccgcgccggccgcctcgacgacatggagcgcctcttcgccgccatggagcgccgcggcgacgccgacgtgggcacgtacaacgtggcggtgaacgcgtacgggcgcgccgggtacgtggggaggatggaggcggcgttcgcggcggtggcggcgagggggctcgccgccgacgtggtgacgtggacggcgaggatgggggcgtacgcgaggaggaaggagtacgggcggtgcgtggggatggtggaggagatggtggacgccggctgctacccggacgccggcacggcgagggtgctgctggcggcgtgctccgacgagcgccaggtggagcaggtcaccgccatcgtcaggtccatgcacaagaagcccaagacactcttcaccatataataataaaaaaaaacccaacactttgcatatataattgcattattattacatgtataataatacagtataaatgtacattacaatactaccttagttttcttttaatgtatgccgccattaattctaaagtagcggctaaccattcatcttaattattttaaaaaaatattgtaaatatgctactatctctgttttttaatataactaaccaacgtcatatatttagggatggagggagtaaattgtaagtcataaaacatgtgacaacaaaataaataaaatttatatatttttaatagcatgaattgtcaaacgtcatataaaaaatcaacggtgttatttattagaaaatgaagggagtatattatagcatagagtataatagattgatttagcatcaactttgttgctgtagagtgtaaaacggtgttgtcttgacaaatataatgtaaacaggatgtgtatgcaatcaaaccttaaacttttaaatcattttatgtataaaaatatatgtgatttggtcaaaaagattactgtcatgtggttaggataggagtatattttttaacaaattatgaatacattggtcagataagacaattattaaaccgcacattctttctattccttagggggacttattttagtccctctcaaaaaccataaatgcttgtccctactaacagaaactattaacagtaatagttttgactcggcccactaacaatttttgaactgttaaactacgatgaacgaacgaaagtaaatgcttacaaaacactcaggcaactgatctttttaaatatttaaaaaagtttcataaaaacaaatagtctaaatataatctctaatactccctccattccataatataaggcacaaccacttttttttagatgttccataatataaggcatgcatgtatgtaggcaattaactatgaccccttcttcattaaattattacttttttaaatcctccactctcatgttctttaattctattagatacatgcattatatttattaggatgatccaaactacaatatgataataaatattttcttggtctttgggttaggggtgtgtcggtgacatgggaccgggagtatcatgacttaaagacttgaggcagacgcgatcacccacgtggcctaaccccctcggggggggggggggggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccacatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagagaggggaaaaacgatcccagaacgatcgggggctggctcgcactttgtagcttcttcatacatagatccaccaaaacacaggagtagggtattacgcttctcagcggcccgaacctgtatacatcgcccgtgtcttgtgtgtttccattctcgcgaaccttccacatacagactaggagcttagaatctcacccagggcccccggccgaaccggcaaaggggggcctgcgcggtctcccggtgaggacccccacgctccgtcatctggcgcgccaggtagggggttctgtgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgtgctcgtactccaccgccccctccacgccaaagtcctagacgggaggaggcgctcgagagggtcgaaggatccgcgacttcgacatccacgggtgatggaggagggcgccgagatggggagcgtcgcctcctcgtctatggcgacggcagcacgccccagggcgcgctccaagctgcgggcgcgctcctacgtcacccgcccgttgtccctgacccggagtctccagtccaacgttggctggacgacgtggccaacttggtcatgacggcacggcagcgcctaggtgctggtgggcggtcctccgccaccaagacctctggcgctgctaccaccggctccgtgtcgtcaaggcggagggcacggcgagcggcggctgttgctcgccattcggccgccactccttcgtcagcacctccgacccaggaagatctgcgtggggggccggatgcccgcatcagtatcgagcgccggcgtaatggccgacgtgctgcccatgcaacggagggcgcctcctcgtccggagtgtcacatcaacacggacgcggggatcagccctccgtgcccccggttggtggtgtcggctgtagagcctttgtggcgagccttcggaacgtccgttggcccctaaggttccggcccaccatcgccgaaaaatatgacgggagcgtcaaccccgccgagtttctccaggtctacacaaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagttttttcagctcgcggaccgagtggctcgtaaggaagaggcatggacctggaacccctccggttccggtgtggcagcttcggccgcccccggatccgctgctcggacagggcggctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaatattgaatctccactgatcaacgctacaccacgttgaacaggcccaaccaacccacctaaactacagtgtattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggatacttacgaccatgaagcatggccagatgtctcgagcacgcagctcactctgatactaaaaaggtctaatactgcaattatcccatcaactgagctagtggtaattaagcatggctaagcataaagttctagctaggtcatcaaagtaacacaagctaggtgatttattacccaaggatgacaaaggacagatatcaagtaaacatggcacaagcgagcagataggtaaaaccctgaccccatgtaattagcaaaacatgcatatttgtttgcaaacagtaaaacatttgtaaattaggatcaacatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacagtacataaaaactaaacaaacatgtagagctcaattttagatgaattttgcaagttgaatggctcaattcggagttcgaatgaattagatatgaattttagaagttttgagccattttaatggatttctataattaaactcgatttattgcgcaattattatttaatttttcaaaggaaaaaggctgccgctgacgtcatcaagtgaggccggcgccgacaggcgggccccacacgtcagcgggtcaagggaatcggtccaccgtggaccgggaccacggggtggtccaccgccggtccacgggaaccgacggcccagatcagcccgagctgatcgggcggccacgaggcagggcgcccagagcacgggcacggctcagagccggcccgaccgagcgatggcgcgcggcagcgcggccatcggcgacgacggccggcgacggcgcggggaggagaggagggatgctcaccaagggcggcgacggcgagactgcaacggggaaaccggtggcgggctcctcggggaggcaacggtggtccggtggcgtaccacggcgcgaggcggcggacggtgactgggacgaccggggcgcggagagggcgatttcagtggttcccggaggcgaggaagcggtggccggggtgcggctcggagttgccgatccgagggaggaaacggcgcagtccggcgtcgaccggggaggcggggcgacacagatggagacggcaaacacggcggcgatctcgggttggtggtgaagttggtgctcgggcagcgaggggcgacaaccgagcggcggccgagcttgactttgaggcggcgaaggtaccggcagtggtggcgcattggggcgacggctagggcggcggtggcgcgcggctgaaggcggtgaaaggggcggcggcctcgggtgtacggtgggagtggtgctcgaggggtggagagggggaaataagaggcggccggacttccccttgcggtggcgaagctggcggtggcggtggctcggcgcggcgacggctgtggcggcgggaaacggcgaccgaagctcgccggagtgtggcagcgcgtgggtgcggcgtggggagagcgagggagagtatgccgggctcgggaaaaaaatggggaaacggacgaggggagcacggggatgctttttatgggctcgggaaggcgggatcgaggccggacgtggcggaatcggccggcgaagtggagcgccgtcgtggggtggtggaggggttaaccggcgccgtttctagcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttaatttgttttctttttattttaattgatacaatgatctttgtgttattaaaactatttctcgagctccgaaaattcacggaaaattccggagagtattttagggcacaaagaatattgcaaaatattcccggccaatgatttttaagggaaaattttaattctcccattatttcacttgattaaattgattaactttttattcaatttctaggaaatgcatcattaaatgatttttaatcccgaacgaaaatcggggcgttacagcggcgtgacaggaggaggaagaagaggtcagcccattccgacgacgagggtcatgtcctcaccgtcgagggcgcttcgcgggccacccgaaaggggaggcctgcgagcgacaaaaagaaggaggccggcgctcccagtagggagcgcccaaccagcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttctagcaatcggcgaagtgaggccaagcagaaggcccccgccgaggacatcgatgacggcgatgatgacctaggtttccaagagcccggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccatcgtgcgttgcccggggaggacagatcgcaatggtggtttcccccactgtttgcaacgtaaagctggggcgtgtcctcattgatgggggagcagccctcaacatcctttcccccgcagcctttgacgctatcaaggccccggggatggtgctccggccgtcccagccaattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcaccgccgtgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctacgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgccccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagagcccccgagccgaacggtggcccaaggcccccgacgaccggagcaggccctctgcccgcttgtcagacggtgctaggtgcccctgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactatgggaaggccgcccctgtcatcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttacactttgaaccacgccacgctatcaagagccaggccctcgccgattttgtggcagagtggaccccagctcccgagcccgtctcagtccccaaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcatcggcacgtgtccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgataggcccccgatgcccgtcggagtccaggcctcgggacccgaggggagcgctcccagctcccttagattgattgcttggatcactgagatccaagcatacctcacatataagactctacccgaggactgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaagccctgcagatcataccactttcatggccatttgctgtctgggggctcgatatcctgggaccgtttaggcgggccccgggcgggtttgagtatctgtatgttgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggtgattcgtggatcgaggagttgccagcggtgctctgggcgaaccgaaccacgccaagccgagcaaccggggaaacgcctttcttcctcgtctacggtgcggaagcggttctcccatccaagctcaccctgaggtcccctcgggccaccatgtactgcgaggctgatcaagatcagcttcgcagagatgacctcgactacttggaagagcggaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctatgctgttgtttccttttgaaggattttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgagggctaggacctgggcacgagcccttgttcaagccaagacacaaaaggaccgcggcacaggcatcctcgtctcatacacacaacaaatagaattgacaaaaaatttcctctttatttgattgcagattaaattagtctatacaagaagggggcccgaaggcctcgaaagaagaaactatttaaagattggcgggggcctgggggctcactccgatgcacccgggtcgccagcctcgtcgccactgtcgctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacaaaagcagcagcagcggaaaaaggcgatcctagcggggcttcagctccactccacaggcaaaactcaactggggtctgagccttggtcttctaacttcgtcttcaactcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcacccacagcccaccattcagtcgcattttagttggataattacgaccatgaaacatggccagatgtctcgagcacgcggctcaacaagatactagaaaggtctaatactgcaattatcccatcgactgagctagtggtaattaagcatggctaagcatatagttctagctaggtcacataagtaacacgagctagtcaatttatcacccaagtttgacaaaggatagatatcaagtaaacatggcacaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttccgaactcttttcctcgcgaccgcggacttccgaaacgacggaaactacacgctggcacgcaaaacgaggaaaaactctaataaacaccaagaaaacagtacataaaaagtaaacaaacatgtagagctcaattttagatgaattttgcaagttgaatggctcaattcggagttcgaatgaattagatatgaattttagaaggttttgagccattttaatgaatttctagaattattaccgatttattgcgcaatttaaatcaattatgacgtcatccgacggggagaggtggcgccggcaagcgggccccacctgacggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagcgggagccagctcaccggtcggccggccgggagcgacggcgcacggcccgatggtcgccggcgacgaccaccggcgcgacggcacgcacgggaggcgacgaaaagaggggaaagggaaaggagatgaagggggtcctcaccgaggagcgccggcgacgggacgaccatggggaggcgaccggcggcggaaaggatggcggcggccgacacgggaggcgacgggaacggcggtccgacgacgcccgaccatggcggagccgcggccgagggccggcaagacctagggaaattattggagcggttagggagggaaataggcgaccggagcggcgagaataccacgccagagaggagaggaatggtggggctcaccggcgaccgagagataccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggaggtggctcgggatgcacggtggaagcggcgttgcggcggtggattggcgaagaggagcggtggacggggtgcgcacggcgactgcggtgccggggagggcgacggcgcagtgcggggtggacgggagcggcggcgcggcgctgctggagttcgccggagagcggcggtgcttgggctcggcgcggggagagcgagggagggcgcggcggcttggggaaaatggggaaaatggatgaggggagcacggggatgctctttatgggctcgggaaggcgggatcgaggccggacgtggcggaatcggccggcgaagtggggcgccgacgtggggtggtggaggggttaaccggcgccgattttcgcggggagagtggggggaaaggcggaggacgtggaggggatcgtgcccacgtcgttggatgcgagctcgggtgcgggagggcgccggattttgcggcgacgtggacggctatggcggttggggtcggccggcgagaggtaggaggaggagctgacgggtgggaccaccggtcccacctgtcggcgaagggagagaaggagggacgcaaaacagacttttgcgagcgggccaagagagaggggagccggcccgagagagggagaaggcgcgcgggccgcgggagaggaaagaagacttgggccgaaaatggcccaaagagaggaagggggaaattttatttgttttctttttattttaattgatgcaatgatctttgtgctattaaaactatttctcgagctccgaaaattcacggaaaaattccggagagtacattagggcacaaagaatattacaaaatatccccggccaatgatttttaagggaaaattttaattctcccattatttcacttgattaaattgatttaacctttatttaatttctagaaaatgtattattaattgatttttattcccgaacgaaaatcggggcgttacagtcgcccactccgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctacgcgcccttgcatccagctcccttgcctgcgcctcgagttcagcggcccgctggttcagtgcggccctctcggcgcgggcactttccagattgcgacgcgcttgttcctcttgcgcagcctcgcggagggacaggctgtccgccagccattgcgccgcggcctcggcctcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaagacggagggtgtcctgcgcctcgttcatcatggtggtggcgatgagggcagccccccgctcctcctccacctccttggcgatctcccccagcaccttccgacgggcttcgagctctgagacgtgccggcggtgtgccttgcggcccacctccaccatggcctccaccgagcttcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctccccggcttcccgtaggcgatccgcggcttctcgccggtcagattcccgcctccgagcctctgtggtcgccgggtcctcggcctcagactggccggacttggaatggcgggaggaacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaatgaggtttccccgggatggttctgtcccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcgaccgctccccgggcccccgtcacggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcactgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaatcagtcgctcttccagtcatcccacttcttgcggaggacgcagggaatgtagcggttcagcaccggcccccgcggctggaagtagcaaccaccaaccaccgacggcggcgacactggctgtacggtgaagaactaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagccagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgaaaggaaggaagcaaatctcttcctcgacgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaagaagtggcgtcacgcccgaccgcttccctcgaggagggcgatcgccctggcataacgccgggggctactgtcggtgacatgggaccgggagtatcatgacttagagacttgaggcagacgcgatcacccacggccgcccttctctttgtctccccgaggggtcggaccgctcccgtctcggccgcgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagagaggggaaaaacgatcccagaactatcgggggctggctcgcactttgtagcttcttcatacatagatccaccaaaacacaggagtagggtattacgcttctcagcggcccgaacctgtatacatcgcccgtgtcttgtgtgtttccattctcgcgaaccttccacatacagactaggagcttagaatctcacccagggcccccggccgaaccggcaaaggggggcctgcgcggtctcccggtgaggagccccacgctccgtcagggtggttatgccttatattttggaatggagggagtaacaagtactctcactctctctcaagataaatttatctttaatcccttccatacatatcaattaagaaaaatactaaaataccctcacattatcaaatcctaatacaattatccttcactttctctactcccaatatatctgtcccttgcttttacaaacactaatacattgattattcaaagataaacttatttttttaaaaaaagtaaaaataatcatataaacttattttaagaacaaaaaagggtaaaaatgatcatgttttagtaataggatgaatatatatagcatttggaaatcgagaaaatattaaagacgccaaataataagaacggagtgattaatctcgctaagagcaagtacaatacacttttttaaaaaaaaattatttttgtcctctttcaaaataaacctaattttaagtaattattgtattggagtttataaatttgggaacaaatatattagaaatagataaaatgaaaacaattattctaggatttgataaaattaagatattatactctctttttttttcttttatactgatatactactagttcgtgggatgggcaaataaataaataaaattatttaggaaccgacgtactgcccactagaaccaattgttgccgctgttgtgcctagctgcactctgtctgcatcagccaccaacccctcattggcatcagagatcagattcagagtcacacagtatttgtactcgccatcaggcccatcaacagcaccatgccagattgttaattactcacgcacgaattcctaggccatatactagtacacatctccaagcccgtgatggccaagcagacagcagattaagaaacagagaactcatctgatttgtgggtttggttggtagtaagttgttggttagggcctccctgacagacagcgttccaatcagtttggtgatcacatttttttctcatcagagcttttggttttgcaaccaatggcccctcttggcgatacagcatctgatgcttaatcttctttaataaatgatccttcctcattgtggttcaacacgcactgtaacaactgtagtgttatttgacattttcatccctaacctagttagtatttttgtaaatatttctcaatatctgcaatatattcgcccttgtgaatatgtccatcagagttgagacctcctaacttcccctttgaaacacaggcgttttacaaacagtttatacttcgtaagtgatataaatcttttctatgattgcgaaaagtaaaccagatatggctcgaaaaatggttgccatttttttgaatgatactttttcctaaatcatagagaatattaagggtataactgcaaacacaaaaaaatgtaggaaagtgccccactaaggccaagagcccaccaaaaaatttttttcttcaatttgcaacctgcactaccaaccttttctgcatcttgcttatatttttgccaaaaaaaaagaaaaaaaaaagagagaaaggagccaccaaacccagaacccgcagagaaaagaagagagagagagagagatcagaggagagagagagacagacagagtgcggcgccgaggaggagaggagcaataatccaattccaatccattcctccgcgacctcgtcgtccgatcatggccatggccgcctccaggttgctgtgggcttcccgcgccgcctcctacctcaagatctccactttccccagggccttctccaccggtatctctctctctctcttcttcttctctttcggtttcttgttttgcgtatgtatttttcgtattctgtggtctgtatattcgtgggatcacgcgtggttggtggtggaatggcgtgatctcgttgcctgttcctcgcaaagattggattttgggggcaaggatcactgttcatcttatcttcttttattttgggttcagttggtggtttaggctgtgaatccgtctgcgtgaatgggaaatttggttggtctgatttgatctcttttcggcgaaatgtttcatcttttttttttgaaaaaggaatcttgtgtgattgttcctgctcttggtaacagcgtgtgcatggcaggtttatgtttctgcatttggatatgtgaatgttagcacactgatttctgaaattcagattagcctattgtatgtgttgatgaggaaggcaaagttttttttttagcctaatttctttctttgtcctgtttattcgaagtgttaggacgtttgacaccaacatatgaagcatctcaggaagatgcttttagtagctattaggagaaagctactaccgaccaataattggcaatattgttatccaatatgaaaatgttacaataccacggttgtttgtttatgaatttaaaacttgtgttgctaaatggtgtgccacaatcacatatttacagatctgaattaggcacaccaaggaaatgaattaagggaaagtcttattatagcagactttggttttaaaactttggtagtaggaaatgaaaaccatatggtaaaatatttatgcaacttaagaagtgacaaatagtcaattgttaatttgcctggccaagaggctttggtttctaacaagcattggacaaatggtcataggaaaatacacctaattttcagtttataaattggcttctaggggggggccattaattccagttgttctggaaatttcgtatgctttctgtggaaaccttgtttcctcactgccaattcagtattttacacatctgatgaagttgtgcatattgcttgttttctatttttttcagtgctgaaggatctgaagtatgctgacactcatgaatgggttaaggttgagggtgattcggcaaccgttggaattacagaccatgcccaggttgatctattcatacgttatatcacattcattgcttcattctgtacatacgcataatataagcattccatttcttaaacattacagggttccaatatatgttatcatgttcagtacatgtagcaaggactagcagtgctaaagttgatcatgtgttgtttttttttcttttttttgcttccagcaccatttgggtgatgttgtgtatgtggagcttccagaagttggcagcagtgtatcccagggaaagaactttggtgctgttgaaagtgtgaaggcaaccagcgatatctactctccagtatctggagaggtggttgcagtgaacgatggactaggcgatgaacctggattggtaacttttaattgcgtaatagatcattgtgagtagattgaacacttctatgaactgtgttttttttttttttgcataggttaatacaagtccatacgagagtgggtggatcatcaaggtcaaggttagtgattcaggtgagctcaattcattgatggatgacgcgaaatactcgaaattctgcgaggaagaagatagcaagcattgaacaaataccagtgacttgtgatctgcaaagaatgcgccttgacccttttgtcaatgcttgtgatgtgctatcgagcacttatctttaccaccggctgctcctgaaatcagcaccgatcaacacatgaataaattagtgttggcattgcctcttccacaaagagttgcaaacttcgaacctgtaaatgacatgagtttcgttatttctttgtagtatcgcgtgatttcatcttcaattgtagctctgccgcctctgctccgtttatttctgaaacgtgtgcttcgtttacttctgaatcgtgtgttcttggtgtctacgagcctgcattatgctgaggaattggggatgattggtagtagacgaatagctaaatataaattggggatgcttgattgcttgagaatcgtcaatatttcagaattaggaaaaaaaaactcatcccagattatggccttacttttcctagatcctagatagtctgcaattctacagctctgttcttagttcttacattatcagtatttacattcaggtgatgagaaagaataggctacttggaggattccctaatcacatagcaagttcatatcacaattcacatatccttctgtcatagaacatggacgccaaaattatcaaatgacacaaatggatgtgtaaaatcaccacgagaataacaacatatgggacaaaaacagtagatacttttatcactataagtatatgtcaaacttaagtgatggtcagcaacattagtgaacagtgatacagaactaatatatatgaatttagatacaaaaacctaggcgatgaagataaatactacccttagcctgacagaacaatgtcctcaacaaaatacagaaggcctcaggttgcatcacactttgatgttccacttgtgtgctgaccgtggaccacgagtgatcccctcataatattgggatggaagctttcctttgttccaagttttcacaaacttctcgaacagatcacgagcagactccgaagaaagatcagagaaaaatttgcctttttcttccttcaaccaggttgcgaactcattgttctttgcgaaatagtcatctttggatatttctttgaaatcctgtttcagtaaaacaaaagaacaatgataagcatggtctcaaggagaaaggaaatggagagctcaaagggtgcagtatgccattatgtatgttctcaacagtttaatacttccccaaaattgttgttagtctcaaaaatataaatggcatacatgatacaactcctgtccacctgtccagatacagataagccattctggttcttgtgaactgtgaccttaaacaagtacctgacttggtatcactaattttcatcacagacacacaaaaggaaataacctacaaactgatatcactaattcaattcgatggcaacagcaaaaaaaaaaaaagcttttcctttatattcagtcttcagagacaaaatacattctggcaagcttcagcaaaatttcattgttcaggaaaacaaaaggggctcctactcaggctgggtaagatggctacagaacatataccagcccggcgaaaaaaaatggtcgtaagaaatctgcgataatctatccctgattcacgcactgaagaattaactgaactagggacgttctccagtttggttctacttgtaaagaaaaaccaacctcgttccagtaccatagttatacgaaggctcaagcttgtagaacaattcatatatgaaaaaatgtggcctaaatagcctattcagatagcttaactgctaatatgcaaaatcatttgattgatgatgcccagtagattcatagcatcattcagacttagagaactcacatcatccttgtgctttcgcttgctcttctccttctccttggaatgcttctcctttgaatccctctctgtcaaaatcacacacacacacacactgaattactgacatacatcaaagctaatatagcaggtacgagtgtatcctcagcataatttgcacacttccagaatagttgagcatgatttcaagtaagaacaatataactgttttagaacaagaaatcaacaagtgccactgccaagccgtgaaggcaaaagatgaaccctagttccctacctttgtctttgcccctgtcgccatgcttcttcttcttcctcctgcgcctctcctcctcctcctcctcctcggcttgttcgtctcggctgctcctcctgctctccttcttgtccctcctcttcttccgctccctctcctcctcctcccctgaaccaccaaacgcaccaagaagattggcaaaatcaacacgcggagaccagatacgccgatgcctcgagagggggggaatggatagggggcctttgagcacctgacgagggtgacgagcgccgcttcctcgacttgccctcgccgcccatcgtcgccgccgccgccgccggggagaagaatcgaagagggggttagctcaggtgaggtctcgggacgggtttagttggtattacagatgagtccgagggctcatatgcaaaattgtcagaaggctttcgggcgcggtcgatccaagccgttcacgtctcatccgacgttggggagagagtacagcaatacgaagcactcacgctctacctaggcaaatcgtgtggttaacatcaagtttatggttttgcgtaaatttcaccctggaacacattttattactgaaattttcttttgtaccacactttcatcgatttttttttattttggatcaaatgttaatagtcttaccattgttatactctagaccacaccgactctcttatcaagtatacgaatgatttcgattataccagttactacttgtcattgaactcaaaatatgttgtacgaagtgagtgctccctttgtccaatgatattataatcatgaacggattagacctatcctaaattgtaatattttgagatgggggaaatacttagaacatgcatctatgtcctctttgcgaatattaaaacatattatttattcctcacattaaaaaaacgttttaaaaaatttcccacttgtattatttaaacaacttttcaaagctatttgtcaagtttattttttaaaatatttaatttatcattataattaaatagataattcgtaccactaatatgtccaataatctaagtactggtactagttaattaattaggtagtaacaggtaatctgcgtcataatttatagttcaaccataattaacaatctacagaaatggcattaatcctcaagtaaattaattaagctttgtcgttgtgttacatcctaaaaacctcaatgatctctctgctaattaaccatgcaaatgcatggagaccttaatatccaactccagttcagtagttcacacaccaacaaatcaaaaggtacttagcagctgtactagttaactaggtagaaaagcttgattattctgatgtgctaattagacacacacacacacacacacacacacacacacacacacacacacatatatatatatatatatgtccagaacgatgaacaattgaacaacacagcaacccaactcgatcgtctatcatcagctgatcatgcatcttcatggtctccaagttactcctagctcccagaatcgacaatgccatcatgtgcttaattagcaagcaatcatctagatctctgcagaatgatatcaatgcatgattaattcgcagctgtgttgcgatgaattatactccctccgtttcacaatgtaagttattctagcatttcctacatttatattgatatatatatgtattcattaatatcaatatgaatatgaaaaatactagaatgacttatattataaaacggatgaagtacataaactagtagataaaatcattgcgatatatatattcacatcacacacctgatgagagtatcaggatgtgccatgtatgctttgcttcgtttgttcttaccacagctgcaggccgtggccggcggcggcggcatggaagctgctgctgctgcagccggggtcctgcaggttgggctgcgtcggctgcagccggaacccggcggcggcggcggcgtcgacggcgtgcagcggcggggtgagctgcagcgcggtgctcgacgactcctcgccgtagtacgccggcgccgccgtcagcatcgacagcaccggcgccatctccaccatcgccttcacgtcgccgccgcccaccgccgcctgatgatggttctcgttgatctgaattcatatatagtttcatgtacaagaatcaaccaaacaccataattaatgtacatatatgtgcttcaagaatcaaaacattttaatgaattcttgattactgattaactaactatacgtataccatgcggcacaggaagctgttctggtcttccaggatgtgctcctgttcatcaatttcatgcatagaattgaatcaatcattttttttttcatcatcatacagcaaagtatttggtgtttcatgatcagtttagtagtgcaaattaattaccttgcgacgaaggttgtccagctgctggttcaggagctgatgctgcaacaagcaagaattaatgtgaaacaactattttttatttttttaacgaatcggcacttagatacacctatttcattgaatataacaaaataaaaaacttacgaaagcaaagctttacagaaaagaggaaaaaactatgggatcaattaatccctaaaccctaaacttaccatttaccattgaatcagagactgatcattctaaattaactctgaagaatgattcattcatcaaatactatcttcttaatcaattactagctctatttcatattacaagtcattttaattttttttcttttaagtttgattaaatttatagaaaaaaatagcaacacatgtaataccaaattaattttattaaatctatcactgaatacattttgataatgtttgtttttgaaatactaatatattttttataaacttgattaaacttaaataaatttgtaaaaaaaattaaaacgacttataatatgatatggaggaagtaattacctttctcgcacggactttggtgacggagaattcgagctgctgctcgagatcgttgatgtcggcgagcgtgaggttggagaggtcgtcgccggtgaacctcctgatgccaccgtccagcttctccatctcgttcctcatccgagtcatctccacaaatatttgctatatatatgtgcacattaattatatttgatcagtgcatttgaaagaaaatttcatttcaactgctggcagatagatcgatatatattctgatattgatcagacattgtgttgctgattgtaaaattaatgtatacctgatcgtggttgatctcctcgaaatgagtgttggtgacggtctggtaatgctcgatgagttccctcaaactatatattgtcaaacattgaaacaagtaccttgattagttgtgagttaattaatactttgataagttcatgtatctaattggaatggtgcatgtgtaattcttttgcgcattcaaaaaagaaatgacaatctctgatgtacaaatcagatggtataaattaattttgtagctagaattttctcttggtgatgtatatacttacagagagtatattattttagatcaaaatgaaacaaacgaaaatttcttaactaataacaggaatgaacaggggatcggaagaaagaacttcacatgaatattcacatattaattaactataatatgctgcagaacagtataaaatcatgtgagaaacgtctggggatcttccggctagctccacaaagtggtggactagacaaccaaggttcgaaacctcacctcttctaattatttaatattaggtcattctcttatattcgcatctttttttaagtataaaaacatgcataacataagataagatatggtcgtactgtcgtacacttgttcaaattatattccctgttgatatacatcttttagtttgattaaattagccacatatgaaatagttttttggggaaatccacctaaaaaacccagctcgatcctagaaatcattagaaagagggaaataaggattaattaactagttgactataaattcaggatcaagttgcaaatctacatacatatatgttgctcagagatgtaaaagacaagtgcgtaatcaagtcacaagagacactagggcatatagatcattgcttatgtatgcctttgatcatgatttaattttgtaatagattcttggctcttcgaaaatatatcaaaggaaactgcagatgcatacatatacactgaaaatagttaaaatgaaggtaggaaaaactcgatcgatcaggagttcaggacaagaaaaatagttcagatgaagaataaatgcaaggcatccatccattatatgaacagatcaaatgatcataattaaacactcttgcccaaagaaaacaaagggtagaaactgcatgagttagttaattttctctgaaaaacaaaataaaggccgagagaaacttagccgaaaacttaatctcttggttgacaaaaaacaagaaattaattaacccatcaaatcaagcactaaaaagagaacaagagacactaagctggagaaaggaaagattgaacagcatctgataatataagagaacaaaacaagaaccgtacctgcaggtagggctgcagtactcgaacatcttgccggtgctggagaagatgacgacgccgacgcgggcgtcgcagagcacggcgagctcgttcgccttcttcagtagccctccccgcctcttcgagaatgtcacctgcctgttcgtcgcgttctcgatcctcttgatctcgatcttgccgcgccccatgcctgctataccttcctgatcgagtttaatttaatttctgtgttcttttgtttctccttcttctgcacaagaggaaactgaagaagaagagaagaagaagaagaacagaaatggccaagttatgaacatatcgatacatggacgaattttgttaaaatcaacataaggcatgggtgctcaaattggatttccccccacagctatgtaaagggtgcaatcagaagtagaaaaaatttcatgtagagaagagaacaactagtagctagagatgtaaaaactctttgctgcgaaaggatgaagaactagctagaaaaggtgtccttttttttttcttgaattactcatgaacagggtagatagatagggcaggagtagtaatgtgctatgtacataccttgtgaagtgctaagcttgcttcaaaggctaaggcaggaggtgcagaaggagagacatatataggagagagagcttgtagtaatgtgcaacacacaatgctttctctctgtcacacactctcacactactactcctgcaaatcaaatcagtgtactactccaaatcaaatcaaaagtagatggagggagtagtaaatatccagaaagcaacaaactacatttttaactgtaactaatatgctagctagtctagttttacatttacccctgcatcagtgtgtaattaggatcagatagtgagtcaaagcaagaaacggatgcagacataagcatgacttcatgatgatgatgatcagatcagtgtgcatatccatgtgtgtacttgcagcatgcaatgatgatgcactagcatatactctctggtcgatctctgcacaaatacacgagcctagcttgtgacacaaaacacacactgcaacagtgcatatatcacgcacacaaaagttcagagatatcagtgtatgtagctcatgcaatataatgcaacagtattactcatcagagcacagtgcagctatatatacatgggcatggtataaaatcatgaacactacatgcaattgcgaggaaggtgtatgtagctatagcaactctctgcatgcccctcacaaggcaccatggaaagcaacatgtgtgtggacttgtaaccaccctctgacagtgtgggcccacccggtttcctcctccttgccgatcttggcagctaggtttgttaggttggccatggccatgaggagctctccagggacagggtacacttgctgcttatggcaacagagccaagaaaaccctagctcccttgtttgttgctagctagctaagagagagagagagagagagagagagagagagaggtatatgtgcagctagcatattgatcactatggttgcttgcttgccttgatgggggactgccactgcacattgtaccacatggggtggagggggggtggactgcacccctcatttgggaaggaagaaataaatttggcagagattttgatctctctccatgatggcttggctaattatatagtagagagctagggttccctatgtgatcaagttccgcgagattccgtgtttctcctttacagtaagtttagttttacggttttgctagctagccgtcgacagttttggaggctgaaaacttttgattttctggccgtgcgatccacgccatgattcgtgcgagatttggaaaaaaaaatctgcgcgagaattaaggtgtgtccttgcaagggcttgaacctaggatatccatccccaagccgtgcgtgctagccacttagatctgttgcatgtttttaaaaaattaattgagttacatgttagttatactccagttgcaccctactataactgcattgtgtaattgcattgtaactacgttatcatctctatataatttagatataaagttacatatattattttaatacttatatacgagttacattatagttatagtaaaattatattacaattatactatagttagatttgaaagttttttccttaaaaaacttgcaacagttttctagttagtccctagttttattacgcacatgcaagtgggttttttaatatgaattcagtgagatcggggatatgttattggttttcatctctttgaacgtgtattaggaggcacattcgctggtgtgtgtgagcgtcatggtgcatgtgcgtctatcgtgtaaccaggaaaaaaataattttaattttattaagtattcttaagaactaatgatatctaagttattatgcattttatttgctttcagtcagtcagagggtcattggctgttaattgttggttgaccttctgtttgtccaaatcaatacataatttttgggtggacaatttagtatagaagtccatacgataggggcaaaaatcaataaagaagatcattcagtaacttattatatatcctgaggaatattcagtctagctagctacctcgatctgaatttgacgaatcagtaatgctaaagtaacaacgcattcatgatcatgttgaaatgttaatggagagctggtggcatatattcggagcatatatacatatatatgcatatagcagcccttttttttggtgaggacatgtagcaaatatataatgaccatatataagcacacaatataaacaaatatgtactgtagacaagaatacaaaaaaaaacttaggctcagaactgtgtaagcatgctagttagcttttagaaaatcttacattaaccaaaagtaaatgggcattcttacccacatatatatgatcagcattttcaggctacttgttgcatgaacatccaaacaatcttaatttgcacatatatttgtacatatatttttcatctcatccactgtctgcaactgttgcatatgtagaaagcgaggacttccatttatgaaacactgattgtgaaaggaaacggcctctttgcatcaagttctgtggctttcctttgtcgatgaagcttggtttcagtcccagattctttctcatatccaccaaatgtgcaaattcagagagatcacacgctttacatcgtctgattgatcgactgccggttcagattgagacatacacaaattacacgaaattctatatcactgtatatttccaaagtaatccatccaaatatgcatggttgatttctcatccaaactgtctgcacatatacaaacgcgtgcaattgagttgatccactgcagcaaattcaggtaactcaggagatcagtaaaagattggaagaattaattatcacttgccaacactaatgaaattctgatcaacttgatgggctaacttttgttcagagttggcagaaatctgaacatcattaattagatgacatttgccacgtagttgtgtgaaatcagatggcaacagaaatggaaaaaggttatgttgaggaagcttagcaagaaatcttttgccatagatgttcctgatgagttgtaaccaccaccactttacagcaatgacaattattgatgtgccaactgccaaagtattcaagaaagatcagcttgtagtatatattgttttcaggggtgatttaatttatgtgatgagaaagtaattaaacaaattacttacaatacttgatagtaatcataaatggagtccgaatagtggatccaccaaactcaaaataattaatcagctttagtcagctaggaaacagattcaactatataagtacatactttggacccctcttctgaagctgtaacctgttgattatcatgaaggcaagatgtgaattcatatacacatggtctgtgcgtatgaattcacatcttgtctttgtctgactgatagctacagcctgatacttgcagcagtacatgattacacattacatctactaccattgaggaaagggagagaatatgagtgactcatctttcctaactcacacaaaacaaggactcaaggatgacacacaaactagtagtactattcatttggtattctgttgtgtgcttgtgccttgtgacatatgcatttaataatacccaactctaccattaaaggaaaaagaaaatgttgttttccagtatgatacatggacttatgtaacttgtgcaaggaaacccacctcatctcagtcgatttttccatccatccgatagatcaagatccaatggtccaggtcaatcaaaccattcaatacaaataccaatttctaacacccacctctcttctactccccagctgccgctgccatgcatccacaccttctgcttcaacaggactcctccaacgatgctagacgccgatgagccctccgccgaccaccgctcaccattgattctacctaagctttgcgaggtgcccccgccccatccacgtcctcgtcctccgactctaccatccgccaccacctaaccagttggacgagattcgtccaccttgttctcctttttcttagttggatcctgccacgggatctaccataaccgtccaccgctacctaaccactcgaccgagatccccctaacctataccctcccccttcgtcttcaatggctcccatcattagatacgccaccactactacccccccccccttctttgtacccacgggtccgatagcaccaccgccgcctcgtacccttgttaccaccacccaccattgggccacacatccccgggcttcctctaagccggggaactcccttctcttcctcatcctactgtgacctccaactgtgaattgtattctaactgggtggggttgttgtagccagttaacagagttcatcaaggtcattgaagatggaggagaagctcaccgaagcacggtncaaagtaatccgaaagccagaaatctgtaagatttggaattctattttctattgaatgtacgttagcagttctgtatacaacattttcaagcacgaatgatatggcaactggtctatatatacatagtaaattaatgaagtgtgaaaacttgttttgtgcttaagaacagaatctaaatttgacctgaagaagataaacttttatgaacagctaacgcggtgatgaatttgagagtagggaaacgagctagctagagaatgaaacttcatacaggatacgttgtggacatggatcgattaggatatatccatcacaaagaaagcaaccatctgctcttccatgcttcagcagcagcagtcctgaattcctgatgctttgcacatcgatcagcctcagctttggcccttggggactgccaaatcgagtgcaagatttttgtaaagcaggaggtatgatggccaatgaaagctattacccacgatcccaaacatcaagcgaacataataagattacgctttggttgtatgcatcgatcctagttatgcagaggccacgattgttctcaccgcagttatatcaccttgatataatcgattagttcaataaaaactttcatcatctaaaactaattaataagagtacgcacacatgatcctaataattttgaagttgcttaaaaaaatagcggtctaatattatctagttctggtcaaaactaacgagggttcgtgaatgggggagtaattcatttgtcgttacaaactcaatataagaaaatagggatggtacatactagctggtattcccttgttattttattgtgtactgatatcttgtagtctgaccatttagtactaatatgggacacatactggattgaaggaaagaaattgttttccactatatttgccccctcttaaccagtaaataggattggacgaggctcggacaaacaaagcgcatttgcactaaccttatcccctcctcgtgccaaccttatccccttcccatatgatgtacggaagctcctcgtacccaaaggtgtccatggtgaggtcgaagtccaccaccgcaccgcacatgaactcccacagtagcactgcctcggtcacctgtagcggcggctccacctaggacaccctcttcgactggacgatggcctagacctcattgaggccatcatcagtttttccggtcacttggagcaagcaccgccgggaaggtaaccccctcaacgagccaccgttctgggatggtggcctcttggacaaagctcctcaccggcgtcatgtcccaaggctaggttcgattaaatccgctgtcaattaacccgccagcgccagacgtcgtcgcaccaccgcgggttcctgaccctaccccatgctcaatgtcaactacggcacaacgaggttcgagcgtggcatccccttctccttttttttgttttggctcacgagctaaataagctggctctggctcaagctagcacacaagccgagccaagtgtttagcgcgttagcatagcaagctgagccaatccaattcgttatcctaatgagcccggatgaactgagttgactcgatatccatccctacattgatatttgaaatgaatcaatgcctgcatataccagcaagcttaaatctggtccctattaatcaaccctatcatatctattattcctagtttaattgggtatgatttggctagctattgtacatatacaatcagttattaatggcattatttatttgtgcatatcttggtcacctatatatgtgtatatatagaaaatgttgattacaccataaagataggccttttattatttgcaatcataacttttttccaaattattaagaaatcgaatagtgtgtttcaaaaaagaaaaggggggccatagcagctataaaaagccatgccaacccaatcagatagccatcaccttcacagccaggattagcctagctaacagcacccctgccgcagcctcccttttgcaattcgccgtcaattcatacgtaaagcagctatagccatgcataggatggtgaagctactctgcacgctgctgctggccctttctctcacggcccactattcgggtaaatttctcgtcgtcccaaaataactccatttcttttctcttatccaagttcatatctagaaataaaatgaagtacttgtacgatcgatggaggtagtactgtttatatatcgatttatatgacgaagatcgtcttttctttttgattatatagaatacgcacatgtgaaaacttaataagttttgatttgatctgaatttgcagatatgtcgatgaaggtgtcggccgattgtcagagcgtcaacgtacccggcccctgttctcccacaacgtgcgatgataactgcaagtcgcaaataggtgctggggctgttggcgagtgtacgtccgggggatgccaatgcaccttttgtactctccctcctccaaagaagaactgaataattaattatgatgatgatgcatcatggtctgtgatgtatcatttaatcctagcataataaaattatacgaaattgtgtcgacgatatatgtggatgtcttttggttcgagcgacgtttaatttggtgcatctcttacttgaagattcttgtttcgtggaattagagttgtactaaatatttttgagatctcgaataatacagaaggatgttgccgctccgtttctgaaaattatggcccgtttggtatacagctcctacactccgagattcttgtttcgtggagctgaagctgtaccaactgtagctgtcatatccactatattaatcataatttaattcgctttattttcttcttctgctgagattttttattgattagattttgccatatttgcaagtaattaattttttattttttatttttttttgcgaggacaagtaattaattatttgagcgtatcttggttacctatgtatagaatatgctaattacaccataaagctaggccttgttatttgcattaattctatatcctttcgaaagaaaccgcatatatgtttttccagaaagaaaaacctagcgtcaactatgcaagagtatatatgtgtctataaaagtcacatctgtcgttcatcctcacagtaacagctatccctcgcggtctactgttggggtaaaattcactactcccatattataagtcgtttattttttttaagtcaaacttcttttagttgaatgaaatttattaaaaaaatcaaacgatttataatatgaaacagaaggggtttcatttttattgcacataagatacgtagtgtaaacttaaaataagcttcgatatgatctgaatgtagtagctaggtgtgtcgatggaggagttggccgatggagcaaccccaaaggacttacgcaaaaccatcaccatatatatccggtctgtgttttccgaagttaagtcgtgccttgtttacagcaacaagcaagttgatgcagcttctaccagcgggatgcctatatacctactgtctctaaactttaaagagaataaaatattttctttgtctcaatataagtaaaatctagtacaaatataacatatattaaaactatgaatctaaacaattttatagttctataatatattacatctgtattggattacacttatattaggacggagggagtagctacgttagataccatgcatgtacaatggatccactaattaattagttcttgctaccagcacattacccatgttcaagggctccacaaagaaaaattagaggaattttgaaggatttgattcgtatggaaaaaatattcatgtgtggttctttggaacaatagagaataactctcctaaaatttataggaatttcggagaaattcatggttttctcttccagtaacataaagtttgtgtcatccaaacagtaattttgaaattttatatgttttaagttcctataggaattcaattaatgggcatgacgctttactcatgcattttttatgtttctatgttctcacaatcctgtactctgaaaagtcctaatctacctaaaactgtggtaataaaaatgccccatttgggttggagcttcagacatatgataaggtgtgtagcaagaaatcttatgcttctgatacgtaacttgatggctatcatataaaacggagtcgaacttgtagatccaccaaactcaaaaccatccgcttgcttgcctgctagcagctaggcacaaattcaggcattcagctacaagtacctggactgtagataccaaatgaagtgcgttttgtgcttatggactgtactacaatctaaatttatcctgaagaagacgagcatttatgaacagtaaacccagaaatttgagagttcagtgaacaagctagagaatttgcccaaagtttatacaggatatgactatcgatgcaagggtacttgtcccacccactttcatccaaagtcaatacacaggcagttaactttcacacatacaaataggaataggattcaacagaaagaaaccaaccatctgttttttccatgcttcagcagcagcagtcctgatgctttgcacatcagcctctgctttgatgactgccaaatcagggaggcaagattcttgcaaagcaggaggcatgatgactgataaatgaggcaacagactgatgcatgacatgaacaaacactcaattcatacaagggtctccacatgccagcacttttgagtattggattagaaactgatgaaaggtaaggtacagttactacattagttgcaaatcacctaccaaatcacaatcttttttttttctactgctgccatagcagagcagaactaacattaggaaagcctaagacctaatcagattacccgtttcagccaacaatcatgggaatagttttgacaagagcactgagttttagaggccctaagttcacaggacaatgtatatcaatgtcacaacttcactgtatcatctttagctactttctggcagagagtgctgctcttcaggggcctcttcctgttgctcttgaggctgctgccacacatacgtcaccgggtgaccttgctgtccaccgtacatcattcctgatccaggcccctgctgcgctggcacgtagtaatatggatatgtgtctgctgcgccccccacattaggcggtaggccaaccctcggaagcccaagcccttcttctttcatttcatccctgggaactatgtccaccaagaagtcatagatatcagtcctggtgatggcagctgcaatgtcattcttctgcaaggtccggcgcttgttctcctccgtgtgcatccacgacctcaatgttaactctaatatgaatacctcgcatgcctttgcgaagacaacgggggcttctgccgagatcatccggacatcctcatcagccttcattatcttctttatccttgcgagtggcaagctgtggttcttgaagtcggttgtttgctcaatctcttccatttggttagcccagaactcacggagttgctgctgttgctgttgctgcagctgctgatgaaattgctgggcttgttggtagactagctggtgctgagcactgagttgagctggattagtggggaatggtgctgatggctgtgagccaggaggaacaacagcaggagctccaggaaccatggcttgaggtggatatgcagcagcaggaggaggatatgcttgtgacccaccagtggcaacacccatcacaggctgaggctgtgaggatggttccatgtcagctcttgtccgtccaaagccaaaggccctgtcgttgtgggaaacagttgcaagtattgatcagttgatcttttgtatagattaacgagaaagatcatgataggttctaaatttgtattttgtcaaatacaatacacatgagtgagaataccttggtataagaatggaactcactgcttttcctttacaaaattgtatctgacatacaaacttgcatgcagggaaaaaaatgattgaaggaacaaaggcaacttgattgcgacttttgttgcttatagtacaattaatgagcaacttgagtgctgcggttccatgtagcttgctgttgcactttaagcacaactcatgatctcaatactttcatctctattggttcattaagcattctaaacagaaagagacttccattgaatgtggaatagaattacagatgcataactaccagtatatgtgatagaacatgtgcaagctaaacagaaagtagaaccttccattaaaatcatccctatgatttgtgatgggatggtaaattaccttttgtactcctactatccatattgtgcaagtgggtagttgcatgaacattcaagccctgccattatcggtcaaactggttacggacaagtgaatttgtgggctgctattacaaaccaacatggataagtatgcatcatacagagtttgaagcttctcatgcatgtacagcataaatcacatgtcttgatgttttccggtagaagcaggtcccaaagataacccacaaaaggtagctatgcccccatggctccagttatgacttattagtctcccagaatgatggcatttgtgtccagagggcacagatcggctagttccaagccaattgcacaggttttagctcattgactgacaaatcaatgtttggataactgagatgggagatgggaaaatacggaatgaattgtatttctagtcaaggctttttttctcccctctactgttggatatccaacactccaaggatggcctggatttggtgtagttacccagctgcagttgcagctgtcatggcagggcagttcataccatggctatgtgttcctcctaatttactcgcagcatctcatctacttacatcaaaccgaattaagtctatgacacccagatgccaaatctcataaatatttttttccatgtcaaccagaagtgtgtgtaaaagaagactacaacattcaagcaagtaggaaaaaaaatgcacacttaaatatgtaagaaatgttaaaaatgatccgctatgtcattattaactttgaacaacatatcaagaagccaagtgatccaaattgccatcttactctctgtttgacacaccatcagtactaaaataaagtgctgtcaggttaagcttaaggttggggtgcaactaccttaattggattctttgaagaatatgtcaatcttgtagttccaggaggtccacacatttgggacaaacaaggaaagttggcacgtatcatgtcacgtgacatttgaacacagaaaaaggcaaatttagatacattccaaaactcagactcattaaatgcatgggaccaatcacgtctttttttagggaaaaaaaaagagaagagagcagcgtcctaacacatacgcgatgtgggtgatcatgtaattatgatccatcactaagagaaaatatcactccaagagaaaatcatcatatcacttcatgaaaaaacaatgcaacgaatggtaggaaattaggagtgccctgttttgacagaacatctagacagcaaatcatgagatcctaacagtatgaaaacaacaccaaaataaacaaatttagatgtggcatcagaacagtactcttgcatctaggaagtttgcactcgtggcagaactacgttaagcgcgcgtcagcaatccatcatcactgaccatggtaatggtttcctacgagttgacccactgttcttacaagaagatgcaggtgcggacctaacacggggcaaggccagggtggtcatccatccacaccgtgcttcttgctagtcacgcaggcgaggaactccagctcgcactgcagatcggaaacagaggagagtacgatcgcgatggtgaaggagggcatcttggttatctcacttctttgaagctccatttcactagttagtaagctccattcccaaatcaaagagaacatcaaacctaattctcctctacagcagctccttccaaggctccggcgcggcgccaccacaccagcaactacaaaccctccgcctctccggcgagctcatgaactccggcaaacaagctagggttagaattctgggcagtggcaaggcggccatgacacgggaccaactcaacactcatgaacacaaatttaccaagacgagaccgcacgtctctccacacatatagcaaactaaaaatccaaactagaactaagcaggatcaagcaatcgaaacgaagccgacgactaatcgaaacctaaccatatgctgccaggatcagctccacagccctagaaacagaggcgatgattcctccctcagctacgagccgagagagaattcccccccccccaagctagcaacacccaacccacgcatgcagccaacaatccaaacgggatcacccacggaattgggaacagagagatcgaggaaaggtggcgggaggcggggcttaccgagagacgacgcccggatctcccgcgccggcgggagcgggagcggcggcggcggagagcgctccctccggcgaagggccgcgccgcccacctccctctcgtggagccctcggcgtcggcggcggagagagagagagagagggagacgcggtcgcccttgggtcagaaggacgcgaggaggaggaggagaagagtcagcgcgaggaagacgaggagagaggcagcggcggccgcgggcgggggtggtgggctcggtgggccggaggtttctctatgtgggctccaggcctggtaaaattccgcgttgtttctgttggagaaaaaagtctaatttgcctcccttcgttatagcccatttcgcaccgtaaaaatttctaacgcgcaaccaactctaaactcacctcacgctctacacaatcacatccattcacaaagcctctgatgggttatcttatcagccgtagctcaattttgaaatttctaatttgattctacattttttttatcttagcctatttttaatattagattttaaatcaagaataacacaaatataaattttatatctgtaatttattttgttggctttgttcatttttctatgccttatcagctataagtcaaaacgatcaaaacaaaacaaaagctggagacttcgcaaaggatataatgaatctcgatgctaatgtgaataaataggatatggatttttttaaaaaaaaaacattatggacacaagtgctcatgtacaattgcgcgcagagagattactgtatttctagtattataaaaaattaaaaagtactgatatacgtacaatccgattatacaactcatatatagctagaaacttgcaaccatagttcaatctttaacacatttccccgcaaaaaaaacacacacacacattcatatgcactacaatcagcatgcatgcacgggcatctcatctgagaagattgggaagatacgcaaaacgaggtaagtcattagcgcatgattaattgagtattaactattttaaaactcaaaaatggattaatatgatttttttaaacagatttcctatagaatttttttttaaaaaaaaacaccgcttagtagtttgggaagcgtgcgctcaatgtatctggaacgaacgcagccttcctcctctacccccgtaatttttgcagtggtggacagaaccagcagttacaattgtttgattttgagtggctaaggccttgtttagttcgtgaaaagaaaatttttaggtgtcacatcatatgtttgaccggatatcggaaggggttttcggacacgaataaaaaaattaaattcataactcgcctagaaaccgcgagacgaatcttttgaacctagttaaaccgtcattagcatatgtgggttactgtagtacttatggctaatcattgactaattatcctcaaaagatccgtctcgtgatttccatacaaaatgtgtaattagtttttgtttttatctatatatgactttttgagaaaaaaaattaggaactaaaccaagcctaaatatgtgaaccctatagcctgtgagttgtgagcctatcagggtttcccaaaacgccggggccagagttaccgcgctccggcggtaagcacggttaccgtgcggttaccgcggtaaccgtggaaaaccataaaaaaccgtgcaaaatttatcaaaaattcaaattattttttaaatttatttaaatttaaggaggttaccgcggtatttatattaccataccccgcggtaaacccgataactacggtaaccaccggtaacaagggaaaccctagagcctatacgttactaacccacgtaaaaaaaaaagatagtacgtccgatgagcttcttccgtggtgacccactgaacctggtgcgtcaaccgctagctagctgagctctcactcaactggagagaaaatggtgatttcagggtgaagcaataattgaaattaaatttgaaaatatactttttattttttttcttagaaataccctatatgcaaattttgacacaaatatactgatggtttctctgaaccgttgtgcgaaagtgacgatgtgaacggtctcgcgcaacaagtctgcgagagtatttcaaaaattaaatgattaattaattataatcagttattaattatcttaattagtctcgcacggtctcactcattctccacgtgacaccataatatcgacatcataatatcaatggtatatttgtgccaataaaattacatctagtatatttctgagaaataaaaaataaatggtatatttttttaaatttaattcacaataattgtgttgctccactattcccttcgtccgaaaatattaaaactagaatcgaataggatattttctaatatgatgtatctagatatatgacatgtttgattggagggagtttttataatggattggaagtttaaagtgatgaggttattaactgttttgtttggttgggatacatagtaattttggtgggatggccggatgtggatggggaattgaggaaggaactacctcattttcaatacctgggtaggggtggtaattgggagataattccttatttattttgcctaaataaatcttaaccatctgtttttattaatgacccgatctctaaccaaacttcttatcgactttcaccacctctaccaaataagatattgggattaaaaattaaattttcatcttaatctcatcatcaatggatcatgtaaactcctaattctcttccctcgtgttgccaaacaagtcgatagagtttggtttcagaaacgttgtaataaacgtcacattcattcaatcctatgtgagcatacatctttgtccaccaaagctaggtaggcagttagcccatcacttatcgtgtctagtattcccttcgcatccatccacgattcatctatcgtcaccatccagctgatccagcgaacgcacgtatatattccccttctccatgccatacgcaatcttgatcaacatgttgatcaactaatcacttcaattacactctcagatagctgcttgggttccccaagatcggtgcacgatcgcaattaattaatcttaatcacatctgtacagtacacatccatccgacaaatgaacggatcttcgcttgcaggagatagatagatcgatcgatgtcgtgctattatttctcttccaatattcacaatttcatccttcccttcgatctcatctcatttgcagccatggctgggagatgcatggcgatcgagaagaaacaaaagaagaagctcaaaatcataagaaaaagcgaaaagaaaaatctaatgggtggccgtggctggagcagtgcggccggcggcgaggctgctcgggtgggcgcgagcggcggcggcggcggctgccgggacgacgaaccgggaggagaaggagtactgtagagagctgcgcggcgtcggagtcgtcgtccagcccgccggcgacgtagactccgccgcggtcgaagttgcgcgcgtagctgagcgggtcgtactggcaccggccaccgcggagccggctcgacgccggcgccggacgctccgcgcacagcgccgcctgacgccggaggcgccgcaccagcctgcccagaccgcagccgcaccgccgcgccaccaccgccgccgccgccaccgacgacggcggctggccgccgacgccacctcgcccatccgccattgccggcttgccgctgagcggtggcagagtggagtagtgagagagtgagagtgtgtgctggctggctttcttggtaggtgaggtgaggtgaggtgagatgtgtttatttataggtccaaggttaagtcaaataaaatgtgtgtctgtgagactgtgaccatattaaaaccatacaaaattacaaatcatgatttcaaagatgtccaaagatactggtgtcctagtactccactagtttgaacaagtgccaaatttggttctatttgtaagggctgtttagttcgcgaaaagaaaattttagggtgccacattggacgtttgaccgaatgttaaaaggggtttttggacacgaataaaaaaactaatttcataactcacctggaaaccgcgagacgaattttttgaccctaattaatccgtcattagcgcatgtggattactgtaacacttatggctaatcatggactaattagactcaaaagattcgtctcgcgatttccgtcctaactgtgtaattagctttttaaaaaaattctatatttaatgtttcatatatgtgtctaaagattcgatgtgatgtttttggaaaaaactttttgggaactaaacaggccctaaattgaaacaaattcagcacacaaactatgtgggtttatgcctggactggggcactaggtagcagtaactcggagtaatggtaagcaggtcatcgtccgtagtacgttgctaaacgctggaaactccatgcagattggtttcttggttccagaaaagtcgaaaacggtgggcagcgtgtggtccaacagcaataccatggattagtgccgctcatgcttcggagaaaaatgagtaactgacacgtggacccatgatggatggtgagcctcagcagtcaggaccttctccttccgttttttttttttaaaaaaaactctaacgataagatacatgacgttgagtttcactagttaggaatttactgtgtccacgcacaagcggcgcatgcagccacggcggacgccacagtcgtcatgggccgctgcttgtcgcgccgcgccaccgatgcgatgagatccccccatcacgcaccgccgtggcagcctcaccgtgcccacccacgcatctgatcccatctcgcaaaccgtttttgtttttttgtttttccccttttttgagagagaaataaaactgcgtaaagtttttcaagaaatttccaggcagacaacggtttcatcctctgctactgcgacgtcacctttgaaagaacaaattcttctccaacaaaaatcgacccaaatttgcagcagtggccatgcatacacatccacgggaggacagacagtgtgcatgtgaatatgctgtgatctaatgggcaggcaatgggaggacccacgttgcacacattcttccctaaccaagatgccctgtctctctggattatagtagtactaatcacactcccctgaattctgcgaatggattggactgatgagctgagcttgttgatgagaagacattgcttaaagcgaacggctccatgattcctaaccagtgtagttgtagtactagaaaagttggaaaaagttcatgcactttagggtttaatccatccatcctggaaggcaactgccgacaaggttgccctggagcccatcatctccagtagtacgccgatgagcaatcgatctgatgatccccatttgctttggatcctcagcagctggtggttcatgctacagttctgcttgcttgtcaagatcgagctcacatgctcgcactgtttggtttggtgattgtcactgatttgaactggtacaaagttaatggttaacttaactcaggcagtgagatgagatacaactggggaaagtgtctactagttgcaggtattctaaataagaatcacatgagatcagcaagtttggaagaaatttttttttatggtaaactggcaggaataatcatcagatggagtcaaacatcgcaatttggcatgggatcaacagatttgtcggctacgattcaagctgccaccatttcttgctgcgtgatatataaatgactgtgaattcagtactgggggctctgcaatcctaacacgataacatggcactgttcagaactgcaacgtaacagtgatttttgggtcctgtttcaaaatctaagctgaaatcgcctatagctgacaaatctactccaaaaacatgtattggaccatgcctttctttagtaccaaattccagggctcatcataggaatgatataaaaaataaaaaaggggaccctaatttcatttgagatgtataatgagccataagcaatatgcctgaaaattttacattctctagtctgtaatgaagaactaacaatcctccatgaaacatttttcctaaaacagtagtcttatgtaattgaacctttttcctttttaattttgtttgagtcaattccttttgggtatctatatatcaaaagtgatttttataacataccggtatgcagaaaaaaaaaggccgttaatatatttagtacagaaaagcaaaatatatggacagaagaagaggagggcatagctctgtgagcacccagtggggatcaaccacagttgaaaactggaacacgagcagggtatcaaatgaccaaatatgtacaaatggaatccaagcaagcccgttgctagttagcgttgaatcctttgagtgggagcctgaaattttgcagaacagacgccattaatagttcactaatcatggatatacctccgccgtttcacaatgtaagactttctagcattgcccatatccatatagatgttaaggaatctagatatatatgtgtctctaaattcattaacacatatatgaatatggacaatgctagaaagtcttacattgtgaaacggagggagtagcatttttcttttgatattaatttatatagagtactgatgatacttttcaaatttaatgtgcagaaacaagagttagataaatacaaacaaacgagaaaccaccactgaatgttggtatagaacttatgagtaatgactgcaactggtgcccccagctcaactattccaagttgactcaaattaaagaaggcttagcttactacttgcgatcagaattatctggaaattaaaggtgcttttcttttgagaacccacaggaaatctgtgtgactgcgccatagtacttggaagaagagaaaaactgtggcagacaaacccagaccagcaaagaagaaaaaaattggggcatccaaaacaaaatcacatctacccttatgcttaactgcaagtgattaccttaaaatatataatactagatggactgccatatcatctcatatcaataaatgcatttttgcaataatacaatccaactgcattctctgacataaaatgaggagagtttatgcatcaatgtcaaaactcacatccaagtgactattaaagattccaaggtactccctccatcccaaaatataaggaattttgggtggatgggatgtattctagtactatgaatctgaacatacttcatatccagatttgtagtactaggatacgtcacatccaaccaaaatcccttatatttagggacacagagagtatggaataggtcaatctgtcggctagaattgcctatctgatgtgctactgctcaagtagtaacttatcccttatctataagaataaaaatcagcatgcactagtctgcacaaactgttaaaataaatattatgccaactagggagggactagctagacacactacacaaaaccatacattgtgggatgaagggtctcgtaagacaaccatatcagtaaaataacattttcatactatgcagtccttgctatgctcagacgtatttgaattgaatgagataatacaatgagaaacatgcacatcttgtaaatttgaggtagcaaaataggatgaaaattgtacttaggatcaaataaataccttcaccaaacaaagacataagggcacatcaggacaacttttacaaaatacaacagcttgcttgtccctgaaaaggtacaatcactcagttattttagtatagctatttcataagacatatagttacaaaaattagagtagttttaaagctaaactttaaaaacatgtcaaaattgcatttttgagtaagtttgaatatttgatgtcaatgctactaaaaatgttgatgagagctactcacacacttatgctctcattttttgattggtcagtaaggcccaccttataaacaaaaataccattttaagttaacagcaaggagaagcatacttctttggatcttggtatagtcttaaggcctccaggaatttgttccaaaatgggccagtctcctgaaggctaacgttttctggtcccccaaggtatgcctgaacaatgaactcgtgacttctttctctgaaagagagaagatagaatgtgtcagttttttttttcatttcgctagtacatttattcactatgctgaaaacatgttagcatttaatctcactaaccttccttcatattgtgacaaccatcccaagtaagctgcgccaaagtacattgatgtaaaaggattgtatagatcatctacggagctgacagtatacgccctatggccacaatctctgcaggaaaaagctaactgcaagtgaagataacttcatgaaaactataatattataaccgaccgagagtaactgcagtgtgtcttctgatagcctaagcagctaacttctcctatgcctatttgttttccagattaatcttctctagaatatgattgcctgacatctgaagtaacataaactagacaagtagtagaccaaaataaattatcatagtttaaatcaccatatgaatatgtatgaaggtatagtccaaacaatagttcagccatcctgaacagtgcattactctgtaagcattcataactagtaaaagggcaaaaggaactggtaaggtcctactaggattaagcaaatagctcaccaaaactgttagacaaaaagcaaagctttatagataattaaaacacaactgtaaacttaatttcatgcttgcctgtaaagccatgctgcagtagggtagtctattcccatcaagccagtacgagaacgaacaccatggacaaaacgcatactgcacacctcagcaagagcagctagggcttcctggcagatatgaatgagaatagagaatttactaaatatctcaagctttcttggaatgctaaaataagagtaaatactgttattgtaacatgcacccaaataggccaacaccatctttattcaccattttgaccaggacatatatactaacacaatctatggacatttgcataattttagaatatccacaaaatagagaaaatgctttgttgacaaaatatacaacaaatccattaactaatgcaatgatgttacatgaatcgacaaccaaaataagatgagttttatgtaaaaaaagaacaagatgagtatcagcactgatgtgatggataatcatgctaaagtactaaatgtatgacttagaaaagcaataccatgcaacaaagcaaataggttaagagccaaaagaatttcttcagtttgcctaaatgttggcctcatcacatatttaaaataagggagggccatgttataggtgatacagaaagcgatataaaacaacaaatttaatacataattagtatcattatacagatactatatgttcactgatttataaacaaaaaaacttactggtgttactccttttgagctcaaatgacgtgatatggttatttcagcaacagcctgagaaaaaaatttacaaccacgtaagtctgagatggatggaaattaagtattggtgaataaaataacaaatacatgaaacctgcaagacattttactggtgagcagatataggattattgtatcaaacaaggcatgagtctgggattgttccaaaaagaaggaatagctatggcaccaagtataagtaatgcttctgtgaacaatatttgtccatgtaatttgtatggcatgataggaaatgtatagcactgcagccacacctacaaactacaaagttgattttattacatgccatccacacgagcagttcacttgatcaaatcaaggatgcaattttaacagcacaagaatattaataagattatagtggtagctttacacaaaaacatatgtatgtcaacattttagcatggtaaaaaaaggtggcccgtatactgcaaatgcaaagtaactacaaaaaatttaaagaatcatcttttaccttcacctcaactcgagaaagataaggcctcctcttggagtcatgagaaaacctcacatttcctcgcctctcaccagattttgtccactccttaatcacatcgggctgactccacatcgcatccatatctacctctgataccttggaatcccaataaatcaactgtccttctgactcaaatgtgataacaagatgtcagcttgaatgttagaagcatatcaattctctgggaatcataaaacgaagggaaaacaacttcacatctaaatcataacctagtatttgctaacatctcgacaaaccacaaaccttgaatagcagaaaattatttaaataaataaaaaggtaacacagtaaaatttaacctgtgctcgaggaattggctaggagattaggagttaaatcattaaaactttctggctgtctgcagacaaaatagcaagaagcagtttgtcagcaagttcagaactggaactaaagtaaaataaaataatagctcctctacaaacataacttttggatttcgatccattgaatatgtttctaaccctaacggaaaactcagaagagcttgaaattctgaatatatttgagaggccgagcaaatgatgcaaccatcaagaaacactcatgtttgaattaagaaatatcagtgttttaattaacttggtatttcgacaggtcaggtgagcatgaattacagtaaagaaagtcactaaacatattgctgtccatcatgtgtttaacctgccagcatagaaggtccacatagcacagctcaggggtcaggttcaggggttcaaacttgagatgaaaactactgttctttaaattatgtgacatgtcataagtaaaattttaggttttttacctcaaatcttcaatggccagttgttttgagaagttcaaaccaattttctccaacttaaaggtttgctaggcttccaaataacctcaatacctctaaaattggaccttggaggttcacaggtgctaagagaaacgaatttgtttagtgcttaaggcacacttttcacagaataagaaagttagaagctgaatatggaaataaattattaagggtgaaacctcatagacagcaaggcctccttcacataaagatagcgttgaaagatgggggaagttgatttgtgaacagccttctttttgcctcccttgtaagctctaacaacgaattcttcagttctttctctgaagtgtttttggcaagtaattatgtttggcagtagaagataaaatatgtcaaaggaaattaattgcaatggtcaagcataatctgacaatcaaaatacatacttatcgtcacatgagaatagccattttgcataagcagcaccaaagtagacattcacaaaaggccaatagagcaaattagcatcttcttcaatgtcataatacttgtaacccaattcccttgttaaaggtaaagaaaacaaatatttagtatgaaaacatagaagaaaagatagttactaaatctgggttatcaaggtttcatggtacctgccaagccattgagcaacttctattgtcacctgcattatgccagctttgatctccttagtctttcggtcataattatcgacaaagagtctccttccacttgcaatttctgcaagggcacctatcatatactgcatgagtgatgaaagtaaaaaataatgtttaatgtacttcagcagtgtctttgatacatatacaaatccaaatattgataagtcataaagcaaaagaagcaataccgggtctagctgtgacttgaaatgcttatgaacagtaattgcagccaccgcctgaagaatcaatgaatttagttttaagccaaaattgtacagataagtagataacaagtacagttttgaaaaagaaaataaagcaaaggacccttaatttgttattgtttccatagcttcgaaaatttgtttagatcagcgcagcagtaacaaagttgtcaacagtaatttagtcacttggataaatataggtaaaaactattatgttagactcttaactcacagcactgattgatttttgtcttgtttaaacttcggtgaatcaatttgctggcactagtataacctgcatttaacgccactacagcataggtacaaggaaattattgttcaaaagtaacaaccaagtataatataaactgctcaaaaaatagacacgatacgtacagaaatacagcttgcgaaaaaataaatacaatgatttacatgaactttggttttttttctttttagataatgacatgaactttggtttgattgccactaatgcaggttttagatgtcaagatacactggctacagctgatcactcaccatcatttcagtttgtgtgagatatgcctcaccatcaggatcccgtgacaggtgaaccttctgtcccggcccttccccagcatcaatccactctttacttacatgaggatcagcccacattaattgcatatcctctggatccaagcagtcatcccaatatttgaagcttatagccattttgtactaattagcaattgtatctgtcgatctacactgggagcaacaaatatgaaaattatatgcaataggataacttccttaaagcaaaaggaaatccaatgtgccaatctgcattttgttcagggttgacatagagggtgatggaattttgaacagttagaagccatcaaataattaggaatgggaacgttgccaaaacaaaaacaaaaaaagaaaagaagtgagcaaacaataagaatatgttctgattgcatcgtaatagatgcgaaaagcatccgcgcttctacaaccaactatgcattcaatttgagctcatagcaacaacatggagtaatcactgaaaagtgacagaaataattgcttcaatcacagttacaggataagtcaccccagaactgcatgctgaactcatcacccaaaaaagaagcaaacagggttcatgatcaaaccacaacacaaccaaaccaatcatcagagacgcatgaagcacatataaccggggcaattcaccccagaaacaaatcagcagaatcaactccagaggcactgtatacacaaccctctgaaatttctcaaccatgttacaccgaactattcatattacgaccgaattgacaaaaactacttccactccacaggcgcatgacaccttataaatcatgatcactgccttccaccgcaacgcacctcaaaatcacatgtatgcacaatcccacgacactaacaagtaccggaatcatgaaatcgaccatgggattggaggcagtaaacaaccgcatgcctgcatgatgaagcaacgcatacacaacccaaaaaaaaaaacgcagaatccgatagccacacaaattgaatggtcaccccaacccagcagcagcagcatcgccgcgtcacggaaccagatgcccacacaccaaaacaccatagcgtcatgcgcacgcctccgcgtccagcgagaccacccgcaacaaacaaacagcagccgcaaccgcattcgccgaaccaccacgagactagacgcgacgacgaacgccgtcgatcccatccatgaactccatgctccccatccaaaaaaaacaccaaaaatcatcgcctcgctcgctcgctcgctcgcgcgctggatcaccaaataaagcgcaaaaaaaatgaaaaaaaaaactgaggcgggatcggaacgggagctcaccggcgcgcgggattgggagacgattcggaggattggattcctctcgcgtcgacgggggatttggttttgggagggaatggcgggttggtgcgtgcgttggtggaatggggaattgaggagagagagagagggaagggaaggaggggagagagagagagagagagagagagagagaggcgcgtattgccgtttggtatacaacgagggtaggggtggcaggcgcgacagtttaaatgtcggggagcggggacacgtgtcaggtggttagggcgcaatgcagctggaatttttttcgcgagcaaattgcatactttggcttttttttttttttgcaaaatttgctgtaggacatctaaaaaacgctaatttgctataggacaccacaaaaaattggtaattagctgctggacacctgcagaattattttattatatccggagaaattggatagagaaacaatcattaaagacaagttgcccttggctcaaatgagtacaaacgtgggccccacatgtaagctcaaatgtaagccccccctctttctccccacgcagggccacgtcgaccagctggaacacgccattgcatacccacacgaggacggtgagacgccacattcttcttcgaggcgtcccggtgacactcatcgtgctactgctaccgccgcagccgacctgcctccaccgcatctctctcgtcaacagtcggttcccgccgcgtgctcactagccgccggttcctccaccatttcagcgacctccacatcagcgcgccaggggctcccctcgtcgggttcttccacaaccacaaccatggcgcctgggcgaacaaccgctccatccctatcggcatcaatgacaccggggactgccgtcggagccaccatcgcggcgccacgacgcgtaatcctgacggggtgttcgccttgggcgacgccgccgagtggcacgtcgtcggctcccgtggcgggcgcgtcctcctccttagccccacccagctccgcctcctcgtgctagagcccatgcttggtcgccgccagtacatcccggtgccaccggcgcccaagtacaggccgtcatacttcagcaacgcgcaacaccgttccaaccgaggtgcccgcactggcccgcgcctcgtcgcacgatcaccagcgctccctcgggctcgcttgaagagcagagagagaaagagagaaagaatgagatagagaagaataaggaagaaggagcagagaaggatagagaaaaaataaaaagaaaaaaattcgaagggtagaatcgtacttacacagttgtttctctctgcaatttctccggatataataaaataatctcgtgggtgtccagcagctaattaccagtttttggtggtgtcctatagcaaataagcgtttttgcagtgtctcccagctaattacacgtttttttgatgtcccatagcaaattttacaattttttttactattgttataacttaaactatgtatgtaaatggaccatgtatgtttaccaaaattctgccctacaggctacacctgttcttctacctccagttttttctcttctctagttctcttatgtttctatggagggtgaaagaaccaccgatgacagattggtagctaatcgagcatccaccggccaccattgccatgcgcttgagatgaaacttgaatctccccagcctatgttttcacttgagctaaaaaaataaaagaaacaaacaaaaaaaaccaattgctaggatagagggggacatgtggagctcgagctcaagcgatgcgtcaatgttggcaaaggttgagatggagcatggcgctgatcagtcgaactagagctcaagtgcaacatgaaagctagtaggactcaaggtggagcacatcaccgatggaggcaaaagatcaactgcggtgatggtgcctacggagctcaaggtggagtgcatcaactaagatgcttgtgctcaaggttgagcacggggcagaggtctaggttgagcgtggcaagcacactatctactagactctagctaaagacaacatcgacacttgtggcaaggttgaggtttcccgcacgcactacactagctagcctcagaactcgaggtcatcattgacggtgccactgatgatatgaagaggatagagcagagggagggagccgttggtcaaaggaaagaggagggggatccagattccaggacagagccatataaggcaagagtctcacgtatggttctcttgagaagagcgtaataccaccaccgatgagagaggggagggagggagctggagaaaaaaacaagtccaaattgaaacaatttgtcaaaataggtggtccaaactagaaaggtttggttacccttgatccaacacgtaagtgtggtaaaaaaattcatatcaatccaataggcaatttactgttatttctcatacatatgagcatgcatatccacaattaatccttctattcacatgtttaaaagaagacgaccaatgataaatatgtgatttttttactgtatttatattttgtataggaagatcatacatatgttcaaaagaaaatcataatgttgtgaccttactaaattactattttatatttaatacatgggtggtagggtttgataatggataccagttccgctctcatgtggctttgtttattgccatttcagatacgtaatttcgaaactctgcaatttcacagcattattgtaatatatctaatacaaaatatactagctcctatgagataagaattttgataaacttcatggattctttgcaaggtacaaacaattttgtttcatttcagtccaactttatctgtgcgtttttcacattggaattcttctccccatgtttcaaaatagaagagctgtgctattgtcttctgacctagcaccacatatgcaaaatatgaaaccatgcaaggatgcattcactattcgatgataaacaactcaggttgtgatattacttacactgtactatgaagatagcatttgtatggcgtggtacgttaaaaaatcggagggagtaaaattgttttctctcgtggcagagtaaatttgaattttgcaccgctcaaacatcaaaagcatggtcctgttcggaccagaatggtacggctctgatgctctggcacaaatcatgttcttctcgtgtaatccctccgtcctggggatttttgatattttacttttactgtttgactacccatcttattaaaaaaaattatgcaaatataaaaaccaaaaaagttaggctcaaagtactttggataataaagtaaataaaaaaataaataataattccaaaatttttattatcaaccaacaaatcagccagccaaaaggcagcttgtcattacaacttgatcgattacttataaataagctgtatcatactattatgtgatgaaaaaaaatgattaattaaggatcctttcgttcaaatggatccacaggggtttattcgccagaaaaacatcgaggtgagattaattcaaaaggtggttcacggcaaaaaactgtgaaacatgtaaaacttcaccaaaaaaaaaaagattctccataatgagttgataagatcttacattgcttgtccttttcaattagacatgttgacatggcagtaggaaaaaaaacatttacatttattttgaacagtgtatggtttgtcattcatttgggaagcacccgtttggccagttcttttcttttcctctccttttcatttcggtccttttctgctttggttggttcgcctcttatatccttttttttctttaattaatttcttaaagattataaaagctcaaatctatggtagaaaacagaatgcccgaactttaaacaaacaccaaatacactcattcgtcaacgatgtaatggccatcatagacgaattagcatttagcaaccagactattgacaatcccttcttctccttctccaccttcccattagccaacaaaaaattttaaacaaagtgaatgaaaacgagaatctttcttccatttctcaatttaaaaacaaaaacaataatttaatgacaggagaggtgaggttgggggtccacaaccccagagagtcgggagggcgagagatccgattcggtgcggggtaggcgacccacctacccattctagtaccctctctccctcccattttaaacgtagctataaattttcgtgtttaattttaatcgttcattttattttataactaataattttatatagttattagatgataaaatatgaatattactttaagtgtgactcataattctattaaataattttttaaatataacagacaattaaaattagacacgaaaactcatagctgcgttttttaaatggacagagggagtattctacagtacaacattttccttttataaaaaggagacgagacgagtcgctcgcctcgccgccaccttccccttccccccctccgccgcctcctccgccgcgaaacgaaaggcgagctctctctctctctctctccgcggcgcggtcaaaaccctagcgcgcgaggaggccccccccatggcgcagcagctctccgcccccttccgcgccgccgcggccgccggatcccgcgcctccgccgccgccgccgatcccgccaaggtatcgccctcccttccattcctcctgtgctccctctccctcaccttcttccccaccccccctccggaattttccggtttgttccgcgtcggggttcgattggcagagggttgggacgtcttcgttcgttgtgtgactagttgtgttgctgatactgcgcctagatttcgtcttaagcttggtttccgtgaatctgggaaccttgggttggggggggggggggcaaatgctggggttcgtttcttgtttatgtgcgttctccctggttgcttcgtactataatctgttcatttctgtgctggagtatggaggttacttttatacatactagtggagaatcatgtacccaggcgctttattgttatcagcaaaaagttctgtactgttatcaacatagttgattcttggtcaaagaaatcctattcacactcttcaattaagatgttaatactattcactctcttcaattatgtgttgctcatagttagtttgttggatttttagttttttagtagtagaaagatgtccctcctgttgatgcgatttgcctgctatggaacaggtgttacgcttgagaagcgctggctcagctcagttcacctccatcgcagcttcctcttcattgtaactgcctgcttctaatgcctatttcttcctcttcgttgtaagagcgcttttttgatctgattatgttttaacgcatctaaataatttttttaactcaagtgctaggaacattgagccgctgagagcgatagctactcaggcaccccctgccgtcccacgtaagtgtctggtttcccaaacaaatgtgtaataatagaattgtgcaggcagcagcatttgattattcctttttgtttctgtctgtagaatattcgagtggcgagaagacaaaggttggcatcaatggtgagttgcttctgtttattctaggaactagtccattaattttaatgggatatattaatctgtttattctaggaacctagtccattaaaaaaattgctataattttaatgggatatattaatctgtgctggccaatgcattttgtcttgcatgcgttttttcttttctttttttgcaaatatatgatatcaattgcaactgaatgtgttagttcgagttccatgtctttaggttttccaaaagcaatttttagtgctcagttaggtatatgctacagcaactgaatcacccatggcttgttggcagaagtagtttacagtttattgtaccatacatcaaaagtaggcgaaataatttattgctatttgtttgtaatgcttgtcttatttttttggtatcatagggtttgggcgaattgggaggttggtcctgcgtattgcaaccagtagagatgatattgaagttgttgctgtcaatgatcctttcattgatgctaaatacatggtaagaaaatagttcaaattatttgcctacctcccatatttcataccttggttgcttcatttaatcaatgaacattatattttcaattttggggggatgaagttttgcttgcatttgctacactgcattagcttatatgatgccatgttacgttcttttaggtttgtaagtgttataaaccttgacgaaaagattggccttttctcagcttaagctaaattaagattgatgcagataatattttatttgaaatcattgaaaaacctacttaatgtgcattcaccttaagttacttaaatatgctatgcagtccattgtgctacatttcaatttgctagttatatattggcacagtttcttggttcttccatataatcacacgaaactgcatccctaccttatgtgttcggttcaatgaccataatagtccatttcaatgttttactcctaatgcaacataattcctgtcactgtgggagtaccaacccatccttccatgcggatgcaacatttggttgtgccttttctttctgtagataatctctttcttttttccaggcctacatgttcaagtatgactccactcatggtccatttaaaggctccattaaggttgtggatgattcaaccctggagatcaatggaaagaaagtcacaatcactagcaaaaggtaatatcaagtccacttagggactagtacatgattacatagaatgtcacaattatttgttatctaagtattgtgtttgatgattattagtaaaaaaaaaccctcttgaaacattgctagtaaatttggatctcacaattattgaggtattgcatcactgtgttcccatgccatcatggattcaacctaaaattctttggatcactggaaaaataattattgtagcctaacgtataatctggtcttttgtcgtatcactgcttacttgtatagtcgaatatattacaatgtgcagccttgtgaaataaagaaaagtaaagtgtctttacgactctaaccatatctggagtatggagtgattgactgaacatgctatacggatttataattgagtaccttttagtcctagctcctaaagtaactcagtattgttgtgtacgttgtacatttggggtacttcacaatcctttcttcaccgtgcccctgctctcgatacacaattatgtttctgtgactacattaatttctgttagttcttgcatttgcacctaagaatttgcccccttcttttccagagatccagcagatattccttggggtaactttggagctgagtatgttgttgaatcttcaggtgtttttacaacaactgaaaaggcatcggcacatttgaaggtttgtacaccatttctatacattgccatctaactgagaaatggcaagcttttatattggataaaatggtgatgtttttatgccttgtttgtagggcggtgctaagaaagttgtgatatctgctccatcagcagatgctccaatgtttgtcgttggagtaaatgagaagagctatgatcctaaaatgaatgttgtttctaacgcaagttgtactaccaactgtcttgctcctcttgccaaggtaacttatctatttctaatcctgttactattttcccattttaatcataacaaacaatttgctcttgtgatttttcatattttcgtccatccaatggagctaattgatattccatggggtatgcaggttgtccatgaggaatttggcattgttgaaggtctcatgacaactgttcatgccacaacaggtttctttcccttatgaattttgtcattgtcaaggatggcgactgccatttttcagtctcctcatatcatgttgttcattaatcataacagacttgcttttctatattcagccacccagaagactgtcgatggcccttcaatgaaaagatagagaggagggcgtggtgctgctcaaaacataattcctagttccactggtgcagccaaggtacgatgaaccaaaaatctaccttgcttttctagatttctgttttggctgactgttttgattccttattaggctgttgggaaagtcctccctgagctaaatggaaagctcactggtatggccttccgagttccaacaccaaatgtgtctgttgtcgacttgacctgccggattgaaaaaagtgcatcctatgacgatgtgaaagcagccatcaagtatgtaggactatcatttgtccatgcacattatctgctgtttctgtttggtcaattgttttaagtcttaaaatgcttgagttggtatacagtagccttcaataatttgaacgtgaacagaataatacttgtgttcacaaatgaattgcaaaagtaacatatcccttgttacgtcttttgactgtgctagaaactgcggtcatgcacttgtaccgtctgaagattctgtgatgtgcctgtatgtaacattgtgaatcttttatcagatttactcataagctgtgtgtttcagggcagcatcagagggtgcactgaaaggtattctaggttacacagatgaggatgtggtttccaatgacttcgttggtgatgcaaggtaagtacttctagatgtaccgatgtaaattgtgttgtgctcaaaagggagtggttgacataactgcccctttctgcatatcaggtcaagcatctttgatgccaaggctggtattggactgagctcttccttcatgaagcttgtgtcatggtatgacaacgagtggggctacaggtgagtgtctatatttccattaaggggcttaactcttcatctttttttccaattgttctattgtcctaatgattctgttccattctttgtttcagcaaccgtgtgttggatctgattgcccacatggctcttgtcaacgccaagcactgatttgttgaaaatcctcctccgatagtatctagctaggaaaggctgcaattttgacggtctctttctgttgtcttggaataagatgtaaacttggaaacaaagcaaaaaaagaatggacattgatgtccatgacattgtttgtagcaggcggtgaaatttactctgtatcgacctgggcaagcggaactgttgagtgaaccatatgtcggcaacctgattgattcattgagtccaatgctatgccattctatatttactttaaacatgcttgtttcatgccagaaatgttcaacagacaattggcaatttacctcaactccagaatctgcagaattttgtttcaattcagcggcttgttgagagtaacagcagagaattatgtaggctgttaccaagagggaaagtttccggctattcaccttcaataaaatcagcagcagcagcgatcgaggagaagccgaaggtgtgccagagaagccgtgccagaggagccgtacgtgttggtggccataagtcggaagcaaggctatacaattgcatagttccagtagcttcataattactgcttttcattgaccatggttcccattcgttattctctctatccatcccagttttatatcatatttgtaaatggagccgagactaaagcaacaaaatctccttccttcttaaaattaaatctcatcggtcaaggtacgcaaacgtgcagacatgtaacgatatcatttactcctatacacgtaaatgaataagcatgcagcgatgtcatttactcatatacaaataaacgattagatgatgattaaaaagaccttaaaaattttagacaatgatcaaattggaatggagga

SEQ ID NO: 58295 - DNA, 7589 bp, Oryza sativa
gatggggagggatcccgcgtggccgtgtgtgtgtttctaggtaccaataggtaccaaatttacaataaaaaaatggtacctcgtggtacctcctcaaggaccgtaaaattgctcttaatagtatagtcaactactagctccaaatcatctatagccaatataatagctaattcatataatagctgcttattatactactaatatctggtcccacctatcatacacacattatgtcttagagtcagtgctgcagctagctacagatttatagcctgatgctcttctctttctttctttatctctttaaaatatgtttacatctgacttataacttgctattgtacctgctctgggagaggggccggctgaggacaagccggcaaaggatatctcccaatatgtgaccacgtggtcaaaaccactctcatctcatcgccacataagttaaaaccacctcgatcttatacataaggtagctagagatcgtcccacaatttcttattctttatttcattattgagtgactcattggttgtttgttttatggaaaataatagcaaaatactcatagtctgttatgataaaatgtacatactcatgtgtgtgtgtatatatatatatattgttcacttgatttaaataaatattagattattacatagtattagaatatatcaagaactaacttgtaaggtggtggattggtggtagatatcagttaaatgcctatatgttccaacgggaattaataaagactttaaaacctcaaacactaaaataaaattatccccattgtaaaccatctataatatttttcaccattttgtatctcactttaaaataaattttccttgtttgatggcttctggttaaggaagggataaaagcctacctatctcactattcgggggaccaacatggtaatgatggtgggtagtgacatattcagatataaatatagatatagatatatataatgcatttctattactaaaagtttcaagcatatttttctgtcataataatatatctaatcgtcgagttagagtgtttccttgctcatctatatctatacctattataaaaattcaatgtgtttttgcatgaaaatttgatacatcatctatgttagaatcggttttaattaaatatgtttccgtatcagaatgtttgttttatctgtattttggtttttttccccttggcataaaaggggtgaaaaaaacgtccgtaaaaaaagaaaaaaaaagagcgaaaaaggtcccaaaagaaaagtccgattccctgcgaaaaaagtcgttcgtaaaaaaaataaaagaaagcaaaaataagatctgattctatgcaacgaaaaaaagaaaaaaaagaaaaatacgtaaaaaaaagcgaaaaaaaggccgtgaaaaaaattatatccaaaaggataaaaaaggctaaaaaaacaagaaaaataataagaaaggcaaaaaaatatgcctttcaaaaaagaacaaaacatttccatcataatctttacctattatataaattaaagataatttcatactcatcgtattttcggccgttgtcctttcattttaacgaaccgtcctattccgatttatatatgtttttagcgttgtgataatattcacgttttgctttttatctccacatccaatatgtttctgcacatatgggcctaaaattgtaaaagggtccaaaatattgcccatctgttgacgcgaggctgtctcggtgaaaaatattgcccatcttctaagcatatgtcacatactatttatttcagatttgtttgtgtttattttaataattttgcacacatgcaaatgcaaagcatactaaattttgtatgggcggctttcatgcatgtccgtttattttgtaaaagattcatctacgcatgattcttttcaacattattttttcaacatatgatttcgtacggctatttaggattaagtgatttattattaaaactgaagttgtttccgccggtagttttggtacgttgtgtgtatttaagttggttttaaaattcgttcgcttttaaaaatgcaatggtttaaacttggatatcaatctcaaaataaaaatcacatatacttttttagaaaaaaaaatatatctaacaataatacgattaaaattagtcttcatccgttgtaacgcacgagcttttttttctagtaaaagaaaaagaaaaaggacggttgcaacgttgatcagagcgagagctaattaattaacgagaagcgcgcaggtgcgtcgagtggcatcgggctggagacggcgcgcgtcctggcgctgcgcggcgtgcacgtcgtcatggccgtgcgcaacgtcgccgccgggcgaaatgccagcgaggcgatccgggcggagatccccggcgccatagtccatgtgctggagatggacctcagctccatggattcggtgaggaggtttgcctccgagtttgattctctgaacctgccgctcaacatactcatgtaagaacagaaatactccctccgtacttataaagaaagtcatttaagaaaacgacacggtcttcaaaacacaactttgatttattatttctataaaaatatttattaaaaaatgatatatgtatacttttataaaagtatttttcaagacaaatatattcatataatttttacattttcaaacttaacaacttgagagttattcatgatttatattctcaaggtttgatttaaacattgtcctaaacgacttcctttacgagtacggaggggtatactccatattaaagtattaattgttactgcccctgggcataaattcttcggcgtttaagacctaattgtgtatcaataacttctcaaatgcctcattgtaaaaaaaaagaatgtgtgttgttttgcctcaaagtattatcatagataatgaattttgttgtaaaattgatggttagagttttaaaagtttgacttgattttttcgcatatgtgagaatatttatggccgtagaaagtattatgattgtgtcaactctaacggcaaacattttactctgtttccaaacttcctgtgacgacagtaacaacgctggaatcaaggcatggggctgcacacggtccgttgacggcctggaattgcattttgcaactaactacattggtatgcgaaattacaatgcattaattcttcatgcatctcaatcttgtttgcctactaagtttcctgtgtgatgtggttaattagttcttgagatttaagggttgattatgagttatatgctcatagtgcagtactttaatgtcaggccattttctactgacaaatctcttgatggagaacatgaagagcacaagtagtgaaagcggtgttgaaggaaggatcgtaaatgtgtcgtcttggtggcactttgctatttatcctgaagggatatgtttcgataaagtgaagaatccttcgaggtaatttataaatatatactacaaattaggtcttatttgtttcagcttaagattattaaatataatctagattattgagccagattactataagttagattatgataagctaagttgttagctatttgtttttttattaatagttgttagccaccaaataatctaaaaaaaacaactttagagtgtattaccatattacagtaatctgacttatagattataataatctatcataataaactatctgtttgtttcagcccacttctaacgattcaggttataataataataaactgaatcatacaaggccttaaatacctccctccatttcccaacgaaaaataataataatcttccatgcccttatttgttcttaacagtataagtggcgtcccaattctaacaaaaataaccccttctacattagtcaccacccaagtgtttcacgtactactgctgttgctattataaatacttcttttgaaaaaaaaatattggcaatttttcaaattataatcacttaaactaaaggaagacatactccgcacgttagttacaacttgcaaactattcattttatattttggaattaaaatagtataatataaaatcgagggtccattatatttataactacatatttaatttgaattttaaattattaattttataaaactaaaactaaagagataatggtatttctctatgcatgttttatttcacatgaactctgaaaacaatttatgattttggagatcttaattttaatatggatgctctctcatagtgctcaaataatataaaataatatagatatagagatgaaaaatattttgaattgtttcatatatcccgcagcaaagcgtagagcttcatctaggatactccattcgttttacactataaatcgttttaactttggtcaaaatcaaaatgctctaagtttgaccaagtttgtagaaaaaaatattgacattttaaccctaatacaaatatattatgaaaatatgttccattatagatttaatgaaacttattttcaatgactcttttttcccaacgtgtaagcatgtgtttggtttggggacaaagtgggatgtgttagacctatccttgttttgtgggatgggatgatttcagtagtttgtttggtttacggtatgtgatggttatagtttttatttggtagaagggattgaggtgggattggatgaacgaatttgtactgaccgttaatgccgtttgggggtggaggagctcggcggcgcgagcagaggagaggtggtggcgggtgcggacgagcaacggcagtcgaggaggcgaggcggctcctggatctgagaggagcggcggcggtcgcggaggtggcggcggtcgcagacgagcggtagcggtcgcggtcgcggaggtggcgaaggacgtgaacgaggcggcagcgctcacggacgagcgacggtgcttgcgaaggtggcgaaaagcgcgaactaggcggtggcgctcgaggacgaggtggcggttgtggacgagcggccgtggtcgcggacgaggcgggggagggtgcggacgaggcggcggcgctcgcggagatggcggatggcacagtgacgccgttcgctcgtcccaggtgggacgagttcgtccgcgagatttttacggatcggttggtcccggatctgagagaaatatttctctccagagactaacccatcccactcacttctaaaccaaacattcctaaaaataggttcactccatctcatccaatccttcattgcaaccaaacactacctatcctaatggttcacttatggtcaactgcaatattttgaccatccaaattttctttgtttgatttggcgtccggcgtatgtgtagttgtgcctacatagaaaaggagatgctttcttgcaatcgtttagagaattggatgaccaaaatacttttgttttagcctttgagatctaatatatgggccatttcggctatcaggagttaaaaaaaaatcatggtctttcacttgttaatgatgaaatttgtaactgtatttttattttgagtgtaatgcaggaattttaactttttaccattgtagtattaacgtgaggactttaaggggcctccaattagtaaagataaatatatttattgtgctgatttatcttaccagattcagcggtatttttgcttaccctcagtccaagcttgccagtattttgcactccactgagttgcaattggcacgaattctaaaggtactagtgttgttatttgcttggcgtgcttatgcctaaatttcatatgtaatctctattcgtatatgattatatgtcaaatcaatgaatgctaagtttgaaatggttaactacaaatagggagagggagacggtgttaacatttcggcaaatgcaataaatcccggtgttgttgaaaccaaaatgttgacgcacaacaatattgctaatggtacttcgcataacttataatatacctatgtttataccattatattatttttaaactgttcttatgcatcggttctcttgcagctctagtgttccccattggaagaatcgtacgtaaaactatagagcaggtgactctttaagaagaaaatattatgtcgttttttatgttcttgcgttatgtgtgtgtgtggggaacatattatgtgcttaacctcatggaattattgtttagggtgctgcaacgacatgttatgtcgcactacatcctcaagtcaaggggataagcggaaagtacttcagcaattgcaatttagatagcccaagctcacatgcttcaaatgcagagttggcaaagaaactatgggaatttagctctaaggttgtgtcctaatgtggttattaaagtatagtttgagttacacatatgaatacatatgctattttatttcatgtaaattgaacacataattttcacatacattctaaaagcaaaacgagtgtggttcctccaaaatacatccaaattaaatgttttaactataatatatacatctgcctctaattagtctagaagttgggtaaatagacttcaagcaaagttcaggttcaaaagtagattttataatccatttttgaagtcaacctttgctcgaagtctatttttcaccctgaatttatgaaggcggttttttgcgcatagtactcttatggtatatattttgttaatgatgatcacctaagaccccactcagtgtagatggaccaataggttattgatacggaatattttccccatgtttaagaaaataaaatttgtccaaaaactttatgcattaacattgcttagaccacttgttctgagttatttgtctgtaaataagtagatcatccatttaatagccttcatcatattttatctaattaatcactatcatatgttagtgaaaaatcactatcatatcaatctaaactaccatgaaaaatagtttatagtgtggtttgtcctttctaaaattggagatgaaaaataaccggtattgtacttcgaccaaagattaagggcgacatatggattttacacttacgagttattcctagagatgtaatatgcttcattctttagtaatgtggaggcccacctcttctaagcctgatcacttcattggccgacatttgagtgagtcttcattaagttatggcctccatcgtttcctctatacaaaatcagccgctaccaaaaatttaaattttgaaagttaattttcaagttgatattaattttttttcatcgaagtttatcttttagcattaacatttaaatcgctaagaacacatatattataaaagttttacatacaattttttttgttaatatgtctgtcagtgttacatataagacatattagcaaatacaagaccacccgggaggataggccaagacaatccaacatacgccaacacagatctaaacaactccaataatacaagacaactccaatctcaccgagttcatattcgaggaaatcgattgtcgctcgccgtcaaccacatgtgagggctttatgacgcaaggctgacagagactagattagatcatcctcaatattgtaatcgtatgatattgatatataatggcaatattagctttggcccgtaagaaggggtccgaacc

SEQ ID NO: 58296 - DNA, 10023 bp, Oryza sativa
cgaggtacgagaaggggctcgtcgcgaggtttccgagttcctcttcggctccgggttcgccatcgccgagggcgctctctgtacggtgctctctctctctctctctgtctctcttcgtgttctggactaatgctgtttttgaggggatggctaagtgactatcctatagtagtatagtgctgtgaaatgttcctgattggcttaaacctgcaaaaattatagcggattatgtcgttgtagtaaatccttagaatttggttatttttagattgagttaccaaaggatgtgggccattcgattgtttgttaagcggtaattgtggagtagttagagtttttgacattaccccgtgattcctttatggctgtcctttttttttctggataatctattctgtattgatgtgctggtggttcatagcatagcatcctagggatttggaaataaatacctaactttttaccgctcccagaagatattgcctctggtcctcacttgataaggatagaaatttaggtatggagtgaattttgcatagttaggtgaagttaacagttttcctctaactttgtaatttggttgttttaagctgtttgatgtagccatttagtttctcgtatgtgttgaagaaatttccctgcattttgaattggataggacacacgaaggtattgccttgcaatgttattagatcttatgtaatgttatcagaagtcaatgttattacccatttagtattacagtagcttctcacaagctattaacagaatataggtgctcctgtggacatgaggatattctgtagtgtactagagtagtatttcattttgtagctggaacagtgaaactagtataaaaaaatatgaaaacaaaaaggtgattgtgggttggttctgaaaggtgaaaggttcctatatctaattcacatggtttggtgttttcttacaatcccttgtttgccccttacctttttatgtgctacttacctaattgataatctcttgttcaacttacacttgttttggtatctgttcaggtgagacgtcgatcagttgtaccatctctacacaaacgatttctctcggtgatggttgacagagttttttgtaaatgtgctgagagattagtggagaagcttgagacatctgctttaagtggcaaacctgtaaatatggaagcaaggttctctcaaatgactttagatgtgattggtttgtccttgttcaattacaattttgattccctcacatcagatagccctgttattgatgctgtttacactgcactcaaggaagcagaacttcgttctacagatcttttaccatactggaaggtaatgttccttttgccatgttattttctaaaaaatccaattatggttggcctatctaacttctagtgagacgaaattgctgactgatgtcgctgactgatgtctgatgtagcccttgtttgttcttgatagattgatttgctgtgcaagattgttcctagacaaataaaagcagaaaaggcagttaacatcatcaggaataccgttgaggacctaattaccaaatgcaagaagattgtagatgctgagaatgaacaaattgagggtgaggaatatgtaaatgaggcagaccctagcatcctgcgattcctacttgctagccgtgaagaggtactttgactaatctaaagccttgatgttgttttacagcaattgtagtcttcattgatttttgtactagtaggaagctattccctcatttcatagaattttgtgacatggacttattattgatttttgaatcttataagacagtttccatgcacagttcctttgtttttgtgggtaatactttcacggaatccacaaagcttttgtttcaaactaatgatgcatttgaatggaacttcctattaatactctttttcactatctcacatgcatgcatcttgcttttgacttgttttactgccgttacctaacatgcttttctttatgcggtccaggtaaccagtgtgcagttacgtgatgatctattgtcaatgttagttgctggtcatgaaacaacaggctctgtactgacgtggactatttatcttctcagtaaggtactcccttattgcttgcgccttgcgctaatgatttaacaagtaaaacgttacttaagataagctatcccttaactatatgttgactactcagtattgcactactgaaggatccagcagcgctgaggagagctcaagcagaggttgaccgtgttctacaaggtagactccccagatatgaagatctaaaagagctgaagtacttgatgcgctgtataaatgagtctatgcggctttatccacacccacctgtacattccttgtgcttagtcaaccaacttcagagttagtttaggttactcaagggcttcttgttaacaggtgttgatacggcgagccatagttgatgatgtgcttcccggaaactataagatcaaagctggtcaagatattatgatttcagtgtacaatatacacaggtcacctgaggtacgttttccatctgaatattggagcacatgcattattgattggcgttttttaagctctttatgccaattgtttagagaaagtaccatatctatgtccagcatatttgtgaaatgtagattttctttagcagcgcattgcagggttatctgctcactagttgaaatggtgtgactggcaatgaaatttatgtcacagtgaataagcaatcattctgctgtctttatgatattgtcatcctcttagcaatgtctgaacgaccataacattatacattgttacaattgattgtttgttccttatgcaaaggtttgggacagagctgatgattttattcctgagagatttgatttagagggacctgttccaaatgagacaaacactgaatacaggtcatcttgagatatttttttaacctgtttttacaacgtgtccacttatcatcgaactgactttaaatcatctggacacacacacacacacacacacacacacacacacacacacacaaattaaactatgctgcctttctgtcacttctctttttcagatttatcccattcagtggaggtcctcggaaatgtgttggagatcagtttgctctcttggaagcaattgtggcacttgctgttgtgttgcagaagatggacattgagcttgtgccagatcaaaaaattaacatgactactggggccacaattcatacaaccaatgtaagtgttccactgtcaatgcttatgactgctagcagatggcattaaatgttgaaatataacaaatactaaaccacttacctgtctactactccctccgtttcacaatgtaagtcattctagcatttttcacattcatattgatgttaatgaatcctgtctagattcattaacattaatatgaatgtgggaaatgatgacaagattcattaacatcaatatgaatgtggaaaatgctagaatgacttacattgtaaaacggaggaagtaggaaagaacctagaacgagataattatcgtcacacttgtaaagggcacatgatctgagtttataatttgtctagatcagctttagagtttagaagtagtcacttttcctgcatatttcaccataccactcctcgcccaaaataaataaataaatatataaaaactagttgaaacttggtcgaggaaattggaaaatctggtcatgttgcaattggaactattgcatatagtcactgtaagttgccagcttctacctgaatgggcagacgggatgctggaaatgaagaaatatttgcttcaattgacagcagaactcaatcctcccatcttattcagatctgaaaaatacactaaaatactcttctttctcgcagggcctgtatatgaatgtaagtctgcgtaaagttgacagggaacctgattttgcactcaggtacatatgcaccatgatgattcatgaatgttgctttaatgtatcagttaatccgtttcaagcccaaattttactaggtggtcgttgtacatactttccatagtttaacatactatcattttcctctttcagtgggtccagatgaacggaaggaaacagcttcaaagcagaaaagcaaaagatgtacatcgacacacatgagatgtaatctacaagtttaaatttattgcttgtctagtttagctgtctgaatatctgcctttttgtgcacaggtggtaaatatcggcgtacaggttgacgaagctcgaaagcatggatataattcgtttattgtttatggatatacgttgtatgcttatatatccccgagaatctggtccgcaatgcccgttctatagcgtagaaagccgatatttaagaggcccaattgcgtgaacaatttcatcaagagaaagttaggcgcatagaactttcggccacaaaaggcctatatatatatgtgagtaatatcatttcggttactttaggctggtactgcgcgcataagctgttgcgtgggcttaacgaactaaactaaagaccaggcctttaagcaacccatttaaatgatcttgtcatgggctcatggccggtatcaggtgagcccacgtatagcccataaagaacggcccactcaagcaaaatcagcaccatccacagtccgttttacaatcatcaggcccgttatggccctgtatattcgaactacaagcccatcatgggcccaactttggcccttatatttgaagaagaagcccattatggaaatcagagacccacatttggcccatttatgatccgttcaaacccatatattcaccgagtaggcccatgttgataacccatttccggcccatattggagcgtttaggcccacttacggcccattggcggtgtgttggaatatgtaggcccattaacagagttttgtacgactgttttgcggttggaataagatcactttgactccctcaactgaccaccgaatctaaatcgtatccctcaaccgcaataccagaaatcttgaccccccgaacttgtaaaaccggtgcaatctgactcccttggtggttttggatggcggtttcgctgacgtggcgcacacgtggcagtgttgacctggtctttgttccacgtggcattgacgtggcgtttatgtggcattaaaataaaaaaatatatgcggggcccatttatcattcacacaaaaaaaattgtgggacccactgacatgtgggtcccacatgtcatcttctctctcactatccttcttcctcctctctcccttatttctctctctctctccccttgacaagagccgatggcaggcgagggctcggtggcggcatcagcgagtgggtgccggagtggtggctgcggtgggcggtggacctcgggcgacgtgcgacggaatgcgtcgggggagatgggagcacgctcccagccaccgctcctcgtccccactctgtgtcgagggcaatgagggggcagcggccgcggcgtcgacgggaggcgggcggggccgcagtggaaagggagcaatagctcgcacgccccaacgcgcggcggcagactggccttgagcgctccagcgtcgacctggccatgatgcggagcagcgactggagctcctcctcctccgacacgtgcccctccccgaccacgtccgccgcgagaccgcccccttcttcctcttggacttgccgccagccgtgcccgcggcggcctcacggaggctcgagaagttggcggcaagagcagggggctcggtggccgccagggtggcagcgttctcgcgctcctccacctcttccttggtgcgctcagtgtcctccgccgcgcacattccttcgtgccaccgtgcccggctcgctccctccccgccgcggctgcctcgcgccatcgtcgccggaatcatcctgctcgttgctgttgtgccctcgccgccatgccctcgctgagcgggcgctcaaggtgccctcgccgccatgccctcgccccgccaccatccccatctcccgtggcgctagcgccgctccagtcccggacctgccgaagccgaatccttgctactatgtcggtggcggcggcgcgaagaccgtcggctgccactccgtccatcgcccgccgccgccgctccccactcacgaagagaaagagcgagagatagagaagggaggagggggaggaggaagaagggataggagagggtgacctatgggatccacatgtcaagtgggtcccacaattttttttttgtgtgaatgacaaatgggtcccgcatatatttttttattttaatgccacataagcaccacgtcaatgccacgtagaacaaagaccaagtcaacactaccacgtgtgcaccacatcagcgaaaccaccatccaaaaccaccaagggagtcacattgcaccggttttgcaagttcgagggtcaagatttcaggtattgcggttgaggtatacgatttagattcggtggtcagttgagggagtcaaagtgatcttattcctttgcggttagaaaaggcccattaatggccgattatctcatcatattgggcctactaaccgtccatgtttacgaacttgccttagatcggtccaatatagttttcctgaaatatatgccgtaagacgacataaaatacactaatactgtacagtcggttgaccagtgcaagtttaatgtacatcctgtatcaatttgctcaatctgctgcagccaaatgttgtgaaaacgggtcatgcatgcggtaaacaaatattgaaaccaaattaacagcacaaagtccgacaacagtccatgtacaatggttattgtgaaaaatctcaagtcctaacaaatacatcaccaagcaaaatacttgaagttctaaaataataaatcatgtactccatctcctattccaccccccccccccatacattcccctttctattccaaggtccctgactccgtcttctctgctcctgcctttccctcggatgaacatcaccttacaattgataaaaggaaatgtcatctctatagagaatgcaattgaaaagaataacaagctagcaagtgtttagcttcttgcaaaaattccacttatattgtgttaatatggcctgacatttagcataagtttgcatgagacataatggccaaagtagtgtgatttcaattatgtgtccagttttgctcataaacaagaccaaaagctaatgtgaagatggtttcaaggaaataaacaatgcaaagttgacctagaaacttgccggagcacctatgggtggctgaataggttatatatagctttagttcgcaacatcagttgcaagcttgctccttctttagtgccaagatacgtagttctccatattctctaaaaatgatagaaattctctaaataaacagtgcaaagtttgccacgtctaaaataaaagagattctctgaaaaaacaatgcaaagtttgcaccaagaaacttagagatacctgtgttaaatcatatgtacttgtgttggaaaagagaacaacagtagcaattaccaaggtgctctcacttcactgcattggacatggttgatcatttgttccaaacagcacagggggaagtgacttctccatgaatcaattctgccaaggtctccacccctactgccagttccaggacggcagtacctattccaaaacatcagaaggtcaatcagttccagtgttccgcgctggttacaaacaccacatgcaaaatttaaattgccaggactgggacaagaaaaattatgctggaaaaacatttctagtcaacaagacaaatgaagtggcagagatgtttgctcaccggttgcagttgacctttgtatttggacaaaagccagtccccatcttacttgcaagcttctccttggtcatcattgtgtcctctacctctgccaccgcagtttttacccactaaagacagcagtcatgctcatattcagagtaatcaaaagcacttgtattttcttgcctcaactatctgatcttgaatatttcattgaaccattctgagcagttgaagcaaacctttgtaggtgatcattcattgatatctttttctctgtatagtcaaagttttgaacgagaactgcaacgggtacatcctcatctccaggtgctgacttcccacaaacaaaagaaaaagaagtcaatttgcatcctcatctccagagtataaatcactcgaagccccgaaccaagcccaaattgtagaccataaaaaaaaaagaaacttctacctttactgcactctttgttctgtttttttgttgcttgctttggttacctactgaggtgctaatcattgagaataagactcttctttggtcgctaaattgcttgctttggaaaggcctcattgctctgacagcagccagctgacattgcccaacattctcatgctctgaatagatggctatgatacagcaaagtaagcgccaccatagtatatttgaccagttgtcagtactccatattaaccttacttagccttgaattggttttgtagcttgacgtagtactttcatctattcactgaaacagagatgcatgtagtatggtcattgtataacaagacattagccatgtgaataatgcaacagaaaaaaatcaaatacatgagaataactagaaaatatgcatgttgtattaatgaagaagaaaagaacaaaaaattgcacttattgtcatctttgatctttagtgttagtttggcatgaatgaactattggatgccataccataccctatacacctagtgttagtttggcatgaatgaactattggatgccataccctaccctatacaccagaagaagcataaaacatacacaaaacacaccagttgctacttgaatcagataaggcttacatatatatggaggaaggattaaaagtttaaaacaaggtgggggtcaaggtgtataatatgagctcccctttcaggcaatgagtgtacacaaattaaatactacgacaacaaacagagtaaaagcaaacaagtctgggaagtatataacatcagtataaaacctaaagcaaaatgactaactcagcaaaattcagtatcagcctcttacagtaactcagctaatttaataggtccacagatcgtcagaccgtcactacaataacatgaatattaggccatagaataccgcttacagttagcataatggaaagcaagtaaactaactaaataaactatagcatttcaatcgagtattgaatatgaaatggactattgaatatgcaggactgctgaatgaaatagtataacacaagtttatgcagacaatacagagtgactgaactgttgtgctctgctcactagatgattagctgtgaagttaagatatagatgtaattacgatagcaagtaatctgttaaaaaatatagggcgtattttgtttcgttgggataaggcattaactagtaggtactttcaatgtgaatatctaataacatcaattttgtgtcacaaagattatatcctaatagagtaattgttggtcaaagtcttgtcttaacaaaacagaatacgccttatatttttttaactgagcaagtaattaactaaatggtaagtgacaattcagaaaatataatataagcttgattccgatcgcatcaaatcaccattcctcatcacataatagagaataaatccaaaaaggaaaaaggacaatgagcaagagggcataaaacctctctctagcttcatctctatgacactcttgacattgacgttccgggcttccaaaagaccaaaacccacaagcatcacacttttttcataattctgaacatcatagaaaccaattgataatactccctccgtactcgtaaaggaagtcgtttaggacagcgacacggtctccaaaatacagcattgactccttgtttctataaaaatatttattgaaaattgatatatgtatacttttatgaaagtatttttcaagacaaatatattcatataatttttacattttcaaactcaacaact

SEQ ID NO: 58297 - DNA, 17477 bp, Oryza sativa
ttttttttcttttttggtcttcttgcattcttaaattcggtgctgtttttaaaaagagcttcttagctatgtaggaactgagaatggagcaagggaatttgcagggagagtaacaccaccccctcgaagagaaactgaaggtcggctccagttagcagtggttatggcattcgaatcaaagaacaccacaacaactgttatatcatcatggaagtgccgccttaccccacgatcaattttcttcagatctgaatacctcatctccctcttttttgctgcctgctgcattgcagcctttactagtcttctagcaatcccctgatacgcaggaagttatagtagcattagtaagataagcaattaattgttatctgtaagatgaataaaagcacaaaaaaatagagaacaagatttcatttgatgaggctgggttgcactacatgatctggaactaataagtttagaaaaccatttaagatggatccgtagtgagcatcttgaggtggacagatatagtgtgtgaagttgcaaggaatatgaacaaattagcaacgtaacagctcatcagtattgatcttcatgtatagtgcatatattaataggatccatatcatatcaacaattgaagaatttcagtgcaaacaatttaactatttaagtgacacatgtattttcatgaatcgaattcattcaaggattaagaatcaaataaagtgataggaaaaggattatacagcgtaaagaaagaacctgctagattatcaggggcataggattggatggggaaaaattacagaattcggaccaaatacagtgcagttgtctcaaacaacattaacaaattgatcatacccctaatagcagatcccgtacaaatctgaattcctaaaacacctacagggctacaaccaataaacagctacaatcctaaaggctttctaaactcacaatgtaaaggtgccttcataatttcatatggtatcgtattaacatatacctaacaagttctttctgaatatttgttacatttaaaagaaacttagaacagcaagttctaaagatattcaacatgatcttctctactttctcagacaattgacatccaatcatctatttaccctaatgataataacaatcaaagcatgtaactattacaaaaacgtatcaagatttcttttattggacaagcaataatatgaacaagcacttcgccattgaaataattaatttacataagataagaacacatacattgcggggattatgttggacaagatcaactgcttcctgattactaatatgctcccatagtccatcagatgcaaaaatgatgaactgatcagttgtctgtaattggtgtacaacaatagctggttcagaactaagaagaggcctcctgaaagtttcttgaagccgaaatttgctatgcaaaggttctctgttgaactccggtttcttcagatacacatctccaatggatcttgttatctggaacacaccatcacaccacgtaagatgtgctgtgggaacgcagcagtctaaacaaaatatcacggcacctcttatacacactaattaccagaagcaatcagaataattgttccttcagggagattgcaattgaattcaagaactttacatcatattggtcttggtccataacagcagtgtcatgttattgcagttgcattagttttagagataaaaagatcgattcatggttattgaaacttgaaaagaagcataattatcgaatcacttatatttatttagctgtgataaatgagattttcctcttaccaaacaaagaaacaaaagacactaaattctgcagaagttgccatcacatagcatgttctaaagggtttgaaattaccagattaattgggaaaaagagaaacatgtacacttattttatgaaggcaggtccagattataacagtacagatggatggcgtacataatagagcattactccatccgtatcagagaagtacaattctaattttggacataaacctaagagtggcacagcaaacacaattatgctttcagttggctgactataatctagtcccgtgccaatcgcatgggaaagtctgcgagttattattagaacaagacgtcaagattctacaaaataattagatgagtcaaaatgaatagacaacaaatagcaaaataattaagatgtccagatatgtacctggataatacccttcacacgccaaacattgtgctttagaaccacaatatggggatcatcaggatgtgctgcctgcagctctcgcctgacctcttcaaaggatgcattgtgttctgctgacaactgcatagccagaacctccccagttcccttcacaagtctaccgagaacagcacgggaatcgccaaggtttgcaatatatagatttccagcacagatcacaccaaccagacagcaagagcctactgccgctaattgaggcctcatcgaccattgactactaactacagaaaagaatccctcctcagttgctcgaaacgccttccgaatcacatccgctgacatgcacttgtgctcagaagcaaatcctgaaaaaggaaggtaatcatgggcatgcacaactgatgattagcaagtaattaaagctatagagatgcacaggcagaaatgattattagcagttacttgtaaacaaataattatacaatcagatgtaactagaagatgccatgctttatattcataaaaaaattcttgcagtcagtttctaaactggcatgtgatgtgtttaattacattccagaaaatcatctatgggtcaaaattagggcaatcctggcccctggtctaatagtagatgcattcaaatacgcgcgcgctttttcgcggtaatatgcgcagaaccacatctcatgcaatgatgcaatgcagcttataacagatatctactcaactgaaaaccattttcgctcaacaactatcaatatcaaacacatctacacttgcagcacatcataaacaattggaccaatcacctattaatcagatagcatagcgagatcggcattggatcaaagggtgaagattttcagcagcagtagtcagtagaggcctcacccctcagatggttgaagagatggtcattgatgtagcgcgccgtctccgggcctccatgcccatcatagacgcccacaagagtgccctgcaggttgggatccgtggtgctcagtggcccggattccacctggctgtggtcctcgagcaggttgttggcctggaccacggccatcgagaactcgccggcgacgagctggccggcgtccttgtaccacagcagcccatcctgccgccccgccgcatccgatcctttgcgggggcgcccggccggcgacgacgccgggccccagcaagatctcaagtattccatcgcagcagatagcatccttcatctccgacacctccccatcgcccacttcctcacaaagcccattcctttaccttccctctcctcctctcgtttcttcgcgaaacctgcaattgcatccaaacaaacacgcatcccaggatcaagaaccacaaaccatatgatcatcagagggagaaggatcaacgagacaaccctactctacttgcattttggaacataaggagaaagaagcgaaaaataactcgccttttttttctctctttctttctaggattagcttcgagattcctgcgcgatcgatctcgcagccgaaaggggtggccttagatctggaaggaaccaatcgatctcaagctcggaggaagcagcaaggattgggtttttggtggagaaacggtgggctcctcctctcctctccaggatccaaaagaagcaaccaggaaactgaaccaagacgactaaaaaaagatgcgctttttcgcttctccccccctgcctacctctcctgccaaatcttgcagacagcctcgatgaacagatagatcagggtatcttttttatctcctcctccactacacaaacaaactgcacaacacaatcaagagaggaggaagggaaaaaaaaaactgcaaaagaagcaaccaggaagagagagaggttcagggccagcaaggcaggggctcagagatgggctctacaagtcctaatttctgagagggatttgggagtggtggtggtgactgtttttgtgcccttttgttccattttaaatctctttttttcttcttcttttcttgctctctacacctttcttacctagaaagaaaagaaaaagggacatttatgtatgtagctctactatactagtactactctttttttcctttcctctctatctcttttcttttcctcctccttgtcaatatgcatgacgtgctgttttgtatctttgctggtctcacatggtttgacctgttttgtttcttcatcgctactcttcagatttcagatgtacttgaaaaaaaatatatctttcatgtacaaatatcagtgaaaattaactgcaaaaatgcaggactattcgtataagtatttgatctgaaacttaatagagtattgtaccagctacagtgcatttaattggagatttgtcaagtactctgaaatctcacataatacatagaaatcattcaatgtaatttcatgccatctttatgacatgttcaaaacatattaatcgtattattgtcgtataatatctatttttattattacaataaattaaatgttttaacaaataaacctaacaaatagtttagaattagtgggctaagcactgtattagaagaaattttgaaaaaaaaaacatactttgtatagatgtggagtaaataagccaaccatccgataaaatagctgaaaataactattgtataataacttagggtgtgtccgtatatgctggtttccaacccgaaaataacattgaaaacggagcaatcccattaacacgtgattaattaagtatttgctattttttaaaaaatggattaatatattttttaagcaactttcgtatagaaactttttataaaaaatacaccgtttaatagtttgaaaagcgtgcgcgcgaaaaacaagaaatatgggatgggaaaaaggggtgctgaacacgcccttagtgatgcgccttgcttaactgacagtggctaattaacttatttaaaccaccagccaagctccatgcacggatggatcgatcgaacatggcgtccaaattggcgcggcgacgttcggagaaatttcatgggatttggacgctagccgagccgaggagcaggaggagaagatttatcgattaaacaatggtgacccaacgcattcagcctgcctgccaattgtatgaggtgacgcggacgaaacgcaactcggcgcggcgcgcgacacacatggcgttgccgtggcggcgagcgcgatgccacggcgaacgcggcgcgcatgcgtgcgccacgccacgccacggcgatcggcgccgacgacgacttctctcgctcgtcgctacggaacaacggatatgatgacatgtactagtactatctgcattctgtgcttcagcctgaagactcccatttgggcctccggatggattcacattctcgtggtgttcgaatggcagggtttacattaccggttgagcactaaattttgagccccgtcggtattacggttttcgataaatttcgactaatttactatttaacctttgaaattctaatcgaaaactaattccgagctcgaaaaccgaccggctttcgtcggctctgttaaccctgtcgtatgatacatttatgctgagttgtaaactttgatttcaatgtacaaccttactgtgtttcagtccaaaacggttaaacggtgtgttttgtaaaaaaaattatatagtatattttaaaaaaacaaataaatatacttttacaaatttaatagttaatatttaattaattatatgctaatgagtcatcctattttacttatagttaacacgcttctccaataaagagtttcaaacggggtcttagagatttaatcaaagaggaaaaacgtaattttggttgtgtgtcatttcgtggacgggtcaagagatacgaggaatggaacggacggtggtgccattacgcgttttagtgactagtgagtatatcttggcatggggtttgggctgtgtttagatccaaattttaaatccaaactttagtactttttcatcacatcaacctgtcatacactcacaacttttcagtcacatcatcttcagttttaaccaaaatccaaactttgtcatcaactaaacacagccttggtaatttgtatttggtcggtggtacggataagttcatcatagcttggatgccggatatttgacatggagagataacagtgcgccgatatttaaaagtgatgtttaaaatagcacgaactgaacttttatttattttcaaactaaaagatatactaccttcttcttaaaatatatatcattgagcttttacgtaacatttaatcatttgtcttattaaagaattagtataaatatataaaaatattagttaaaagcatatttatttaataataataaaattaaatagaataaataacatatataattttttaaaaataaaatatatagtcaaacgttatgctgaaaataaacggcgacaggcaggtgagcatcgagcactgggccggcaggctgtggcctcgctggccgccactccggccgcggcagctggggccgtgggccctgctccaacgcatcttgagccgtccgatcaaaatcctgcgtctcctgtgcatgggcccaacggcgacaggttaatcaatggctagcttctcctgtgctctctgcgtcgcccggtccccggtcagaaaaatcatataattgtacagtaaacttgcatcactatcacgtgcggaactctattatttctgagaattcttcgtggattcgtgcatgtgtgagagcctcgcgaaatcccagatactatcttcatcctataaaaaacctaaatatagacacatctctatctagatttattgtattaaaatatgttatatctaatttttgatttttttttcaggacaaagggtgtgtttgatttggttgacataatttctatgaaaactagtaccagtactaacattttccccgtgaaaagatctgcgaatttgattttactgaaagtataaagcagctggtaccgtaaattcgcgagaagaatcgaaaattcggaaccgaagatttccatgacagagagaggctggatatatatgcagcgactaaagatctgcatagtaaaatctctagtttttttttcctttactacaaaatctgcatctgtcacgtacatatgctcggttacttttaagctttcaattaacagatggattaattaatttaaggatacttaactaacagcaaacaaaacgagaaggcaacagcaataattgagacgcgctttacaaaagctacacaaaccaaattccagttcctccgattaatcacaaattcgcaattcacacacacacacatcaagaacgtacgatcgaagatcaatcacgcactccatcgacgaaagccgttgcgaccttttaccagttcgatccattgcacatgatatgagcgatgcagattaattaactaaagttagctgcaaatcatcacacatatgcgatcgagaattaagagattaattgatcggtgtcaatcgcaattatgcaaagccgagggataatcgcctacatccatgcaaaaaggtgtactattgatcgatgatctgcgctgcaagtgggcagaggccatgcaaacgtaattaagctcgatctggatgtgacatctcgaaccttggcatgtgatccatccagcttgagcttgaagaaataactagctagctcggctcatttccttataattaattattcatggaattattaaaataaaatatttacttcatatgttaaaaaaataagttttttttataaaagttcttctactaggatcatttgttctaagctatgtgttaaatttatgtatcaaaataatacttaatttgttcttgtaataaatagataatccgtgtcaataattcgcttcatataatctaaaccaaaccattaagaatgctctcatggatccatcaatcattagttcgaaccttaatttttttgctccttaattaattaccaccgttactctcatggagtatttcttaattaatttgtctgttactatttctgatagatgattcctttgcggcgaaaatattaattgtatattagtcaggtcgtggaaagcggtcaaagtggccgggtgatttcttggagtgtaatttacggcaggaactacgaaggattaatactcactgacccggttggagtcaagcggcaaaattctacggtgacgatgctgatgatggcgtaaacgttatgtacatatgcatatgcaatgagcagttactgattaattaagtacagtactacagtgttgtattgttcgtgcatatgcatatatacgcaatgatcagttacatgttcataaactgaatgaatttaactgaagaattatacgcatgtttacttatcgggacgaccaatacatatttaacacaaaaccctctactaaaatcttacgaattttggatcattcgatcaagatcgaacaccccacaacccaccccacaacggcacagccttccccctttccttcttcagatcttcctcttagctcgcgaagcatgctgctgccctctacccttaatttatttatgagctccaacgatccctccattagtaggtgccaataccccaccctcctcctctatccctgacaatctctatcatcgaatccgtcattatcattcgctaccacctatctagttagccaatatttttccacctcataccccttttccatctcatcgacgtcgctctgcgccttctaacctcttcgctttgcccctaccccctatcctgcccattgctaacctccctctaaggcatgaaactcctctggcttccacctctcccaacccctctttcaccttaactctaacacccaaacctacatggatgttaggccaacaccatcacaccgaagtaactcgtcggagctaaaggagaagaaggttgggcaggatgcgatgatccaaaatccgtaagatttgggattctgtttttgtcgcatgtaggactttttttattgtttatatagatgtggattttataactatatatatagtgccatgagcagtataatactccttttaatttcttagagtcgtataacctgccagaaaaatgctctagtacgtgcacgtacggccggccgccctctctagttgacctggtaatttaattagtttgtatgctggatctaataatggctgagtcggattagcatcatcagctggatgctacgtgcaatctaaattatgaatgttgtgcttgccttgaccatcgatcgatggaatgggattcgatggcatgcaaatgcacgcatgcaccctccattattcttcccaaggggatcatcatgatatttgacctagcaagatagcaggtaattaattagtttaagatgggtttaattagagagtccggctagctaggtagctgactcggatcaacatcagctcaaatgttctctcaaactctgctgctcgacgtgattctcggccatactgttcaaaaaagacttcaattttaatatatcttatattacctccatcctgaaaaaaatatttttatacgactcatttttatacatgtagatgtagataagagtgaaacgtaccaacgtaaagctaaaatgactaaaccttacatttttttttcttaaactccaatacatttattcccccattttctcaaacttcaatgaaattgtccttcattttctcaaattataatatttgttttaaagataaaagtatttgcaggataaataaagaggaaacaaaataaagcccgtgtagggcggagggagtagcaaattcagcgagcacaatcggcaatcatgctttgtttttttttcttcctttgtttttattgcgatacgatgcatcagaagttaaaattaaacagaggcacgcgtccgatgactcgatgagtacgatgaggccacctgctgtgacgtactccttcgtttcaaaataaatcgatctcttaccgcatataatataatgaatctgatatttagattcattgtattatgatgcattatatttcgtatgggattgatttattttgtaatggaggcagcagtatagacgatgttggtattaaagttaatgattaaattggtaataattttcaaacccataaaggtcttaggcaagggggaattatcttcaattctttttaatatagtggctgatatgcttgctttactgattaagattaagagggctaaagatgctagttctataaatggtgtaattcctcatttggtagatgatggtttatctatattgcagtatgcagataatactatcatttttctagagcataatttacagcaagcaaataatctaaaattgattttatccgtatttgaaaagctctctggtctgaaaattaattttcacaaaagtgaattgttttgcttcggtcaagcgaaggatcattacgatcaatattctaatatgagtaaaatgcaccagcgatccttaaacttgtcaggagatttcacttcggtccacgaacttgcaaagcgcatattaaggcccctaaacttggtttattgtatcatctcggtccaaagccgcgtttgaccgtggtcttgcctacatggcacgtgtcacgcccagaaatttaacccaaatttctagactattttgcgtattaaatccctgtccaggaccagccagggtacacaaaacgacaagtaatatacagttccaaacgtaaataaagcgtaaaatacttacgaaagaggcacttagtcctcacaccgaaacagaacgacagcagcggaaaaaggcgatcctagcggggcttcagctccactccacaggcaaaactcaactggggtctgagccttggtcctctaactccatcttcagctcagaagcactacacttctgaaaagggggaataaaagcaagactgagtacaaccaccgtactcagcaagccacactaacgatgcagatgtgcaaggggatacaaggatggtttgtgactatttgcataaaggcggttgtaaaacattttattgagcaaaacagtaaaactgttgagtaattaaagtaacattaaatctccattgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacaacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatctggaagcgacagaggccgtcgcagggcccgccccgctccatcacgcccacccttgcctggatgcgtcgactagaggaaagctacactacaagcccagccgttgtccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatactaaaaggtctaatacggtaattatcccatcaactgagctaatggtaattaagcatggctaagcatatagttctagctaggtcacataagtaacatgagctagtcgatttattacccaatgttgacaaaggacatatatcaagtaaatatggcacaagcgagcagataggtaaaaccctgaccccatgtaattagcaaaatatgcatatttatttgcaaacagtaaaacatttgcaaattgggatcaacatgctcaaggggaatgtgtgacttgccttgcttcttcaaacaatcttccgaactcttatcctgcgaccgtgatcttccgaaacgacggattctacacgcaggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctagaattattaacgaattattgtgcaattgttaattattttatcaaaggaaaaggctcctgctggcgtcatcaaagggcagcggcgccgacaggcgggccccacacgacagcgggcaagggagtggtccaccgtggactgggaccacggggtggtccatcgccggtccacgggaaccgacggcccagatcagcccgagctgatcgggctgccacggggtggcgcggctgagcacgagcacggctcaggccggcccggctgagcgacggctcacggcggcgcggcctcctgcggcgacggccgacgcacgcgggaaagcggcggtgcggcgcggcaaggggatccgggcggcctaggcgagcggggcggcgacaagccggccggccgacctaacggcggcggcgcacggcccggtggtcgccggcggcggccaccggcgcggcagcacgcacgggagacagaggagggaggcaaggagggagaggaggagctcaccaaggacgcgacgacgaggggcggggaaaggcggggaagctcggcgtcagcgctcctcgggacgaaggcggaacggcggcccggcggcgtagggtggaggtggcttgggatgcacggtggaagggtggttgcggcgattaaatggggaaacggagcagaggccggggtgcggcgaggcacggagaagccggcggtgcaaacggcgcggcgcggcagtggctagggcggcggctagaggtggctggagctcgccggggaccgatggagagagggagcacggtggagaggtggttcgcgtggtggaaggggaggaagaaacggcggccgagcgtgcccttgaggtggcaaagccagcggtggcggtggagcagtgcggcggcgaccctagcgacgggaaaccgcggccggagttcgccggagtgtggcggcgcgcgggggcggcgtggggagagcgagggagagagtgccgggcccgggaaacaaggggaaatggacgaggggagcacgggggcgctttttatgggctcgggaaggcgggatcgaggccggacgtggcggaatcggccgacgaagtggggcgccgacgtggggtggtggaggggttaactgtggacccccgtttttataacaggaatcattcgtgtaaacagtaccatttccctggatcaagtagtctggtacacacgagtttatagctgaaataccaaaagcacatacacgagagtctaatgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaaagggtgagtaccaaccgtactcagcaagtcaacacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaggaagtggctccaacagcataaaaattcgtcatgcaacaacccatcccacataagttaagaatttagaaactagccaagtgtaatacatgtcccggtgctcaataaccgcgagcagggctattcgaatagatttggtttactcacactgcagtggatgtacactttacccgcactccgcgactgcccaacacatgagtctcgtctcaacacatgaggcgcgtcacggcaaagcttttcgataacctcgcattggcagtacccgctccatgaacttaaatcctcatgcactctaggcgtccatgtttctagcagtgagaggagttttggcgctcccgggaaagagaagtctcacacacatattaaattatggttcaagttaagttctctctcacacactcatggcagtcctaccaatggcgacaccgatgtagggcacggttctcggccctacctcaacggctgtcccatcgtagcgcacctgcctcactcaggggtgaaccatctatgcagggatactgcctccgctcggctatctaatccgctaggtctatacccattcgagaagtacggttgtacggggttgtttcatgcttaacttcatggctcggtccttaattgactggggacggtactagccttttccagataccacccaaatcatccgtccgccccagtcgaaaacagttgttttcgctttattttcctttcacaaatcatgttatcaatttcatggcaatgtggcgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatgattacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgcgggtcttggccttcacccggatccgcggctccctcggtctctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttacgggtataaatgttttgttgtcataagtttttaatttaatctacctgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactacagcgaattgatttcttatagaaattaccaagaataatccataatttatattaaattttgcaattctacgactatagttaatctataattaaattctaattattttaaattttctaaacttccctaatctccctctaatttcctatttatttccttttcctttttctccctttccttttttttctttcctttctttttcttttctttttctctttttctctcctttccttttcttttcttttcccctccctcccggcttctttctctcttcctcggcttctccctccctctctctcggctccctgctacctggggcggcgacggcgaccgagcaagggaaggaggcggcggcttaccgacggcggtggcggcgacggggcgagacgacgggcgagcggcgatgggacgggcgggcggctcggggcgcgaggcagcgcagcacggggcgcgtcgcggggcgacggggcggcgcgcgacgcggggcgcaaggccggctagggcggcgcggcagcgatggcgacggcaacaggcggcgatggcgacgtcggcgcggcggcaggcgacggcgcgacgggatggtgacggcgacggcgcggcagcggcggcgcggggctcggggcatggctgggcgcgtgacagagaagggtctagggctagggaccgaaatcgaacacctatgaggcaatgaacagtgacttttcctatttatcccgattttagtgtattttccatataaatttgattccacaattcctaattttacatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaatttgtatttattttaccaatttgtttttaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacattaaccggcgccgattttcgcggggagagtgggggggaaaggtggaggaggtggaggggatcgatttcacgtgctcgtggggcggggtggagcgcgggagccgcagcgtcgtgggggcgaaaccggcggccatggcggcagttggggcgacgggaggttggggaagaagatgacaggtggggcctcgggtcccacctgtcggggagagagagagaggaaaacgggcgagggaagtaaagcagacttgaggaagagagagagccgagcgggccgagggaggaggccggctcgagagggagagaaaaggggcgcgcgggccacgggagagaaggaagacttgggccgaaaatagcccaaagagaggaagggggattttaattgtttttctttttatttagttggttaaaatgaacttggtgcttttaaaattatttcttgagctccgaaaattcacggaaaattctagagagtacattagggcacaaagaatattacagaatattctcggccaatgatttttaaaggaaattttaatttactccataattccacttgattaaattggtttaacttttatttaatttctagaaaatgcattattaaatgatttttaatcccgaacgaaaatcgggcgttacagcacg

SEQ ID NO: 58298 - DNA, 2843 bp, Oryza sativa
agaagattaattgaagaccgattattgcaaggcaagtcacacagatactaaacacaaatcctttgagcatgttgatcctatatttaaattctctatttatttcaactgtgcatttattttcgaatgtcaccgggtggtgtgaacctattcctttgttatggccaatttgcattgattatttctttgttatggccaatttgcattgattactttattccttgataccttgggtaacaaattgattagcttgaaccttatatattggtttggttcagctaaaagctatatatatatatatataattgcttagccatgcttagaaacattagctcattaatgggatgaatcatactacattattatttatgattatatttaatggtagctcacgatggttaatcgtgttatgataattaattgataattaaaacttgtcaatggtgggttgtgagcacatggttttgaaggtcgtgctcatgacaattaaggaccggttcgcgagctactgttgtgagacattaaccgtaccaaccacaagccagcgtgggcaacggttttaccttttgtatagcatgattcattgcggggtgccagactgagaagcggcgagaagtccgtgggggtcgctggggagtccatgcctctggtttttgagggggtgattatgatccaggtatggtgcactgtggtgagttgtgttgtgctgagggtattgtcatagcctctattcgggtactttccagtatcgcgacgcatggtagacatgatgttgaggctgtgtcttgtgggtacagtggtacacctctggccagagtaaaactattcgaatagccgtgcctgtggttatgggcgagttgagcaatgtttttcgtgattagtctcacacctctcacaataattattgatgctataactggtaataatttgtgtagctcctggtttggaggtttgatctgtacgaccagggttggttgttcaggtttggttgggcctgtgcagtattggggtgctgttcagtgttgattaaaattgatgattaattactctactgttttactactcttaaatctttgctaaatgctgcttttgcaaatgagcctatattatgccatcctttggtatccatgtgcacttgcatatttgctgtgtggcttgttgagtatgtcatatgctcatccttgcaataatcaatcaacctcagttgaaaaaaaaggatccagaaggagaagacgtttggcttatacccctgaagccatcactagaccgttaattccgctgctgtttacttttcttttgtaagtatgtaacgttattattataatgaatttgtatattaaattgtcagtttgtgtacctcgactgattcctggacgaggattttatgcacaaataagttcggaaattactagtgaatttccgggcgtgacagagtcctgggaaggcaattgtatctattaactaggatattttatgtgaattccttatagataagtgtgggcaaaagtctgccacaaagacttgtggtatcttagagtttgttagagataatggttgtgtccggtatgggcatatcttgtaatcctcgggtataaatagaccccgagccctatgtaataaaacacacacgttcaatacaatctcggcacatcgccaccctttttactttcgttttatttcgacgagttcttgctttcgggttgagctgcatcagtttcgatcttcaataagaggtaaacttgttatggcagcttgcgttctcgggattagtgcttctatctttatgacactctaatcttgtttatgtaattcatcgagttatcatgtcttacataatctctaacaatatcatcatctaacctgccgtcggttaatatctgtcaatagagggtagccgattaggttaaatattgatattggtctagattatacgagagggtagccgattaggttaaatattgatattggtctagattatacgagacatctaccgttctatgagacttctagcggcttgattgtctagatattgttcttcttttcatacttaatgttgcatcagttatgtttgatctattaagtcgtgcttagaatatcaatccctagcctgccttctagttgccgattagaatagcatcggagtttcagccgattgtatctaatttaactactctttatcctatatgcttgattgacatgttaaatctgccctttgtattaagatcttgccgcatttaagtatattaggcttttatttagtatattctacttgctttaacatcttaacatagagtggtatcggagtattagccgatacatgctagatctatctgatcggctatgctatgaacgtatatagtctaattattaatatatatttcgatctaagtgatttatactgtctcggcatggcgaccgatctatcccaatcactttatttaagtatatatcgatataaggattatatattgttaatatctatagccgatcgagtagatttagttcttctttacctattcatgactgtccatcgatacatggatgacattagcccaaagataaatgatatgtcatcagcatctagccgatcggctatcatttatagatttaactacagtttctttgcttctatttcttgttaattacaggatcaaatcaactagcatgctaatacatccgaaggcgagctttggacctgcactagagttaagcagactcccaggccacgtgttttctgtcaacacaaagttaggtggcactactacagaacaggtctttccatacgggcgaaaaggattttcgcatgcgggcgctcaaaccgactgcacgaaatgagatgtaatgat

SEQ ID NO: 58299 - DNA, 21822 bp, Oryza sativa
gaagagcaccccggaacggaatcatggcagcggcggcgacgacgaataagctccagacgatgcggtggagcgacctcgacgaggacgacgactacggtggcggcggcgacctcagcaccctgctcccaccgcgcgtggtcatcgggccggacgagaacgggatccgtcgagtaccgcttcaacgaggaggggaaagtggtgaaggtgaccaccaccacccgtgtccgtgaggtcgcgcacacgcgcgtcaccaagtgcgccgtcgagcgccgcggctgggccaagttcggcgccgccgcgcacaacgacgacgccggcgagccagggccccaccggttgctcgtcaagccagacatggccgcacatctccccggggcaccaccacagctccgcatacccgcgccgcttgtccccggcgcggaggtgcacggagaggagcgtggacgggagtggattgctgggccgcgtataggccgacggttgagggggacgaccgccgcggccatccgcgcgacagcagccatcggcggcggcgcccgtcgcatcggccctcctctccgcagcgctcctcccctgccagccgccggccacaccggccctcctccccatcgcgtcgaagacgctgccgccatccacatccaagcgaaaaatgagagaggaaagagagaagagggagagagagaggggtgacgtggacaccctgtcacgtgggtcccacgctgactgaaccgccacgtccgataaaaccggggtgaaaaccacctaggaacctaaagtgaacggttttataagttgagggatatgatatatctgattttgcggttgggggacgattttgtaactcgatgacaagttgagggaccttcggcgtactttttcctccacaaaatggtttcaaaatgctttgctatgcataagcttatttgaacagttgtttttttttataaaaaaaaaacgaaactgtgccttcctctctcccctacttagagcaagtttaatagtataaccaactactagcttcaaatcatttatagctaatataatagttaattcatacaatagttgcttactatactattaatacctggtcctacctgtcatacacacattacgtttttgagtctgtgctgtagctggctatagatctgtagcccgctgctcttctatctctttaaaatatgtttatagctggcttatagcctgctattgtacctgctcttatgacaactaggctgtgttcgctggattgtgttcccaaccggaacagtacacatggaaaacagaacggtctattagcacatgattaattaaatatttgctattttttttaaaaaatagatcaatatggttttttaaaagcaactttcgcatagaaaacaagaaagataagttaggaaatctgcgtaggaacacagcctaaacgtgtacggagtaatcagatagctcccttgatacttgaacgtgccctgcatgccgtacacgagcagaacctgcatagatcttgaacttgttgcgctcatcaaagaggtcagaatgccacgcatctctgatcaaaacacacatgttcgatcggcttccacgcatagtgcaggtgtcacctgttgttcagcatcgtcagcccaattgcagccgacaggagtattctccagaaaccgcacgtggtggacagattttgtgatgacagaatgaaccctgcctgagctgcacgatggtctgttcgaacgctgaatttgcaggatagccttcgaaaacgtgtgaagattttacttcaaattcccgggtcatccacgaagcgcgcatctggaatacgtaaaacggtggtgttttgtgacgataagtcgtccgtgcaaacgaacttgctggaatttgaaacgcgtttacggaacggaagcctctcgattcaagataagatcagtgcagcacgagcacatcatttcgttgatgattcagtttattcagagatcactatcgattgatacaccaatgtctgttcttttttcagaatgataggagtatttacaagtttacgacttctactcatgactcgatcgcttcactcccaagtcccagtagcaacacaaacagataaggcagcctcagtcttctgccacctcactttcactcacgtcccagcattgcagccttgaacctcctcacaagctccttcctgaaatcaacaacaaatcacccaaattaatctcatcaattcatataattataaaatctgtcgcaaagatttgaatctttttggtataaaaaaacgatgggagattttgatttgtggattgcaattaccggagcagctgtctgtcgaaggaggaagacgagagcaatcccctgttctcctctgctcgtctgatgaggtacgggatgatctgctccactggaccgtacggcaggtacttgctcacctggaacccggcgttgcggaggccgagcgagaggccatccgccatgcccatcagctgcgcgaactgcaggccgcggtcgccgccgccgccgatgccgagctccagcgccctcgccgcggcgagctgcccggactcgacgttgtgcgtggcgagcgtcacggcggcggcgccgcggcggacgcggtcgaggaggaacgcggcgcagccgttgtagcagtcgtgggtgtcctggatgctgcggtggaccggcgacggcacgccgagggaggccgcgaggcgggcctcgcgcgccaggtacgcgccgcggaccagcttgagcgcgaggcacacgcgctcgccctgcgccgctcgcgccatggcctccagccggtcgcgcgcgtcgcggaggtaggcctggacggtgccgtgcacgatgggcctcccgccgccgttgaacgccagcgcgccggcgaacgtgaagtagtcgatcgccggctgcacggtggcgtactcggcgtccaccagcagcgggatgtcgtactccgcgcaccgctcgccgatcgccagcagccgcccgtgcgccatctcgagctccctctcctcctccgcctccagcgccggcggctccgccgccgtcaggtacagcgggctggagacgcacagcaccgggaacccgtgcactttccatggcagcttcgtcgccgggtgcttctgctgccaccgcagcagatcactcgccttctccagcaacgcgaccgggcacagcgccgtgatcttgatgcacacgctcgcctgcaacgaacacgcaaaaatcccaaagcaattcagcaaccacacaaatactgtcttagcttaatcactatgctaattatggtgtagtaatctcgttctgtagtgttgttgagtgtaattaagagtgattagagatgtctaaaaaaaggattagttgatggtattaggagggttttgatgagaaagcgggtggaatggaaacgagcggcggagagagcatgtcggaatcatgtggctagttttcagggcccacgaggcagtggcatccgtgcgattcactggcagtttactaccggaagattcccaaggaatccgcgggtccgctcgcgcaagattccgtcctacgtggcagcctcctggtcccacagccacgcacgccgacagcgaggagagagaaacaccggcgagggttaagcggcggcggcggcgactcaccgagccaggaggcagcgcggcggcgacgtcgatggcggcgaggaatccggcggcgttgcggtcgcaggcggggccgtcctcggcgtcctcgatgccgtagtcgaggatcccgcccatgccgccgcgccagaggcggcgcaccgccgcggcggcctcctcggcggtctccccggcgcagaagtgctggtacgcggtggccctcgccgcggcgcgccccgccgcgctcccggccaccgccggcgacctcagcgccgccgtcgccacgtccacgagcgggcccaccgacagcgcctgcagcacggcgagcgtgcgcaccagcgacgtcgacctctccccggcgaacagcctctcggtatccccaaactccaacacctgcgctccctgcgcctgcacctgctcctgcacggaagacgcgacctcctccaccgcctctgcggcgcctccggcggccgcgacggccgcctccgggagcttggctgcggcggcggcggcgaaggaggcaagcacgcgcttctggatgcgggaggcgatggccatggaaggtcggacttgtgcctgacacacccaagaaaacacaaaccaaagcaagaaatgctctcctcggaggaagaagagattcagaagaaggcaatgaatttttctccggtgcaaaactagcaagacgaggaggaagacgagcaccaggtcggggcttataaaggagaaggaggaggaagtaaattgatcaaaaggctgtaaattcgcgagctggttgaggttgaggtgaatccaagaatggaggagatattgcggggtttttttgtttctatatataaaaaaacgaaaaaaaaaaggagaagactcgcgacaattgacagggagaggatgaacgagaaatgggatggaaaacaaacggaaacacgaccagagtgaaggcgaggttaacgcgcgcgtgaggcaaaaaatatatatatatccatgcaacggcgtgtgagaagggacatgatgatgaaagcgagcggcgagcgagatcgccggaggatgctgctgactcggccctcccttggaatgcgttgactgactcggatcctgcgtgcctggatggattaatctttttgtttaatccctttccttccacgcctcgatctctttccttgcaagcatgtactccagtagacaaggttgtcaggatcgggataccagacagtatcgttttgcttaaagtaatatcatattatagaatcgtatcatagtatcgggatactatgatattttcttttttaagtttaattaatatttatattaattatatatagacattctatataaaaaaaatatagtaacgatatatgtcatgcaaatagagacctttatcaagagaaaccacattggttttgatatatttaactgatttttatataaatttgagcatatttatttacattattttcaaaccaagatattttaaataatattttgtagtatcgtagagatcgtagaatcgggataccacctaagatttcgtaggatcgtgtagtaatgaatagtaagatcgagatattatgaaaattaggatattaggtgggatcggtatcgtttcggcttggtaggatcgtagtatcgtaagatactaggatacaaatcgggatactgacaaccttggtagtaggagtagcactttccagtttccaggtctcttttaggtgtttctcaaaaggaaaaaaaaagtcatttaggaactgaaaaaacgtgctggaatccgtttctcttaaaaaaatgtgctgattttgaaaagaaaagatagaggataatttacaatatatagacggggtctacagaaagaatataaatatgtttatgataaagacatttgagactatgccctttttttttagtattgtgctctaatttaccccctttttgtttactctctggttttacgactttaatttttaccacttaaatctctctggttcatttgagatttttggttgtgctaaatagctctgctgcaaaatgggatagtttatcacgacatgattaattaaatattaatcattataaattttgaaaatggtttattttattttaaaacaaacctgtatatataaaaagttttttttaaaaggtaatacgaaaaataagtggtcaagacagtaagttttattaatccatgagacatttttttttaagaattacacaatacaacacagacacccataaagcacacgcactcacctctgtgaacacacgcatgtaaaccctacccctataagtatcttcgaagactgggccggtaaattctagagagattgacgaagtcaccacagacgtctcgctgtcgacgggtacgtcatctaccactgaaatcacaacgccgttaaaatcctgaaaagtttgctcccatggggagtcgaacctaggacctcaggtgatactgaggctcttgtaaccactagcttgtaggccctttcgcgagacgttttaaaattctaatgacagcactagcaatctgtaccattcttcttgatgccgacggttcctttttcttaaggtgatagttatggtttttactcacctatagttgttgccttgctgatggctggataatcagcaaatttcaaaagtcattttctgacttgacagcatgaaaatatataaccttgctatccctttatagtttgaatttggattagtcattactagaaaatagaaatgttactctgacttactttttttttctcacgcgatttaacttgtaacacatatatccgactattttaaatctaaacatgtgttttgtttggagagcttaaaattctgagaaccagctagttggtagccagcttcgaatgtggaaaagctgggttttccagtttctggcttctagttcattttctgtattatacaactacagcttcttaaaatctgaatcggaagctaactgtttgggtgagcttctaattttggatgttacataggattgggaattcaggatcctctgctttgccaactgcagagtcatcagtatcctccttgccttccaggttaatttcagctctcacgaaatgccagatcaagctgggaatctgggatacgacgagcaggatatgaatccctacagcaaattaaaaattctcataactattaaagaaaatataagctttggtaaaaatgtaaaatgcctgacctgagttctctgtcgtattgtgtctcctcggagggcgaccggtgcagccagccaacggcggcagccggccgggaccgcggccagtgcagcgcgcgccccacgcgcacgcactcgataccgacggctgtgccgacagcgacgcggacggccgtggctcgccggcggtcgacgtcgccggagacagccgctgcaaattatgacggcgcgcccacacacccacacacacgtgaggctgcctgcctgcccagcctgggctttgctcatcagcatcagacaggatcagatcacagtcttaattagctgctgctgctgctgtactaattaatggagtaggagtacttaccatagatgcataagctgacactcgcctgagctggacctgcatcagcgtctactgtaccatgatcttgatgacttgatgaatcatcgatgcgtcgacctcccggttagctggcgcgccgacttatcgatccgtgcgtgttaattaatggcaagggctcccacataaccgtgaaacttctgctctaaaccctgcgattataatacgttatcatctctgatggttcagccatgtgagctattgctaataaagaattgaattgcaagttgctgctgtgtgtatcgtcgtcatggcgattttgacagttctgctccctccatgtccaaatatatttttcaaacacgtcaaacgattgcacattagtatattagaataaaaattcattcttaatatatttggatggaatcattcagtctactcggcgaaaaaaaagtatattacaagaaaataaagttttacttacacaacgcgataggtcgtaccggccatttctgaattacaaggaaagaactgcagggagagaaataaggaaaaaaataaaaactaaaagctgccgctcctaaaaagagggagagaggaggtgaaggaatcacatatcgggccccaagctccgcgcccaaatactttttactattggctgtcactgtttcaatttttatcggttaatggttttcttaaactcttttcttctaatatattgacgtgcaatctttttgcgtgtttatttttttttctttttctttaagatggttagactatgatgagtgggatattgaattattgatacttatgtttaggacgtaactactttgataataccaaactatttcttaagatttttttttgttgtaaaaaaaagacgtacaatcaaaattgaaatttgagtagttcagtcttcacccgataagtattccatggaaacggagggatcggagtaccatatttttgttagctacacggctctttgtgtgtgacggtcggcatgtatatatggtggtagatgccagcaacctacgcggcctttgccgcgccgttgcttagctacttcatctctaattatcttccttttggctagtggttgaggcagcggttgttatctgtctccgttatcatgtcgccttcctgttcttactcttgattttgctgtcgatttcctcagctcacaagggtcacagtcgcatgcatctctgaattgaattttgctgtcgattcttgcagttcagttggatgccgtgatcaaccactgtactcagccgcggttaattctctgaatctcttttgtcccacacggcgagagagagaaattatcaaatgaaaatgaatctgacgaagcttcgtaagccgctttcatcttacgacgataaaatcaagtcaaatcaggccaaattacccgtcggcctagctttgcgtgggatgcgtttggtctcgtctgcatcatcatcgctgccggtgaagtggtaagcccgccgccgccgccgaccaccgccttgaggcttccttgggccaggctctatgcgttctgggcttcacctatgcactgggccgtcgtgacttgggccgttctcagctttgacttgggccggcctcagctactttacggggcctggttgcttcttctggacttggttttccagtggaataagttcatctaaggtcccttaacttgtcaacgaatccgatttccgtccttcaaccgcaaaaccagatacaacgagtccctcaactatcaaaacctatgcagattagatccctcggcggtttttatggcggttttgactgacgtggcgcctatgtggctaatttgactcggtctcgatctgatgtggcactgacgtggcaatttgatccggaaaaataataaaaccagtgggacccacatgtcagtttcacacacaaaataataaaaaaattgtgggacccacgtgggccccatatgtcatcctctttctcccctctcatctctatcctctctctgtctcaccggtgggagaggaccacgtgaggtccaccgtgccgaggctcgggaaggccgatggcgtgcaggaggcggacctcgccgtcgacgccgccgcctgctccgtgcactgccacacctacgtcgccaaggacacatccaagttaagcagagcaccaccgttgccacgaacaccatttgatgacaacacttcttgaagaaatcgattggatcaagcaggtgctgcggatgtgcggcttccaatgaaacctcgtctacacgcgcgcgtgcatgtgcctcaacatcatccctctctcccggccgtgcgcgatcaggtgagacgccgccgtgcggcgacgccaccatcaccaccagtccaccaccaccaccacctcatcaccatctcgtcgtctctaaccgttcgacgcattaatctttcacgtacctatcgatacagtgaggcatcgacctatccaaggtggcggtgctcgtcggcgagaagggcgatatcgacagggagcgcctcctcccggggctgcacaggacggtgatcctgccggggatggtcgccgccggcagcgaagagctcctctgcgacgaggacgggtttaccacggaggacgtcgtggccatagagtcccccaacatcgtcaccctcgctgacggccaggacatcgccgccgccgccgacctcctcaaggccatctgagcgagctggatgctctgctctgctctgctcagcttcacttcacttttgcaaattaagcttgcttccatagaatattggaatggaagtataattaatcgagtcggctcaacggcggcacgcggctgcagcggcaaccggcgaggggaagaggaaggggcctcccgcagcgcctccttcttcgcaaggagggcgacgatggcggcctccatctcccccgtcgtcatctccataggcaggccgtgcagccccggcgtgccgcccggagatcctcggtgtcgaggtggctgcggcggagacggtctcccgctcctgctgccgcccgccacggcctcccacggcggagacgaccgttgagaggcaagaggggagctaggaggcgaagcggcggcgagggatgtggcggtggcaggagcggcggcggagtcggtggtggtgttgctggacagagaagagagaggaaaggggatagagatgaagagaaggagacgagagagaggaggaagaagggaggggtgagaatgacatgtgggttccaccatttttttatttttttctgtgaaactgacatgtgagtccccgtattttattatttttcggatcaaattgccacgtaagcaccacgtcagtgccacatcagatcgagactgagtcaaattagccacgtaggcgtcacgtgagccaaaactgccatcgaaaccgccgagggacctagtctgcacctgttttgatagttgagggacccgttgtatctagttttgcagttgaaggacgaaaatcggattcgttgacaagttaagtgaccttagatgaacttattccttttccagtagagagaactatagggccataaggtccaaggaccaccggcccggaccaaggcacgatcatttggccaggcccaagcacgacatggcccgactagtgtcgggcccgtgctgacacggcccgacagttgccttggcacgatgggctggcccgtcacagtacggtcgaagaaaaatagtagagggatacaaaatatacttaatcaaccatataaggcaaggcccaaagaaagaggaatacaaaatagattatttccagccatataagacacatcccaaagagttgagggggaaaaatagacttattctatggagaagcacaatggactgtcgtgccttcgggccaacccagcatgacccgagtcttattgggccatgtctgggccatgtgtgtagcccatgggctagcacggcatgccccgacgtgtaggtcgggccatgctggcctgactgaccttggcccagcccggccgtgccaggcagcccatttggccattatagagagaacagtatctgtagaaaatataaataattgagaatctgacaggaaaaaaaacattcagaaacctgttctttcagaatctgatagtaggaaaaatcatccaggaacatgttcattcagaaatctggtagggagaaaaaaccattcagaaaacatgtacattcagaatctgatagaaaccctgttcattctgattccagtaggcagccaagtagccaacgcagtgacgcacggacagccaccgtatggaaatggagtcaattcatgaagctagcaattgagtactgtagtaccatctggaaatggagtcaattcatttcatggagctatcaatcactgttgtacgagtataccatatgaaaatggagtcattcatttcatagtagtagtaattactgtactacagtagaaacaggtagctccatgttggttggaaaggaagtataaatggagatgcagccttgcaactgcagggagcagcaaaggcaaaggcaggagtgcaggaggacacagtggcatggggctcaatatcatcatcagagtcaggccaaacctgggtcaaggctcaagatggtccaacctgttgtttgtcagctgatacccatctctacctgcttgtcttccctcgcgtattctcgtgggtgggatcaccaaacaaaccaaactagtggtagcagctcattttgcagatccaacctcaccagatccacaaattacctggcccaattatgttcttcaggatcaggatcaggctcagggctactaaagtcagaagcagatgaaccaagccaacaacaaccagtgcagtaattgaagcagacactgcaccaaatggcgcggtttcttgccaaattccaactcccgcctctggttcaaaacttctggagcaaagcagtgcatattcaggtcagtacaaagcagaacaaagcaaatttgtgttcaacatattggtgttagcagaatagcagttagaaccttcttcaagccgaatgaaaaatgcaaccactggtgctaaaaaaaatcttacagaactctcacaaacaaagccatttgatttaactagatgggagttacaggaaatctagattgactcacagcatgccacatctgcgtttgtaagagttccgtaagaaaaaaaaaattggtacgcagggccagttcaatttgccaggctccaaaaagaacttgaagcaatggagagcaaaagagtgatgtcctgtacaaaaaaaaagggcaatggccatattctgtctcttgtaattggttctactaagaaccgtgtttgcttcaggactcatacagatttataaacctggcaaaaatctaatggctactgctataaactgaagaaggttacctccatccttatgaacaggtcaaaaggatatttttcccttttatcgcacatccaaatgatcatgatcatagtcagatcatgaccgacaatgttgtacataatgacacaattctgacttgtatttttgttccaccggggttactggtccgttgattatactcttcccatgggtgaaaacggtgggtcaaggacgatggatggaggtgttttttcttttcgcctctttgttttcttcttcttgttctcttttgtggttaccgattcaattagctgcttgacttcatccttcaggagcatcttcagtgagctggagtacagcttatgcttgaatttctcaataccaatggcagaagaaacttcagaacagtgaagcaaacaaatgcagactgaaaatgcctgcaatgctgacaaccgtgcgtggaaatccaccgaaaaatgtccattcccaactgccttcatcgaaatggcagggagagcctctttgttaccctgtttcaatgtttggagagcactaatcagtaacgtttgttactaaagcatgtaaactgccgtgtctataagtaaagatgtagtatatttctccagtacttttaagggaggatttaacaacatgatcttcaactacatctataaaaaatattatggcactgctaattcatgaatattcagacatactaaggtcatgatctgaatgcaggaacttaccgccttaattgtgtttgcagtaaaagtataacaaggagaaaaattataaggcgtacctgaaaaggtagttccataggatgcttgctttcagtcatcactgaatcaacccaatgactatcatatgcattgtcaaggacaacaattgggcaagacatatcccatccaccacaatcgcaacctccaccagtcttcaggcggtcaagtagaggtgatgggctgctttcatcatccctcggtaaaccatgtgccccgcctgctgcagccactttaatggtaccggatgatgagccgtctttcaattctttggattgggttttgtggaacggcacttggattacaatagcagcaacctccaaatgaggatggagatcttctcgggaccaaagactagatgttgatgcatccgagttattccttgtattattttgccgctccatcagattattcctctctagagaacccctagatatcgaattatttacagcactgcagaattttggtttgctggaatctgtacattgaattctttcaacagcagaacttcgtctcgcatgagcaatatcgtacaagacaaactcactgatggctgagttattcagaacaccattttgtccaacttcagagtacaaataggaagacacatgcatttggcctacaattggaggcaaacatccccgtctatcctttggggtctttccaacagtacttgttcgcttccctgtgctatggaaagtgtaaatccaattcaattcgtttccggctttccaaatgttagcataaatggattcttctgggcccttggtacagaactcaaaaccaaaagaatcattagtgggatccagtttaagaaccgcatgaagatgagttggtgatgaagtaaccgtcaaaacttgagcttccttactttgctggcaattaggtgtgaggctttgttcagtccttgagataccgctcaacaaagatttccgcaatacacggccttttccttcaaccagcaggctactatgtttggcatcttccttttccataagagacggattcctaagagacttggacttcatgataggatccagaattttcttgaatggactagatcgagcttttgtggtgctgttagcaccatgagtactctctggtggacatgtagcatcaaaaacaccaacctttgttgacaaggacttgggcagtttatttactaggtcaccttcaccatgcttactcccatcagaataaacatcaaccgaatgttggcaattcgatcttgcatctttgctacaggttccttctatctgtctcgtgtggacacttttgctggtgtcttcatcaagagatatctccaggaaatcatctcctgcacaatctttcagcagattgcagtccttgcgtggcctcccaagtcttgaatgttcatcaggaagctcacgcaatgaaagactaaggaactccctggtagcctgttgaactttactacttgcatctatggaagaactcggtttgcacgaacggctctgttgccgcgataagtaaggtccacttgtgctaggctgagaggatgagtccacaatctcaaaggacataaatgaatctctactgagtgcagaatctattttcctccttccttcttggagtttcctcagtctgctaacatcactagaactctggtacatagagccgcgcttgtgcatgatgctatcatcttggtatgcctcacgtcggcttgaaggcaaacttttgcaatggaaatttggaatctgctcgaggtgcagttctggttttccatctgggcatttcaacatgtggtgtctgcccggttgcacttccctgctaggactgtctgcctcctcattgatagattgcattgcttccttagctactcgttgtcgagaacgatttcccatagataaaacctgcatgtcatcaaaccattatacattattagatgtttaggtccgtagcactattcaaagaatcattttttttttttgctgcaggaaaggattaccgccttcttttgttttgccaccaagcaaataatttctactagtacactgcaatgaaaaaggtggatcaatcttaagatccacccacccttctgtatcttataaaggtagaaatctacagtcatacacaagcatacaagcagtttgagcagggaatgatactaaaataactaaccaagagaaattggggtaacaaactggatgctgggatgcaaaacgagatagacaatagaagaaatgttgaaatgatgccctcatcagtaaaggaaaaggtgggcgcagtggcgtcatccctaatcttagaaccataaaaggcaactactataaactccatattagtagcctagtaggcaagacaagtttaagaggaagaacacaatatgcctaactaaaaaaaagatctacttaatctactgaatatccaccctatattatcaggaaggattaaaaaaactgttcttttttttttccttttttaagcgcaaactgtttcttttctcatataaatacagtgcaatgcatttcttgcatccaaggaaacctcgaatctgttaaacaaaatctgagagaaagatgaacatgtccacatgaatgccagtcaaatccctccaccaaacagccaaaactcttcctgtccaaaaactccacagcactctcgcatctgcagcaaatccagccaatacaagtcccactgggagctcttgaggaaacacataaacagcttcctccaaagaagagttgtccctctccagactccacccgcaaaaccaatccaatctcaatcaccccaacccaaatccccaaccaaccacctcaagaacacagccagccaagaacaacatctcccatgaactgaaaaaccttctgaagaatgaatcaagaaacgcccattacctttgcaaggcgaaaaccagatcaacgctgaagaagagctaagattcctcgagctcctctctcactcactctccctcttgagcgagtggagtgaggatgcaagaggcattgggggcagtcgccagcacactcttcttggtttcgcctctcctcttcctgagctgagcttgctgctggcggctggcgaaatattctgaaatctctttgcgcgtttactagctatactagccagatacggagatgaaatatcgtcctgacacgaaggactaaagtgcaagattgtgtaggaagtgaagtgagtggcctcggatatcacgagctcgagggggtgtcctcctccagctgttgattaggccacctaatgattaattagtgctcaattagtagcaaagggtattttaattggctctctgggagaacgtgtcattgctggggagtagtcactgctcacagtggagttctttcttgtttctgaactgcgttacgttgcagtttagcagtactgctgtaaaatacgcgtgaatattagagaataacctaatatcaaatataattagaaaatgtgaggcttctaatttagatcgtctagtctatcatcttatagagatagccgaaaattcctgggcgtttctctaccagtaccactatgatctgcattgccttcaaaatggtcttgtaaagcttcctttttttgtcgttaattcattaatctttgctggaacaatattcatattaatatatagagtaaataaaaaagcactgaccttggagtgatggaccagtgcggcgttgagaaaattttcagctcaagacacgagaagaaataatcgccatcctggtggttgcttgcaacctggacgatctgaaattctgaatgctgttcgtctacctcgagccggaagaaatcataacgccgctccacccactatagattgcgtgcacttgactggatcatatcagaagctctcctgcttctttctgcttacggccatggccccccacatcaccgtagtagcatatagcacggctgcacgacgagcaaggccatggatgtcgcgcaggagtgcggacgacgtcactgacacgtggcgagatctttgaggcagggagggtgtggggaccactttctgatcaccgtgggctccactcgccagtcgccactggtttctcttcttctgccccctatcatcatccacctccagaatctcctctccacctttgcctctctctccctttcagcttttgatgattcgatcacctggtaacatatgaacattctgattcaagttagctaaacaatgctcaaagtactctgtactcaccatttcatcaagtaggtaaattgatgttcagacacataatcatctgatcaaaccaccgacagtgatttcttcaggctggaacatattcggtaaaaaagagctaagtgttgaaaactcgtgaaaatcatacctaaaaattttgtaaattgatgaaaaaaatattagagataaatgtagatatgaaatacattttcaccaaatctcaactccaaactcaacttcgtttaagagatttggtgagaatatatttcatatctacacttatctttagtatttttatcatgaatttacgaaacttagctcgtttcgaacacttagctcgttttcaccggatatatcatcgttatataaatgttcagttgcaagaactactagctatagcagcataccttgattactgcccctgtgatcgatcttgagcttacattaggctgaacaacctaatgtatgtagctggacaaatatttctgatgcgttggtcgcattatacttagcttaggttaattagccatagcggctacacatctaaagatgcagtcacgttgtgttgccttccaaaagcatcaacagcaagcatgcaatgcatgatgcgtggcgcgtcccccacaaaaaaacacaatccgacgactaaacaaacaaaagcatcgtcatcaacatggggtgagaacctgtcgtcaaagattcttggcctgatccacaaaccaccagcttaattagttagcttgtctcctagcaattactactgctaattagtcagtcacacacttgctgctggtcctgagaggctgagatgccctgtgccttttacccacatcttttactaaagtcatcctagtgctaattgactatatatacttgctaagtattctcttttttaatccaacaattgaagaaaaaaacattggaattggtctatttgcaaggtgcaaaatagcagaaaaaagagagagaagaaattactcagggtgctgatgagtcatgacagagatgcatgtgctaacctgcagaaacctcaaccctgtagcctgtaactctctgcaataaccaaacaagcgcttggttcccttgctgacgagcaaaaaactggcctgaatgcgactatgaacagtgtggtatcctatgtggctaatgcagccgtgcttgcatttcagagtaatcaagtaattggtcagaactactagttacagaagcagaagcgatatatagtatttatcatgcaaaatcgaacctgctaatattcagagtttcagaggagggatgatcctgtttcagtagctacctgtgaactaacccgtgccgaatttgtacccccgaaaaatcacatcctgtcacagtgtcatatgttcgtagccggtcgcagcgatcaaggtgacaccaatccgaaagcctgaagctcttaactgtgtgagtgccgtagtagcagacagagggaaagacaaggtgactgtagaatgattaattggctcgctccatcatccactgttcatgcacacggccatgaaatcagacaaggcaaacattagagtacactagcgtatttaataatgtactgtgtagattggaaaaggctggagaagctagttttaccagagcatttcagaagttaccttgatcacgagaccgatttactgacgagcaaaacaatgtgccaacaattcgatgttttctacagggtttggcatggcctttgttgtgcttcttgatttgatctacagttctgtgcacttgatccatggatgcatagatgccaagtacaagaactggacacgggagggtactagcacttgattaagatcatagttaattagtaactaagaatatcgatgcatggacgattgctgctggatcccgtactgttgtctgcccaaggaacccctaaaattaatcgagtcaatggccctcttaacttcaggtcttcaaccctcgttagaactaattaagcatcgtggagaaattagggttggatgcatacctccatccatgaatctaggagtcacgcgctcgcaccggcgacggtggtcacggccaccggcgatcgccggcttcgccgcctcgccggatctcgtagccttgcctcattctgttcggccatcggcctgcatgctaagtgggctggcccataacatgggccaaccttttggtcctatgtgggccgtatccgttggcgaattgggtctacattttggtggacctttcatgggcctcctcgacagcccgaggaccagactgggacggcccaggatttagtgggcctgtttagcgatccaaacaagtatggactttaaagtcagataatcagaattgggaaaagtacatcagaggtccctcaacttgtcatcgagttacagaatcgtcccccaaccacaaaacagatatatgacaccccttaatttacaaaaccgttcaatttaggtcctcaggtggttttgaccctggtttatccgacgtggcggctgagtcagcgtgggaccacgtgtgccccacttgtcaggtgtacacgtcagcacctaatctttttcctctcctctctctgttctctctccttccttcctccctctcgctctttgctctcgctagggataagcacggcggcgcgcgcggcctgagggtggtgcggccggcgacgagcggcggggtggcgtggcgatgcggcggcggcgggccgggcgcaggcgggcgacgcgactgcgggcgcggaggtggaagcagatggatgcgacgccggcgagctcagggcagagagagagagagaggggggcgagtggaggggaacagcggtgccgcctgatgttccgctcgagctgcgccttctcgatctgatcccgctccatctcttcttcctcgctggcgtcgtcctcctcctcctcgtccgggctacaccgccgtcgtgctttccgtccggcatcgtgcatcacggtcacctcatcgtcttcgctctgcttcttggccatcgctgccgccgccgccgcggggcaccctccctatgcggcgggggtggggggggggagcggctggcgacggggcggagaaggtcgatgagcactcattggcgaaaaggctgcagcggcgggagcacgctcatcggcgaaaaggctgcagtcacggctggtggtggaaaggcggcagcggcgctcgccggcggctgccgcgtgtcgtctccgcaacactggcttccgtggacagtggccctacgcccctaccccctccttcccgctaaggaacctccgcgagctcgccttcatcaaccccaaggtatcgaccgccggcgagaccgcgagttccttaaggccatcctcggcaagctctagggcaaccccgacgtcttccaccgccgccgccttcttcgccccaccgtcaccactgcgccgcagctcggggggattcggcgtgcaccagggtgcatcgttgaacgaggaggcccctaccgctctctcgatggacgcctctccctgccagccgccaccacctcggggggattttgcttccaccttcgcctccgccatcgtcggagcttgtcggggtcacttcccccaaccctccgaggcgatgggcctaccgacacggacggcgatacgggcgccgtctccgcttggagcgttgccgctagcgaccaagcaatccccgccgcacaccggcgccgtcgtgcccctcctccgccgcacactggactccgacggggccgatggtggttagagcgagagagactttttttttctgtgtgttatgacacgtgggtgctgactcagcattgttgactgaagtcaactcgccacgtcagctaaaaccggtggcaatactgccttaggacataacctggttttgtaagttgagggatgttatatatctgtttttgtggttgggggacgattttgtaactcgaagttgatggacctctgatgtactttttccatcagaatttgtcggaccaaactttggtgggccagcggcagcgtcttatctgtataacttgggggaaaaagtacaccggaggtccttcaacttgtcatcgagttacaaaatcgtccaaccgcaaaaccggatacaacgcatcccccaacttacaaaactaatacaaactaaatcccttgacggttttgaccccggttttatccgacgtggcggctaagtcagcgtgggacccacgtgggcaccacatgtcaggatgccaagtcatctctttcccctcttctctctcagttttctcatctaggtgggcaggccggccggcgggttggggagaaagccgacagggtgaaacgggagaggaggaggtttggcgaccggtggcaggcgggtcggcggcggcctcccccacgccatggacgacgacggtgatggcggcctcactctccccatcccgttccacatcggcgccatccgcctcagctctcccctctccccgctcttctcctctctccgccctccagat

SEQ ID NO: 58300 - DNA, 11962 bp, Oryza sativa
ccaatttcacagcaaacacacaaagctaccagcgcaagcactacaaaccatccctctcacttggccattctcgtgctaggggctcgacatactcggtccattctcacgaggacagggcggctacagattcctgttcgtggcgatcgacaaattcaccaaatggatcgaggcaacacccacaggagaaatcaaggccgacaacgccatcaagttcattaaggggatattttgccgatatggattgcctcaccgtatcataacggataacggctcccaattcatcagcgccgattttcaagattattgcatcggactaggagtcaagaaatgcttcgcctcggtttctcaccctcagagtaacggacaggtcgaatgggcaaacagcatagtactacaagggatcaagacccgtgtctatgacaggctcatgtcacatgataagaagtgggtcgaagaactcccctcggtactatgggtcgtgcgcaccacaccgacatcgtccaacaaggagacacccttcttcctcgtgtacggctcagaggccatgctccctaccgagttacgacatcagagtatatgattacagaagtactccgacgagaatcaggaggaacagcgaaacgacgacgtgaacctactcgaggaatatcgagaacgggtcaccgtcagagcagttagctaccaataggccctccgccgatatcacgagaagctcatccgagcacgcatactttcgatcggcgactacatcctccgacgagttcaaagctaggcagggcgaaacaaactctcgcccaaatgggaaggaccgtacacgatcacacaagtcttgcggccaggcgcattcaagattgcagatggcgatggtcgcgagttagcaaattcttggaacattgaccagttgcgtaaattctatgtataagtcaatagtttccgtacttgtaagaagtcttacaacttcaataaagtctgttttaaggaacagatttcaatcacagtgccccttcccgatgatcccttacccggacgacacatagcgttgaaacctatcctcatgtccctttacgccgtcttgacaaggcctccaaggaacctaagggaacttcggctggggacacccagagctgataaggccttgtcggatccttcagagacgaaagaccatgtaagatatggtcgtgtaagagttctcgccgtgcatattaaccaagccgtgtaatcggaaatggatttttccaacttcacgactaggggctaggattagtgcttattcaactaaggcaagtcgagagtccaagagccttatctcccgagaagaattctccgatgacaaggctgggggctagggagagtgtataactcaagtgactgatcgaagtcgcgaagtgagaagacactcgtgcacaccgcatccagcgtaagaaagcttagttagatagatttcctttctgtttcacaagcatttcttatagatcgtaaagaatcctaaaatatattacaattttcttaagatgtgtgtcacagatatacaagcaataccaggaaggccaacgccaatccattgactagaagattttctccgccagcggagccatcgactttgctaggttgtctatctccgcaggattcctccgagaacaggaaaaacccttgtgaaggaactcgagatgcaactgcggacgatgatctcgtacacacgccagcacgtgccctccggcgtatcggctcgattgacgacattcctacttcagggcctcgtcgatacgcccaccgatgccatcaagctgagcacaagccccgttcaaccatgagatgaagccagccgctgactcctcgggatccccgcgaggtactcagagctctctgcagacaacgaccatggttggcaacaactcctgaggtacgagttgaaccatacctcgcgacctcggagcgcctccacggcccggtccctcttctcttccaatatagtcctctcaagttcggcgacctcgaacttcgtcctccagtactagatgcgacggtcgcgatcagcaagcatgctctcaaggtctgctcagcatgcaaacacctaagtcaagctaatcaagacagacgaggtaaaggaaagggaaacgacaagaaccaacctaaaggagtcgacgccacatccatctcctcgggcagatcctggtccatgccgtcccgcggcacatacggctcgagctcaagtgccggaacgactacaggcaattcgggatacccgtgctgttggacatcctcgacatcggcatctctacaaacaacaggcaaagtacccggaatcaaaacgccaaagaaaactaaggtaacgattgcacacacaaaagaagttggaaccaacgaaaagtattacaaagcgcgattggttaaggggtacagacaagcggtggccctactcttcaaaaagcgggaggacggattcccccaaatcaccgacttcttccatcacatccttgcgcgcgtcgctagccgccccctgatccaagatcttctgaagatcgagttcagggtgcgccagcttcacacacgcaaggacatggcatgccccggtataaatcccgttagacgtctcctctccgatcctggccgcgtgcttggagaggatcgcctccatcactgtcgcaagttccgcaagtgaagtcgtcagccataactcatcgggattcgccgggatggtggtcttgacaccgtactccccggcaagctggtgcagactagtgtaggtgacccgcagcgagccacggatttccgacaagttgttctcgagctccgacatacggtgctcgagcccctgccgttgtcgctcgttgccggccaccagttccctcatcttctgtaggttctcgcgaacctccgccagatcatgcatcagccggtcggcgcgctcattcgccgatgacgccgccgccgccctcgcctccgtgatcttgcggctaatgccgcgagcaccaacctcaaggaggcgccccatctcgacctagagctcctcccatgtgaggacggcagccggcgcaccccgaccagccgcgagattgctggctgggccgctgggcctcacatcgcggctcctgggcacgaccacaacatctgtcgaggccacggtaggagacgcgctagaagtccctccagatccgtcttgcgccgctttcgcccgcgccgccctgtgaaaggctacaattgagacgtgctgcatgagttcgacgaagtgacaaaacctcaaattcatccacttctcgcccagcgtcacaagccgctgctgtcgcggaggcgggggagacgcatccgaggcctggagtataacgggcgtgatgtgaggtgcaagttttccgactacgtgatgatggaccaggagagcttaccgagggggtgggcgtcttccgacgatttccgatcatggaggagaatttcctcccccttttcagaacgttgccgccacttgttgtggcagcagcggcagcaacatcaaatgcctccttggcgacgccctccttcagctacgccaccgcctgatggtccacgagcggtccgatgatatcagtcagagggagagcctacacttcgtgaagtcacaatgcgatcccggaagaaaaatgcaaaagggtcgccgagtacactcacattgatggcagcttcgcgttcggctgcccccttctcgcaaagagcaacagggacgttgctcaccgtggtggggccgctgatcatcacttgaccgatgcgatgctctacggtttcactgttcaaacctgtagatcaagaaccaaaatcgataagtcaggaggaaaccccgaggagaaacccgggtcgcgtcctccgaccctgagtagtcaaaggctggatgggctcaagcctggagcggctggatccgtctaccgatgaagtcggcagcgacttaatactccgacaaccctcgcactcggaggtcatcgatgacatcgatgaaagactgaagggaggggtcaaggcgggcttggcaggccaagacgaaatcttgtctggttgctcctcgggaacaacaaagaccggatccgagttttctatctgaagatagaaccacctcgcccgccatttactacgagaagaggggcactggaaggggatatagcgcgacttcaggccatcccgaagtcggaaaccaacgcatcctgataccctattggattccatccaacgcaactcatagtagaagcgaaagaggtcacgaaatagttctaccccaatgtaggcctcacaaagatgagaaaagatactgaggaaggtgatagagttggggttcaaatggagcagagaaagaccgtagaaattcaagaccaaaagaagaaactcagagggaggaggaaggaaaccacagagaatatagtcctcaaccgcaaccatgcggcccaggacaggttcaggttcaatacctcctggttccctctccatggtcccgcgatcggggagagcgccttcctcctacagcttcttcagcgacgcgcttgtagaagtggacttgtcgaggtccattcccgtcgaagatcgtcggagaaggggctgagatgaacaagctagggtttgtgtggaagcggagaagacgaagagttcttgaaggcttgaaagtttctcgcaacagccggactccaaaatggactcccaaaactcccttaaataggtgcactaccgacgatgcgaattccaaggaaaggagagagatgaccgccagaaatttctgggaccgttgcgcaaggcggtttcttggacttcaatttaaattcactcataaccgttggacttcgcatggtattgtcgatcactctttgtctctacggtccccacactgagatcgaccagtcgagaacgacaacaactccgacatcagaagtcatgattggttacacgagttcatttaagtagaagtcgggggctactgtcagggttacggataaggtataccctctacccttggatgtatgctatacggaaatacggtatagcagtacataatcagacgttctttgaacacactaaggaaatcaatcacgaagtctgccaatggaaaagttcctacccgtataggaatggatcgttactatatcgtacagggtccgatgtctccgagtcctacttcgagaccacctgacctgcgatataaaagggacccctcggggggacctaaggcatcgaatctcagagcctatacaacggccacagcttacgaagtcagagactacaggagcaagtcgccaggtgatctagtcgaataaccttgactacgatctcgtcggtaccgccgagttctattgctccctttgtaatatgtggttcttttcatataatcccatatcaactgattagggctattacctgctaaggagcttgaaccagtataatcgtcgtctcttgtttcattgatatcgtattacgtagatcctcgtaccagcgtaccccaataccctctatatccggtctacgggtacccaccttcgacagaggggcgctagtgagaagagatgccgagggagagagggagtgtgtgcagcgagggagagatgggtgtggggtgccgggagggaaggagggaggcaggagaggacatacgccagggaaaagagaggctgcgggggagggggagaaatgggggtgctaggagggagggaggtagaagcagaggtacgcgggagggagaggggccggacggacgaaaggaaggcaaaagccttacgtatttttttaattattaggtatatagatatagacttgtgctataatctatctatctattatatattccatccgtttcacaatgtatgtcattctagtattttccacattcatattgatactaatgaatctagacatatatacctatctagattcattagcatcaatatgaatgtgggaaatgctagaatgacttacattgtgaaatggaggaagtactaaaagtccattaaacttcctacaaacgctcctatgtctccacgtggcactctacaaacgctccgaagctgccacgtgccaaagaaacatccaacccttgatttttatttaaattagtgggccgatccttttcgaccattagagtagatgtcaaaaaaaaataagtaatccacccatactaatctacctccaaattgagcaccactctattcgtgcaaatgcatgtatacgtacgtactctgtacgctcctattcccattcttctcttttcattctattatctatatttaactctcctattttccttctcctaatagaaagcataaatttatgtaaaaacatttaggcaactatagcatttaaatcataaaggtattctaatatgcttatgttgttagattatttataaagtaactaaatcatatatatatgttttgatcacactactaaaaaaaggcacatagagatcggtgttataggtgctagaagtgataaaaccgacacctatataccatttctcacctctacgggttgaaaatacaaaaaactagcaactttaataaactataggtgccggttttctgtaatataggttttctgtaatataggtgctggtttttttaataaaaactgacaccttcaatttataagtgtcagttaattaaaaaacgacacttggtttttaaaaaactgacactaaaaatatgagctgagccgaccggtggtctcgagcggacaaggctgagagggctcagtgccactctctcgcgcgcgtataagaccgagagtttctcgctcgttctctctcgcgctcctctctatctttctctatctctcgctctctctcgtgcacgctgttgacggtcgttagcgatcagcttcgaccgtcaattttaccaaaatagaggagaacgagttatgcttgcaatgcatattcatgttagaataataatattccactagtatttggttcactaaccttttgtaaagaataaccctaaagtggtggagaatcgacatcaactcagacgataaatcaatcggacgatgtcgagaatcagacttatgcatgactgggccaagaactcagaattggcatgatgaactgggccaaaattcacaagtctgcgtatgagagcaacggaggaggccaccggccgattttgggccaggacggcccgacccatggttcggccgaaccccccgcagcgccattcgatccaggtttctcctggacggctgagatggctccccaatgacggttggtgagtattaccgacctttccaaccgtcacaaccgtcattctcaagatataaaaggagctctcatcctcacttcactcacacacctcaagcaagagttctctcatattctctcaagttagtttagtgttctcaagctagtggaataggaatagagtataaatcggagtctggaagccttcggaagagttcgggtatggctctagtagctcttctcttattttttgtatttagaatactcttctatatacatttatggtattgaaatactttccgagtatatgaataccaactttactttatgttcatgttatactgattatgttgctagcttatctgggagatgctttggtacgggtataatgtttgcttatgcaattactctatgtcatgacgatgatattagagtagtatctggtagtttaggcgttgtgtcaagattactggatatcattatttgggtttatatgctgtggatgagaagtgggccgctgatggtgacagctcagtacgggtattcctccgcgcgtgtatattgtcctaagttaattccctggggagggtactgtcgcgtcccaaaacgaccctaaaatacatcctctaaattatgcctagaataattaaaatccgtgtgaaagcctccaacaattaaaatgtgcaaagttaaaagtcaaataaggcttgcaggatttttgtatatttcctaaaagcctaaaatgcgtaaataaattttagtggaattttcagagcacaaataataattaagaagaaataaacaaagttaaaaaggttttataaaaagaaaaaccctaaaaagtctttttccccccctccacctcttgggccggctcggcccacctccctccctctctctcctctcccccgcggcccatccggcctcctccccgcgcgcgtgctgctgacgggcgggctcgcccgccaccctcgctgacgggtggggcccacccgtcatcccctacctcccgccgctcccgccgcctcgcccgtgccctagcgccgccgccgccgcaaatcccgccgctcccgtccgccccgcgtgcaatcaagaggggggaaatattccccgtgattccctccctctttccccccacttttccctctctctctccatcggattcgttcgggatcttttcccctaaacctcgccggcgcatcaatggcggccggatcttccgcggccgtttccccctcatccggccgctctctccccctcccaaccctatataaacactccccgtgcctccctccgccgtttccgaccctcgccgctctctctctccgccggaatcgagctcgcgccgtcgctctctctctccgccattgccgccgagctccggtccgccgccgtcgtcgccccggaccttctcccgcttcggcgtcgccttcttcgggttcgccgcaacctcgccgacctcgtccacctctccgtttcgttcgccgaccgccggaaccccgccgtccccatcgacccgtgccgcgccgccgccttcctccgctccggtcgccgttcccgtcgtcgccgtcgacccggggtgagccgtggactgccgattcgcttcccccttccctcccctctttcgggcgccgctccgccgcgccggtggtcgccggcggcgaccataggggcgcgggtgcaccgcctcccgtcggctgtgccggcgtggccgccttcgggcgcgcccctcggctgccatgtggggcccggccgtcagccgcccgcgccctcgggtgcggctgacgcatgggacccacggcgccggccggtgtgagccgggtgcgcccggtccaccgtggaccgtgaggctgccgcgtgggccccactcccgtggacccggtccgcccgccctctcccctcggctgacggaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcattgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattcttaggtttggcaggatactaccggaggtttatcgagaacttctccaaaatcgctcgacccatgacacagttgttgaagaaagaagagaaatttgtgtggagcccgcaatgcaagaaggcgttccaaactctcaaagaaaagctggtttcctcgccagtgttaatcttgccggatactcgcaaggacttcatggtgtattgtgatgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcggcagaggagatggttagaactcatcaaggattacgatgtgggaattcactatcatcctggtaaggccaacgtggtcgctgacgctctaagtcgaaagagccattgcaacactcttaacgtccgtggctttccacccgaacttaaccaacagatggaagccctgaatctgagcatagtgggtcgtggattcttggctgcgttggaagccaagcccaccttgctcgatcaaatccgcgaggctcagaagaatgacccggacatgcgtggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtaccagattaaatttcagcaccgcgtatcacccgcagatagatggacagaccaagcgtctaaatcagatcctagaagatatgcttcgcgcatgtgtcctagatttcgggaagacctgggataagagtctcccctatgctgagttctcctacaataacagctaccaagccagtatacaaatggctccttatgaagcgttgtatgggcgcaaatgccggacaccgctattgtgggaccaagttggggaaagtcaagtgttcgggactgatatcctgagagaagctgaagcgaaggtcagaaccattcgggataatctaaaggtggcacagtcccggcagaaaagttatgcagataaccgtcgccgtaacctggaattcgcagtggacgattttgtgtaccttcgggtcacgccattgcgaggtgtgcacaggtttcagacaaaagggaagctcgcacctcggttcgtgggtcctttccgtatcattgctcgacgcggagaagtcgcttaccagttggagctgcccgcctccttgggcaacgtgcatgatgtgttccatgtgtcgcaactcaagaaatgtcttcgggtaccgtccgagcagactgacccagagcaaattgaagttcgcgaagacttgacctacgtggagaggccagtgaaaatcctggacaccatggagcgcaggaccaggaaccgggtaatccgtttttgcaaggtctaatggagcaaccatgccgaggaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataatt

SEQ ID NO: 58301 - DNA, 20778 bp, Oryza sativa
tgttgcatcgcggcatctagatagcagtacaaatggtatctacacgcataacaatttataaattgcaccgaccatcattgttccagcctcccagatcgctcgtcgatttctttcagtttttcgtctactccgatgtcgttcgacggggtctcccggctggagacgtcgccgccgccggcgttggaggaggagatggcgactgtgactcaggcgccggggctgtcgacgccgtccatgctcggcaatccagatggtggagctccggcggcaaccatgatccagagcgcgccgtgcgccaccggcggcgaggcgttggtgggcgagggccggctgcgaaaggggaagatggtcgccgaggaccagagcccgccgagcgtcagcggcggcgcaccggctgacctgcctcccggcggcgacaagctcactgagaacggcggtgacactgacaccctcctcctgggtgcccgttgttcgtggatagagaggatggtaggacccattgacatgtgggtcccactattttgtccttttgtatgactgacatgtgggccccatgtttttgtttttattttttatttttatattttgcttccagtgccacatcgtcgccacgtaggacgaggaccaagtcaaactggccacgtaggcgccacatcggctaaaaccaccatcgaaaccgctaagggacctgctttgcaccggttttgatagttgagggacccgttgtatctggttttctggttgaaggacgaaaatcggatacctcaacaagttaagggacctcaagtgaacttattcctttcctccccttttccctcctctctcgtgccttccctcccctcggcccgactccctcctcccgtccttctccttgggccggcccactcccacctctcctcctcccgcctgggcctgccccggcccaagccgagccgcagccctcccgcggacgtgcgctgcacacgctgccacgcgctggcaggcggggcccacgcgccggtcgtcgtctccttcctcctcccatccggtctcctctctccctcccgtgaaaaccctagcttcttgctccctcgaatctgccccattcaaaccttggattccaaaattcattaggggaattaattcccttcccttcctcttcaattccccctaatttcccccttgattcgtgctctcaactgcccggaacggccgcgctaatcttggccaccttctatggccaccggccgagttttctgccgccgttccccgctcctcccgtggccggctcgttcccttccgctataaaatggaatcccctcgctccattctctcgttttagccttctcccatgtctccccgtggccgcaccacctctccccgtcgccctcgtctctcccgtgccgccggccacctccagccgcctctgccgcctcgcccgtgcgccgtccggctgttccgtcgccatcgtcgacgtcacagctgcctccccttcatcggcatcgcctccgtttcacgggaaaatcaccggagccgcatcctagccggcaaacagtggtgttgccgccactgcaccacctccagccgcctgtgccgcctcgcctgtgcaccggccgacgtctccaccacctccctcagctctgcgacgccaccaccttccccgaccttaccgtcccctcgcccgaagctcgccggaacggtgtcctcgtcgacgtccagtggcgttgccgccactgtaccaccccagccgcctgtgccgcctcgccggtgcgtcggctctcgtcgtcgccgcctctcccggcacagcaacgccatcctccacctcgggcactcctcggttttgcccggaagccaccacccgtcattgccacgccggcttctccatcctcctcgccggagtccctccggcagccccttccaccgtgcccgtgcgccggccgtcgtcgccatcaccttcggcatcgcagcggcaagatcgccctcggcctcgcctcccttccacccgaaccccgcaggtgttgttcgtcgtcgtccctgtccgtcctcgccaacgactccttcagttggccgttcatcctcaccggctcgtcgtcccgtagcgccacctccgtcatcgtcattgcagcgccgtcctcgcatccgtgcagctgctgccggctgccctcgtcgcctcctcgccggccccggtcgtcgtcgtcctctcgtcgttcccgcttgtcgtcagccctcccttcatcaagccgtgctcgttcgtcgcccgcgtttcatcaagagtgcgtcgcagccccgtcgtcgtcttcgtcctcagctccgtgtcatcaagcgttgcgccggccgcgtctcgccttcgtccaaggatcgcagctgaagtcgtcctcgagccgccttcgccgtgcccgttcgtcatcgtcgttccgcgcctcgtcgcgtggtggtaaggaccctctccctcttctcgctgcctctgtcctcgtcctttcggtgttgcccgtgcccattgtgcggttgtcgaccccggtacccgtgtaccggtttcggtagttgttcgtgtgtgcatgtggtgaccatgtttgtgtgcccgctcggtagccgcgtggtttccatgtgtgcagcccgcgcggtgtctagtagggtccgtttgtcggccacttgcctcgattgacacaaggggtccgcttctgtcgacccgtggatcgtctctatgtacctggtctatcgtggtcccttaggttgacatgtggggtccgtatgtcaacagcgcagccttcctatcttttccaggctagcactttcacacgttttatagttgcaaaacctaattataataatccgtaaatctacatgtaacaacattaaacttcggatgaccatgccttggacatacgaactctgaatcgacccgttcaagtctcttaatgtttgttataacctaaagaatcctatcctttctttttatctattgttattgcttctttataggcttgtagcttcgcttgtatgcttcacgtagctttcgtcgttccgaaggttcccgaagcatggtttgcggtcgtcgccgaaggttcggaaagccattctctctgagcaaggcaagtcgcatcatccttgagcatattgaatcccagtttataaaattattttgatttaaattattgcattaccgctttttttaaattcccgcattatcactgttttatttagcacttcctattaatccttgttatagccttaccattgctattgtttattatcaccttgcttaccctaggaaaagaaaaccccaactagtgggtaatctactcatggttccactagtatgaatttaggtagatacttcgctgattaattaggcaacactaggtggttttataactttagactttgagagttctcatatcatttggacactgtggaatggttggcttgtgatggaattgaacacacatctccccccccccctctattcaaaactccaaaaatggttttaggctgggctcgaggtgcatggttttgctaggagcacctcggccaccataaggaccagtcttcgggactctgttgcaaagcactaccgtactaaccacatgtctaattggtaaggcttaactcggtgctcaatctagtcctggcaagaggacacggatagagatggacgaagtcagggctcgatggacatctctaggataaatgaaggctacacgggctgcggctcggtagtcgagatgtcatggcacaggaacggtgttctgctgctaggggctcaatcctggcctacctgtcccgggattacggccgtaggcgaggttgggtcggtgcttttgtcacggctgggatgggtaaaggggttatgtcacattctttatgacgggttccacggccgtggtatgcggcgtaaagatgtgttttgtaggtaaagatgtacacctctgatcagagtataatctattcgaatagccacgccctcggttatgggcaagcctagcaatgtacccaagttagtggtttaattcttaaaacttgcttatcaactaaaatgtggaatggttggcctgggttggcttgggacgagctgggacccaggtcaggttgccagttcggtctgaatcatcgtaggccttgggttaagtcaggttcatgtggattcacggccttgattaataatattgtgtagctcaaggatagtgcttgtaaaatagctttgagcaactaagtgacttttaaatgttgtttactgcaaaacctaaccctatattattaccccttgtacccccttgcattaatcctgcatctcccggtgtgacttgctgagtactgtggttgtactcattcttgctctatcttttccccccttcagtcagagaagctttggagaagaagtcctaggtggagtcctggcttataccccagttgagctcctgtgaagatggagccgtaggcccgctagtccgctactgtttatttttgattgtcaggcctgaagtgcctttgtaataatgtaaatattatcaatataataaagatgtaccttttgtatcatgtttgtgtggtgtaccccggcttttcctaggacggggattaatacactagcgttcgggaaaaggtatttttccaggtgtgacactgggcaagtgccagtgaggactggtggcgtgcacctcatgacatacagtggggggacaaccaacccccacagatcaagtggtatgcctccatctccaagtgaatggcgttcaaattcctctcgttgggacttgggtgaaatcaccaggaaaatggacacccttgatgtgcatacgggagagatccaatataacctcatggaacacatagcccagacgcaagaatggcaacaaactgctgatactcagttcgccaacatcaacaatatgatgcagtcacagcacgatgaccttcaagcgtacttctgctttcaggggttcaatccttaccaaggaccctaagcgaaagctaagcttggggggagacatctctccccccactgaggtaacttctatcacattgcatatttcccttgccaattgcatatttgctttccaattgcatcttataaacttgaaaacaacataaaaatttgtaaaatagaaaataccaaaaagatagtttaggtttgagtcatgctaggtaagacgaactagttttatttgttgaaatgatgaatagttgctctgttttatatctcttatatatgggttcataggtaagtgctctctcaaaggttaaatataagtagccaataattatctgggaacctgaggtaaatgtgatgcacttgcttatctgagtctaagccattgcaagatatgagatagtaaataagagttgctatgatcctagtcctagtttgacttgaatttcggacttgaagttcctcatttgatataaattcctaccagagctaaaaatgtgccatcataattgaactatatacattttggttacttgccattccattgaactttgttatattcttgtgacttgtgtagttacttctcatgctttatgatcaacatcatacaccgacatatatgcacatgctaaactcctacattgcgagctaagcaattatccattccatttccatactaccaccaaaataaattctccatgctttcatgtgttttcttctcctaaaaaaagaggagggaaaggcatggttatgaaaaaaaaagagagaaaatataataaagttatgctctcaccagcatgagcatgatattgaaaatgtagccatgccctctcctaattaataaaagaaggatttttgggagaagaaagtaagcacaaaggagaagcatttcctttattttcctcatataccatttccaccatatatcacacacactttgcacgatcttgatcttgagtatgtttagtcatcagctttagtctaagtttttgacttagtaataaatgtgaatgcaagtatgccatgtttgatccctaccgagctccacacattaaaccttagagtaggaatcaaaaaggcaatttggcgaggatttcatattgatacacttggagagactgagtgaatcattcgaggaacttggatttcttttgcaaaatcatttgaaaaactttcggaatgaaagttgaataaaagattgggtgattagtgctctaattactgttatgtctttcaaccgcccaaggcaaggagaagcagtgtctcgtgggaatcaggggtaagggtaagccaccgtgccaaagattatttaatctgagagagagtacatataccttgcacttgtacctttgagatatacagcatagtagcaactcctgatcaacaaccaagtttttgtttcctttcatccttcactcgggacgagcaaaggttcaagcttgggaggttttgttgacggtcattagctatcagtttcgaccgtcaatattaccaaaatagaggagaactagttatgcttgcaatgcatatacatgttagaataataatattccactagtattaggttcactaaccttttgcagagaataatcattaaatggaggagaatcgacatcaaatcaaatgatcgatcaatcggactatgtcgagaatcagacttatgtatgaatgggccaagaactcaaaattgacacgatgaactgggccaaaattcacaagtctgcgcatgggagtaatagaggaggccacctgccgaatttaggccaggttgggccggcccctggttcggccgaacccacctggccgccgctggatccaggttttggctggacggctgagatgaagcccctatatggttggagggtaattccgaccattccaaccgtcataaccgtcatagttcagctataaaagggcttcacctcctcacttcctccacacacctcaagcaaagctctctcatattctctcaagtttagtttagtgttatctagctagtggaataggaatagagtagaaatcggagtctggaagccttcggaagagttcaggtatggctctagtagctcttctcttctcttttgtaagttttgtactattattagaatactcttctttatacatttatggtattggaatattttccgagtatatgaatgccccggttgtatggtcatggcgggctgtcgtaaggaactcagcaatcaggggtagcttctcgaagtaccaggagagcatcggatagagggtattagctagtatatcaggtaactaggatgtttgtatactatgtatactagaagtataggaatatattctctttctcttttctttccacttagcttagatattttatatgaaaatgagtagctccctgcttgtgtgtcactctacccttggattatattaacccctgtttagactatgattattacaagtaatatataaattattagtcaggttctctctaccatgatcttcccacgggaataaataaatacgatatccttggaatactctcgagtgaaatgctacaatggtatatccgtgcgcttgcggatgaactctgtaaccataatataccaggagtatttctgcaccattgctgggaattatatgtctagtaatgtcgttaagaaataccaacaacggcggtggcggccgtcccacgcccgaccccgcccggatctagcgggtcggcagcaggtggcttggtagcggtcgacggcagtagcgcgcagctcagcggggctcctcccggccggatccgacggcagaggccatctctcgcccgaccccgagctatccggcgaaaggcgacagcggctcggcggtgggcggcgggcagctcggcagcggtcgacgacagcagcgggtagctcagcggggctcctctcgcccgaatctggcggcggcagctgtcccgaccttgcccagccctgcacgaatccagcgagtagcggcaggagtccggccctgcgcggactcggtaggactggtggtgggcggcggaggacggatccaccttccccgacggtgggagcggcgagggcagcgggagcggacaacgcgacgcaaatgagcggccggcgacagggatggcggcaatgttgatggttgttatagaccaatttcgaccgtcaatatgagaactagctacacttataatgcatatttgttttagaataatatagttctacttgtacttagagaataatgtgttgcaggaatttagcaaataaaataaagagaaagtgaagaaacctaactcctaaacaagctagaggataaggagggcccacatgtcaagtgaaatcgtcccggaaaccgccttaactgccataaccgtcatagggacccacctgtcagtgtcgtgcccgaagctagaggcctactgggccggcccagagttcagctgaaccctgatggcgctagctccggctggccctccacgtggacgctccagattactcctcaatggcggttaaggggcagaatggtcttcacttttctacaaccgtcataactaccctataaaaggaggagctcattcactctctcaacacactcaagcaatctcaagattcctttttatactttagtttagtattttagtgctaagtggagtagaatagaatagttctcggattcctcggagctctcgaaagaatttcagtatggctctagcaacttttctattttcttctataagactcctggaattaatgaaatattcttcttcatatatttttgatattttgcttagtatgagtactactcttgctttatatttgtatcattaaattgtatgggtagcctaccaaagaggtgactacgacgaaaccatacgctggattgtcataattagcgacctcaatctcatatccagttactattagtacatccaaaagtgcatgcattatttcccttcttatagaattttctcttaaattactctttcgatttacgatctgattataccattgggttcgtaataattaaatctttaaaaaagatctcacataattatattttataaaaaaatacaaattacttttataatatatctaaattacttttatattttattaaattacttcttagttataaaagtaaattcaataaagtctgaaagttagaagtaacttgaaacaaaagtaaagtaacttgttacagcattaaaagtaaatatattgtgggagtaaaaacataagtctatctagaaagatttagtcaacaatcatagttacccccacaactgatttacttctgatgtcgtgacaagttattttctttttgttttaagttacttctataatatatgcaaattacttttaggctttattgaatttacttttatatgtctaagatgtaatttaataaatctgaaagtaatttagatataatttaaaagtaatttgtattttttatcaaaatataatcatgtgagatcttgttataaagatttgattatagttcggatcgtagatcggatgactaagttaagagaaaaatttatttgaaccataggtggtaggaacatattttatacttacttgatagacaagtattatagattaacaatattcggacaacatctgatggcatcgctggttagtactaaaacgagatgcctctccatttagattttgcgctcacatatatagtacggaactttgagctaacgggagtcatagtaaggcttctctcgccttttgataatcccaccgtgcgtcaacaaagcccagaggtgcgtgatgagctcgccgccggtggccagcttcttgacgtggcccgtcacgttctccgacggcgcaaccgccagcagcagctccacccacatctcggccagtaagttccacagcgccgcctcgtcagccatggccgagagcagctggtaccccagctgtgcgccgtcggctaggacggcttctccggtaaagttggcctcgtcggccggcatgaactctcgcaagctggcgaacatggcgtctttggagcggcggcaacctatgtttcggaggtagttctggatcgcctcctgcacggcctccatcagcagccgctcgtcgtggacctcatccgtcaccagctccggcgcctggagcagcaggtaggcgcaatagttggagagcacggtggccacctcgcggctgtcggcggcgacggcgttgtgggcggcgcgtggccgtgccttgccaccggcggcgccaaacagcttggagagctcgtcgtcgcagatggcggtggcgatgtgccagatgaggatgctgcccatggtgccgaacttgtacctggaggtggaccagtcgaacacctgcagcatgtcgttcctctgcagcgtccggtcgccgtacttgacgttggacagccactccgaccggagcagccggtggatctggcgcttcaccgccaccggcaggctccgccgcgtcactgccctcgtcgtggccagctgatccttgacccacctgtggagcggcacgcgcgtgaggaggcaggagctctggttctcgaggcaggagtggagcagcgagtactgcccaaccgagttgctccagtagcttcgtgtcagcgtggcgcggcacgtcagccataggaacttctccaggatcgggtggccttgccaccatggccggtggcgcacgtagcggcacagcatcttcaccctgtgccagtccgacaagacgagggacaggtactgggagagctcgaggaccaggaagagggagatcaccagcctagccagccagatgtcgacgctggtcgtggtgtagtcgacggcgccgccgcccgggggcggagagtggtggtggtggtgatgcagcaacgccggggagaagagggtggagaggctcagcgcggcggccgccatgaacgtggccgtctccgggacgagagtctgcttcggcgaggggtacctcgcgtagtagaagtcgaagaggaaacccagctccacctcgatgacacggtacatcctgtcgtggtcttcgcaggagtcgccgccggcgagccccctccggacgaacacgagcgtcctgatgtccttgggctcgtggaacggcttcccgttgaggttgaggcgttgccggaggagcttgaacagcgagaaggagaggcacagatccttgagcttgtcgtcgtcgctcagtaggctcccgtcgtgctgctcccacgctttctcgacggtgacgagctcgtcgttcaccttgtactcggcggcgccatactggtactgcacgttcttcttgtcgtcgccggtgaccacgtacctgtagcccctcatggtggccgggtcgaaatcccagatgctgctgaccttctcgtgagccatgtacttggagatgagccagttgtcggcggtgaggacgcggtcacggccggcggcgaggaggccccgtaggcgcaacacgagcttggcgacgttgagcaaccagagcagcgacaggagcaccttcagctgcagctgcagagaaccgaggtaggagatgaggaggagcatgacgtagaacacctgcgtggcctggctgatcatggtgcgggcctgctggtcggcgccgtcgaggctgcaggcggcgatgccgtcggcgcagccgagcaggaagcatgcccacaccaccaccatgtcgttgcggaaggagcccgactgcatcagcccgatcgtgtaggacaccgccgggtagctcagcatcagcgccagccagaccacgaaacggaaggcggcgctgcggctggtgcggcggccagagccgaggaagacgagcgtggcgaggagcgcgcagctggccgtcaccagcgcctccacgcggaccaggagacccaccgggctggccgcccacgccgtggcggcgcgggtcacgttctgtgctacggacaggtgctgctgctccatctttcgctgatttcgagctagcttcttcctctctctccggttccaatccaaggttcgagtttggactttggacgaagagagcagcacatgtctcgtactttcatgtctagacaacaaggtttaatttctttattacttgaccaagaccatatgccaatatcacatgtctatgttcccggtagtggattctaaactgtcgatgggatatcccctcattatttgtacgtcatcctaatggttatgtaatttttttaaaaattcaacaagatagattaatatgtgataaatcatttaacaaacatactccctccgtactcaaaagaaagtcgtttaggacaatgtttaagtcaaaccttggaaatataaatcattaataactctcaagttgttgagtttgaaaatataaaaaatatataaatagatttgtcttgaaaattactttcataaaagtatacatatatcacttttcaataaatatttttatagaaaccagaagtcaaagttgtgttttggagaccgtgtcgctgtccagagcgacttcctttacgattacgagtacggagggagtacaagttaaaatgtagagcaattttacagtccttaagaatgtctcaaaaatttaatgcgaaatttgatatctcctaccaagaggtgctaaatttacaatagagaaagtggtacctcacggtacctcctaaagaactataaaattgttctagaatttaacttctagaagttgcaaaaaaaaacaaattaaactacgggtagttaacgtatattcgcactcaaatttgttttttcgttgcaacttataaaagttaaatttcaccttgcatgtttttgaagtgatttatcacatattaatatatctttttgattttttttatttttttcatgatcatttggatgacatgcaaacaatgagggatgtccccttgagagtttagaatacattccactttgttcccttcaaaatatgtcacatgttagtggaaacaatcaagagattataaagtccaaccaatgagactgtcatggttatggataccacatacctaatagtagttgactaaacactacagggcccaccacataccatgacttatacggaaacaaacctcgtatatagaaggagttccggataaggaaggataagaagagttctacatagaaacgatagggactactcagatcgtatccatatttatctccctagatttacttggacaagggggcacctatgggtataaatacgatcccccctaggaggagaggggagagacccaccacaatctacgaagccacaagacacaacatacacacaagccaatacgccactagatctcgacaacaaagattagcctaggtataccccatccggtgcttgtgaaggccggcaagagggatctagcgccatctctgatctcgacaagttcatatttgaggaggaagaatgccctgtcgttgactacgagttggttatatagccgctaagtcgacgacagctagataggttatcccaaatattgtatctgtatgatccagatgaataaagagcaacactggcttcggccaacaggatgtagggctattacctgtcagataaggggcccgaacctgtataaaaatccctgtctccatctcctttacctcaatctcgcatataccctggtaccaacgatccccataccatacaaataccctagtcgcgatctcaaacgtcgacagagacgatcacctaacttagccggtaataattaggggaggcatctgtcaaattttggaccgttagatttgctctaagattaatgccggcctctttttctcctctggctccggcgacacagcgatgaccctaaccagttagggtttggcgatggacggtcaacacaaacaagcggcaaggcggtgacaatagtgccaaaaccatggggatggaggacggtggtttggtgtcggaggcggggctaggcaagtgaggcgggggaggacgatggtcgggtggtcctagctgacgccattcgcgcctttaggcacttgcgaggtggggacaacgccggcgagctcgctcctcttgttctatcaagcgatgcgggagagaagatgaaaatgggagaggataggttactattcatgtacaaatgttgatgcaatcctagccatccaaaagtgactgaaatctaatggggtttctagtttcacatcaatgttccttatttttttgaaaagtaattcgcatgttacaatttggatcaatgacgacccacatgtcggcgatgctagggtataaaggggaaactacctcggtggggtggacacggatgacctcctcttctgccatgtcgatgagttctcctctctttatctcaagacaacatggtgaaggtcaaggtctagcctcaaggtagcacggcagggggagatggtgaagcgaacaatgacttcatcgaggcatggcaaggtcctagcagccaacaagaagcaaagcagcggtggtggcgcatggaacgaacgcgacgtgacgatgatagaagagcaaggcattaagtgcagggtgacatggtgaggggaggatgattgggtcttccgccataccgacggtaatggtcataagaggtttgtcgttcagcgttaatagcaccggtaggttaaagcttatgttcaaagtgaattagtgtgaaatcaagcaaggttttaaaggaaaaatgaagagggtttagtgcagtttatttgccctatcaattttgcattgagatggaagaatgaggcgatagaagaggagaaactactagggtttcgagcgacgcgggtggagctcgtgatgagaggcctaggccggttaggctatacggctatgtgcaggaaaaggagccgatcgtaagcctctatgccgatgtagacctagttctcgcgccattgctcccacttatgcttcaacaatgtgggaggaagtccatgacgtggcggccgtggaagtagacgcatcccgcgcgtgccacacggtgaagtaccagtagaatagttccattgatgacgagatgctgacgaacatgtcgtagaaatgcacaaagtcgaggtgcatcatctgtagctggtacacctctagaatctgcataaagaattccaaaaaggggggaccagtccatccgctgcatagtcggtgaagtgcaccacttccatcggctcattcggatggggtctaaaccctccgcacatcaccgagaccgccagccttcaccgatttgaggtcggcatataaggagatacgtcttctctatccacccgttgtcgtttaggcgggatggtggaagggcactcccatataggggcctcgcaagtcgattggtgcaaggcatcactgctggctaaggagaggcagaggcggcagggttgtcaaaggagggatcggaggtggtgcgctgcatgagaagaagcaataaggcggcgaactgaagaagagtggggcagcagcattacaaatgagatgaagtacgtgctgaagtttggcggggggttttatgccttgaaaaccctccgtgacgcttcgcccactccaccatggcgatacgattatcggagactgggagaaaaattagggtcgtgggtaattatgacctgaagcctcggaaactgaagacggccaataatgggaaaggttaaccagtgccccgtcacatcctcctgcaaccacatggggcccatgttatcctgtgcttcggtaacttcgagtagaagccccatccccaacctcaatggctctcagcccagcaatggggctactgtaggagaaacaggaataggaattccctttccccctaggagatcgaggcgttgtaggacccattgagccttccttcctgagggctcgggcactatgggccccgccaagctttcaaggtttcaagaaaagtccgggggtgacccgaggacacagagtgacccgaacatgatggccggccattgaaaagcacttattacaccctggggccccgagggtgccccgagcagtccttaagggggatttcactccattaaggaggggtactcaggactggtcatcacccttaaaacgaccactttgcattaattgtgatgtggttcaagcatggcgtacaactcatgccttacgtgggagacgtggtagtgcatgcaaccccttgcatgcttacgttgcccaaagagcacgagccacacggcgtggcgtgtcctcatcaaccatcactagggccaacctctattggcttcggccactaactgatgggcccggggacaattcgaacgaggacttttgactttccattccacttgttggtcggtaggtgtgcttgtcttatctagtcgattggctaggagggacagcgataatactaagcatatgaagtttagaggagttggccccactcttgcatgcatgcgatggcaatgtggactctccttcacatataaaaggaggatccataccaccgaaaaaagggttcgcactctcgttgaagctacgttagccaaacactaagtgagcaaggaacttctctcctccacacttagtctttcttcccacaaaaccttgtaatccttccacccatccaaagtccaccacacaggagtagggtattacgccgcatccatatgatctgaacctgtatacttgatcatgtttgttgtttcttcttgcacgtgaagcgggacccacacttaaaacttgcacccaggccaaactcacaaaaggggagtacttagcttccctgctagaggagtaccggactctgacataacatattcatgcaaattggaaagaaaaaaaaacatatattttgaaagaaaaaaaacctatgtctagctgcctaactggcgcacattatacaaggacattcagatcgagaaggtcaaattaaatatccatgacagataacgcctaagggcacccacaatggttatctataggctctctacaagagatccatgtcagcatattttcctacttggaagatattaaatgaagagagagagcaaagctatctactaacttagagatagtctatagagaaaaacgaggcaaggcatgagagagctatagatacccatgtagacatactattaatctagtctattgctgaaatgtacatgttttatagaaagcacattactttaccattgcgggtgctctaatagtcacacattatacgaggacgttcggagagagtcaagttaaatatccgtgataatgtttggtcagataggcatcccatgtaccaatgggagatcggagtactaacaacagtacagcgcaataaagaactcaagcaatcagggccatctgtattaattaattttgatccgatggtccagattcactgctccaagacatataaaccacagggtagcgcaaggcagcagcagagggactaaaaaccatggaagggggacagccaataaggatatactgcaagggagatacaaccttgaatgtggccgtccgtgggaacgagctgcgtctcgtccgggacgaccccaacgacgaatcccaggtaccaaaagctagcaatcccagctaggatcctatttaatttgcatattctaatttggtctttggttgcttgattttgcctcaaatcatcagtatttacgacctgtagtgtagaagaaagtatgtcgaagctgttaatttttgcaattacatgtataaaccgttgtgtgatattatactaccgtttttaatttgcgtggattcggcaatgtacgtacgtctggtctgcacacgatcgaacatagcactggttccaggtgtgcgacggcgtggggaaactgacggacgacgaggagcggccagcgttcgcgctggtgaacaggacgacggggcacgccctggtgaacggcggcgacctcgagctgggtctggctccctacagcggccatgtcgccgtggagctctcggtactgtggtcactggggcacccgcgcgccgacgggttcatggagatcaggacgctgagggacgtcaggtacaccctcgacggcgtccacgggttcgtcgacggggggtacaggctcaacggcatccacgggatccccgagcatgggacgctcgtcgccatctatcactcgcagcccacggctgattatgccgtctggaagattgctcccgtcggccaccaagagccgcacagccacagcgagtctgatgatgctctggagtcttaggttggacacggccatttccaatgcaataatggttactgttggagtcgtacgtacaaatgaattaaattattactagtactatattgcatatctagctagtgtgcgctacgcgattgggtatcagtacttggagatctcgagttgtagtccttgcttgcttaattaaataaaagtagcagctggtggccggagcattcttgtcaggagtctctctctagcatttatttgttttttagataatggattaaaccggcctctacacccaaaggatgtacacagcctaaaagtctcttacacgagcacttaggctcacacccttacaaaaggtttaacacaaattcgagtgaccacaaacggacacttagacaatgacagagattaaccaaaatagtacttaagacaacaaaaccccatggtgcaaagaagagagagcattaaacttctaatcttgttcttaagttccaccctttcattgcaaagaaactagaaactctcttctccaatatcatgcaaccatcttttactctttggccatcttcctccttaagcagcgaagactattgtcttgcccaaaaaagttcccctgaaaatcacctgcaacaagaaattagtgttggagccattaaagactacatcatttctgcacaaccataccgcccaacacaacgctgcgacccctccaaagactttagtttttagcttaggttgaacccccccttagccaattacccaataagctagcaacattcctagttttgagccttagaaaagtagaagaagatagaatttctaagagtttacccttgtcgaattgtttgtgtaatgaggttaacaataagggatttagttcagaaggagaagaagagttagataaccttgttcttggtcacttatgtggtgatttagtagaagaggttatggatgaggagaaagaccacctaagttgtggtgctcaaaaattctccaataattctaacaggaaaaatgctgagataaggaggggaaagaggaaggttagagtcgctattcgcaaaaagagggcatcatggggggaattttctggaatagcagaggtctgggagacttggctaaattcagatttctttcggatacctcaaaagagaaaaagctagactttattgcccttttagagacaggtaaaaatgatttctccaacgctagtcttaagagtttttgtggaggccaagatttcttttggcattggacaagaccaaggggaagatcaggaggtattttgttaggaattaatgaggcggtctttgacatttctagcgttgatgaaggcaagttttatattaagttccacattaaaaataaggatgatggctttcaatggatcctcgtggcaatctatggggcggcccaagaggaatacaaagaagctttccttgttgagttggttaatgcttgcagtaaggagtcactacctattttgcttggtggagatttcaacattattagaaatccttctgaaaagaacaatgataatttcaatgagaagtgtcctttcctctttaacgcagagagttggaactttctaggcgcaaattcacttgggctaactccttgtcaaaaccaatgtttgagaagctagatagaattttgatgagtaccaaatgggaacataagtatcctctagcttcgaatcgagctttgagtagggaactttctgaccatacaccactattgttggacacgggtgttaatactcctaaacaaccaatattcaggtttgagcttggatggttgttaagagatagcttctatgacatggtagcggatgtatggaaaaaggaagttaaggggggactaagttggaaagatggcaaaataggatacgtcgggtgcgtcaatttttgaggggatgggcgaaaaatacaagtggagcatacaagaaagagaaggctaacttgttagcaaaagcggatgagttagacaagaaggctaagatgcaatgtctatcagaacaagagttaaacctcaagaactatctaaaaaatagattagcacttttgctaagggaagaggagataaaatggtaccaacgggcgaaaacaaaaagaattgtggatggtgatagaaatacaaaatactatcatttgatagctaacggaaagcaccggaagactcgaatttttcagttggaacaagaggagggtgtaattaagggtgacgtacagctgagaaagtacattacaaaatattacaaaaacctctttggacccccagaggaaaataatttttctatgagggagtctagaatagaggacattcctcaagtctcaaatgaagaaaatgacatcctaacaaagtaattctcagaggaggaagtaaagcaggctatcttccaaatggaacacaacaaggctccaggtcccgatggatttcctgcagagttctttcaggtgttttgggaagtcattaaaaaggacctaatggccatgttcaatgactttcataaagaagaattgccactacacagcctgaattttggtatcataactcttccacccaaacataaggaggccaaacaaattcaacaataccggcctatctgcttattgaatgtaagcttcaaaattttcacgaaggtactagcaaatagagtagctctagtagctcaaaagatcattagaccttcacagacggcctttttacccgggagaaacataatggaaggtgttgttattttgcacgaaacaattcatgagatgcacaggaagaagaagaatggggtgggtattaagcttgatttgaaaaa

SEQ ID NO: 58302 - DNA, 45614 bp, Oryza sativa
gcatcggcaccctttttgctttagttttgtttcgacgagttcttgcttttgggttgagctgcatcgatttcgatcttcaacaagaggtaaaattcgttatgacggattgcgttcttaggattagtgcttccatctttatgatactctaatcccgtttatgtaattcgtcgagttatcatatgtcttacataatgtctagcaatatcatcatctaacctgccatcggttaacatctgttaatagagggtagcagattgggttaaatattgatgttgatctagattatatgagatatctaccattctatgaaacttctagcggcttgattgtctagatatcgttcttcttttcatacttaatgctgcatcagttgagtttgatctattaagtcgtgcttagaatatcgatctctagcctgccttctagttgccgattagaatagcatcggagtttcagccgatcgtatctgatttaactatatttattctatatgcctcattgttatgttaaatctgccctttatatcaagatattgctgtatctaaatatgttaggcctttgtttgatacattattcttgctttaatatcctagtatagtgtagtatcggagtattagccgatacatgctagatttatctgatcggctatgctataaacatatatagccctattattaatatatatttcgatataagtgatttatactgtctcggcatgatgaccgatctatcccaatcacttgatttaagtatacatcgatataaggagtatatatcgttaatatcaacagccgatcgagtagatttagttcttttttacttattcatgaccgtcgatcgatacacagatgacatcagctcaaagataaatgatatgtcatcggcatctagccgattggctattatttatagatttaaccacggcttctttgcttctatttcttgttgattacaggatcgaatcaactggcacgctaacacatccgaaggcgagctttggacctgcactggagttaagcagatctcccaggccacgtgttttctgtcaacaatgtcaccacaaagcaaatcaaggaaccagtccctttcctcatcgttttcctttgcaacaactacccaagctagaggatacatctgattgttggcatctcggcctatagcacacagtagctctccattggttgcccccttgaaaaaacatccatccagccccaccactctcctacacccagctgtgaaacctttcttgcatgcatccaaacagatgtacatcctcttaactactggtggatccatgccaatctccctattcacaactacagtgttgccagggttgcttctgagaagttcaagttggtaattaaacaacttttggtattgccccttagctgagtcaaacttcttcttcatcacaagccactttgctctcttcagcttagagatagatgcatctacaaacattttttcttgtacagttgatttcatatgagctattggcttggaaggattagcagctatgaaattgccaaacttttctgctatcctaacagatgtaaccagcctactatccctcctaggtggacaagcatgcaggttgtcaaaggttactatttgccagctgtctgacctagaattcttagaaagcagacatacccagggacaactttcccaatcacagtttgccctaaccctttgcccatcatccttaccaaagttgatcactttcctctctgcaatagcatatgttgtaataaccttcttgaattgcttcttacaactgaacttcatccccaattcaaatttagggacaccttgactcttcttataccttgcttgatggctacctttagtcctcatctccctatcactgccaagttcatcaaatgattcctcctcatcactatctgcataaggggttttattccttgcctcatcaccacctgtttgcattcttggtttagccctctggaaaaaaatgtcatctaggttctctagttgtcctgccttaaccttcctcttgacctccttgtaatgtttctctatctcaacagcctcttcatcatcatctgattgagcatcatcccctggagtataatcactgtcagaaggtgggtggctagctatgggtgtactgtcatatgttggatagtcaggaatgggtgcattggcagaaggttgatggctaccacagggtgcactttgacaatgttgatgcctagcaataggtgctgaatcagagtggtaaataactatcctcctatcagtttcttcctctgccagttctttacccttacatccactaccaccaacctcatcaacccctttccctttggatacatctatatcaacctccattttcccaccctcctcttcactttcaacttctaactccatttctacctcccaatcactgtcatcatcagacccattacacaaatcaacaatctctggctctttaacatatacatctgctacatccaattctccagtacagtcacacatcagtttgcaagccttatcattagaaagagcacgaagacctgtttgcaaatctttaccaggaaacaaccagtggagcaaagtcccagacatcacattgcaatggtcctttaggtgtccaaatagctcgggcaaagaaaccttgtctctttctacatatgatagagcctcagatccaccacaatatttcttctcactcccatctaaaacaaatacgcccttcagatgaaacctaaccacaagagtgtccaacacgtccatccccttcatgcagaacaagatataaaattgacttagagcattttaaatttgtcctacactcggtccaaaaaaaaatggtcctacacatgcatacctagtaccaaatcctaacttctgcaataaactaagcctaaacataccctaatcaagtacaaacctaaataaataactcgcagcttacaccaaatcccaacatcgaaaaacattaaaaattattccttcccacatcccactgataccatgcaacaacacaaactcagagaggaaatggaatacctgccggattcggatgtcggattgcggggggaatactcgccgatgaaacccccgccggccgccgcacctagctccgactccctaccgaggtcgccccaaggtggttgccggcagccacgcctaggccaccaccagatccaggtcgagctcgatgttgtcggcggccgcgccaaaccagtcaccacctcggcgcgacactctgccatcccttccgccgccccttccgccgccgcctgctgcaaatcgacctcgtcaccagcagcgtcgccctggccgtcctgatctagggttttcacacaagtgaggagtgacaaatccgctgtgcgccacgagcctaactgcgagcctaactaccgccctgctgactcagcgttgaaccccgtcgcccctgttgactcagcgctgaagaccgtggtcaatgtgccacatatgacaaaccaggcacaatactgccctgggaccaacaatgacccggttttgaaagttaggggacccccgatgtctggttttgcggtttgaggacgttttggtaactcgatgacaagttcagggagcttcggtgtacttttcccaacaagaaacgacaaaaaccatcgtgcacttccgtaaaagtctagcagcccagtttaaaataaaaagcctaattgacttcctgttttctttgttgatgtaggccagcccacgatgatttcccctattcatgttacttgcaagtccaagccacgtgaagtttttcctttttttgcttcgaaggcccaatgtaacgatttttagcctaaagagttatgcatttctattttccctttaaatttctgaaatgtggtaggtaggggtgggaaaaaattatacctagaaactttatacgaatacaactttatacatagaaagtctacgcatagaaaactttatacgtagaaacattcaaagtatatacacatggactttatacacataaaagttatatgtagatattttatacacataaactttatacatagatactttatacacataaactttatatagataaaatctatgcatagaaactaaaattcattagggaatagaaagttttgcaaatgagtttaaaacaaatttgtatcctacataagcacaaaatatccggatgggccatgagcccgtgaggcccatgtagttggatcagtgcgccccaacaaatttccgagtcacgcgtccgaaactcccgcgacccagccacgtgttttcccacattcgcgcaatgagcaacgcgcgaacgtttgcgtattaacgttctcgcatctgaggtccccctaacctgacaacgaatccaatttttcgtcctaactgtcaaaaccagtgcaatataggtcccatggcggtttggatagtgattttcgctgatatggcgtctacgtggctaatttgactcggtcttcatatgacattgtagtgacgtggcgcttacgtgacaatttgatttgaaaaataataaaaatttttggcccacatattagttacacaaaaaaataaaataaaaatggtgaggctcacgtgggccccacatgtcattctcacccctcctcttcttccttctctctctcctcaactcccctctattcatctctctcccccctctctgtcctctctcccacgacaagctcgacgcccggggcgagcagatagtgtcctggatgtcaccctcggagttgtagctccggctgcggagcgcgtcggcgcggttcatactctcgctccggtggatgggctcattgatgcagtcgttgtcgttgacggacgacacgtatgaccctcgccggggtgaaccggtgcgaggggacctcctcgtcggcgacgacctctgtgccatattgttggaattaatagatgggccttagcccattcgaagattaattctttggaaaatcataaaagcccacctcatgggatggcatacatggggagtttaataccaccttacttattctagaagagggggatcacattaaaagggaggatgccctcctacccacttgaagcatgtgaggtggagagaagtgggggaccacgcgctcgctcgcctcgcctcgcaggcggcgcgtaggcgcgcgtgcacgacttacgtcacccttgcgcagatgcaaactccttttgcagttttgttttgctgcgggaaatttttgcagttttgttttgctgcgggaaattcggatttgttttgttttggaaacattccgaaaaatccggtgcatgaaaacggtgtggagtccagataagttacgcgcgacttattcggttcggttacgtggagtggagatcgtacgggcgccctgatcaagcaacctatctctatataaatcgagccgcctccttcacgcaacacacgcaaaatcaatctagggtttgcctcctactctgtgctgcgctatcgctcgtagactactccatcccgttcgctggcgtgcaccggcgatcatgagagtaggtctccggaacctctgccttcgacgtcctgcacaagggaaaggcggcaataaagtttttgggaagcgctttgcacgactgcaccctgttcgcctgcgacggctcgtcttcctctccgttcgcgtgctacgcaccttcgtcgacgcccgcaaccgcgagtagttcctgccgagcaaccggtctttccgcaatctcggtacatgttcaatatattgcgcatatttaatctgttcatgttatactatgtaatttacatgtgtagatctaatgatgcgttgatgctagtttacatctgcaatgtcatgatttatttatagaataaattaaatcattatgtaattataatttcaactcatgcgcgacgccgccctcgagctggtcacgctcggcggagaggtacctccagaagtagaggatgcacgtgttggcgaggatgccgacgatcatcaccgggaagacgccgaggaggaactcgccgaacgtgatgccgctctcgacggcgatgatgaggttctacgggttgccgatgggcgtggcagccgagccgatgttggagctggaggcgagcgcgaggaggaaaggctgcgacgggaggttgttctggcgcgccaccttgaggatgaactcggtgaggacgacgcagctggtgtcgttggtgaagagcgcgctggcgacggcggagacgacgcagacgcggaagaagaggtccttgctgccgcggctcttccaggagagcatgttgccgaggtacttgaacatgtcggcgcgctccaggaagatggagacgaccatggtgccgaagaggaggccgaggatggggaggtcgatcgatcgatagatgttttctccgatcaaattggttccccaagaaccctagtactgatcctgcaaaactggagcagcgtgtgttagtgcagaaaccaaccaagaactggacaaaaaaaaagcacagaactgatcaatgcgcagaatcttcggtgagatcagacgaattaactgaagaaataatcatacaagaatcggtcacaagagattggccgccgtcgaaggcatgcgaagtacgttgcacatcatgcagcgtttgagggtcagtcacacactcacacatggctaagaatagctagctaggcagcatcgatcacccacaaattttgacaatttgaccctttgaaaaaattaattttacaaataaactgtcgccaaaacttatttcaaaatgatcctttttttcaacgccaaatcatttggcgttgaacttagacacctcagcgccacgtcaactggcgctgaatgctgagccaccgcggatgggaggctaagtcagcgtgccaacgtacattcagtgccacgctatttggcgctgaggtgtgtaagttcagcgctacatgatttggcgctgaacaaatggatcatttttgaaataagttttgacagcggttcatttgtaaaaatagtttttacaaagagttaaattgtcaaaatttgtgatcgatcacctgtcgatttttatccatggagtcgctcacctcaatcacggctcgatcgagcagcacgtccggccgctgaggacgaaggggtgatagctaaagccaacacaaatacacaacacaacgacgacgatgacgatgatagcatacacaagtccaagatcgccggagtgggagttgcgtttgctcgctgtcgtcttcgtcgacgtcggcggcggtgcgtggttgtgatctcctcctcgcggttgtgatctgaggccttggcgatgctggaggcgaggtcgagcagtagcgcgatgccgaccgtgggtggggcagggggatctctctctctcgacgacgcggggtagcggcggcggtgtggagtctggactcactggcgtggagcaaaagccggaaggcgaggcagaaggtggaagaggtggcgggggctgggatgacgacgacaacggcgaaagcgacggctgtgaggtggcgccacggcgcgaggagaagcacctgaagtaggcgcgacgaggaagaagagggagagccgagaagggatagggaatgatatgtggggcccacgtggagcccaccatatttacttttttctagctggcatttgggtccacgtgggccccactgcttttatattttttgtgtgtagctaacctgtgggcccatggtttttattatttttccgagatattattgccacgtaaatgcatgcgtgggacagagacctagtcaaaccagccacattagccagaaccgtcttccaaaccgcaagagatctcatttgcatctggttttgacagttcagggactaaaatcggatttggtgtaaaataagggacctcaaatgaacttattccctgtagctttaatggactgtttccacaaatctagctaacggcccaatagaggtctatttcatttcgaaataagttcacatgtcctttaatttgtctctacggttgaaataagtccctaaccaaaatgatataacaatttacaaaaccgaatcatctgagaatttcctagacagtatgaaacctgattttagctgatgtgacaagctgagtcatcgtgacactactggggaaagggacattagctagaaattgaaaaaacttcttttagcccacatataaaaaattgattcattaattctgaacgggtgtcggtttcattgatataaattagagttttccatgttctactcatactcctatggtcttagtattatgtgagtggtccaggagtatgattgggctagaccaagaacgaataatgcccaacagacactgtttattgtctttcctagctcaaggcgagaaacaaaagagaaggaagatgggcgtcggtgctccgacgaccaaacgacggtgatgaaagtggtaagacgtgtcccacgatataactcgtccatagatggtggagcttagcaataaagaaaaccagaacaagagggacgctgggggcaacaatgaggtcctgatacatagataaatgacaaagacgagatctagtggtgacacaaccggatgagtgcatcaaaacacgttcccgaacgagaggattccattttccttgtaagcgcgggaaaaaccgattaatactattcattgtcttccctagccaacacaagaaacacaagaggagggaagatgggcgacagtgctccagtaaccaaacaacggtgagtaaggtggccggatgtgtcccacaatgtgacatccatatatggtggcggttggcaacgaagaaaaccagaacaatgggaacgtagcaggcaacaacatggtcccaatagagagaaatgacaattgtgagctcttgtggtgaacatggccgagtgagtacgtcaaagcgtgttcccgaacgaggaggttctatttttcttaaatgtgcgagagggagggaacacaggagagaagagggtgtcagggttacagataaggtataccttctacccttggatatatgctatacggaaatacgttatagcagtgcataatcggacgttatttgaacacgctaaggaaatcaatcacgaagtctgccaatggaaaggttcctacccgtataggactggatcgttactatatcgtgcagggtccgatgtctccgagtcctacttggagaccacccgacctgcgatataaaaggggcccccccggggggacctaaggcattttatctcagagcctacacatcggccacagcttacgaagtcgaagactacaggagccaagtcgccaggtgatctagtcgaatcaacttgactacgatctcgtcggtaccgctgagttctattgctccctttgtaatctgtggttcttttcatataatctcatatcaactggattagggctattacctgctaaggggcctgaaccagtataatcttcgtctcttgtttccttgatgtcgtattacgtagatcctcgtaccagcgcacctcaataccctctatatccggtctacgggtacccaccgtctacagtggcgcaccaggtagggggccttggtgctcaaggttctagtgctatgacatcgagcttcgtcgacaacagagtcaacatcggccccatccaaggaatccctgcttcaacaatgctggtgtggactcaagtcggcgaaatcgtcttcccggtctacaccacggtgccaatctcggctggtccatcaataactagagacgagaatgccgtgattataaactcggacgatccaaagtcgaagaatcctcccgccgtggcagagaacggaacatcgacgtcgtacaagctcgagaagattcctagtgcggccgagccttgtccttctgacaaggactgcgagccgacgaggacaacttccgagctaaccaagtcctggtgtcctatccacaagtccaggaagcacaacttgcaagcttactgggtttttctcaacgtacaagctaaaatccgtgcttgtaaagagcgtggaatccagcgtacttctccaactcgtgatgtctattgtcctattcacaagacgaagaatcatgatttctcaagctgcaaggtctttctctgcgccatgaagacgacacttcccaaggtccagcagtcaggaacctgtctcgaggatacagacaaggaacaaggagcgacgttgacttcggatcgtttcgttggagtaatcgacatcgatccccgcaaaccatcagtccttcacttgctagaagactatggcttgtcatcttctagtacaccacgcgacgtgtttgccatcggtgggactagcacgtctgcacaggctaacgcagaggcagagaaccagacggccacaccagcccaacatctcggcaccgtcaacacaatattgagagaagctccctatgaccccgtgcttaacgatgatctcgcacgatggacggaacgactatgggaatcagtagccaatctcagtaacacattcgaggaagctgctaccagagcacaactggaacgatcgacagctgacggtgccgacggtgaaccaccggaggagcggacgtcgcctgcacgagctacccctccacctcgcggcaccagcgatctccgtgaccatctgaatggccgccaagaagcatgacgtgcacgagacaacgagaatcgttcccgacatcgtgtttcttcacgacaacgcgggaacgagtagcgaggaggccactcgaacgagggccaacagcaccgtgatcgtcacaaccgccacggtcgcgataaccgtgaacagcggacaccagacgatgatggtcgggggcgttagcatgaaggtgatgataacggtgaccggcgccaggacaacaatggtggacggcgacataattctcgagaacccgaacatcgccctcggaatcgcacgccagagccaagtgagccatcgtcgtcatcgtcatcatcatcttggtcttcgtcatccaataaacgtccacggaggacacacgatcgccgacaacccactgcccctagcgctgtgtgtagagctttcaaccgttctctacatgatgttcgatggcccgagagattccgacccggagcaatagagaaatacgatggaagtactgaccctgaagaattcctccaggtctactccacggtactatacgctgctagggcagacgacaatgtgttagcatacaatttaccaacgacgttgaaaggttctgcgcattcgtggctgatgcacctcccaccttactcgatctcttcatgggcagatttgtggcaacaattcgtcacgaacttccagggaacttacaagcgccacgcgatcgaagacgatttacacgcattaacacagaatcagggtgaatctttgagggactatgttcggcgctttaatgagtgcagaaatacgatccccgatatcaccgatgcttctgtgatccgcgctttcaaaacagatgtcagagatcgctatactatctaggagttggcaacaaggcgaatcactaccactcaaaggttgttcgaggttgtcgatcgatgtgcccacgcagacgacgcgctaagacgcaaaaacgacaaaccaaaggcgggaggagagaagaagccagccaaggacgcacccaaatcaagcaagaagaaaagcagcaagagtaggaagaggaaagctcaagcagaagtccttgcatctgaatacgagcgcctgcccaaacacccagacccacaaggcagtgatacaaagagaatatggtaccctatacacaagtcagacagacattctctggaggagtgcctcatcttcaaaaaatcgttggaaaggtagttggctttggagaagggcaagcaagtacgtgtagtcgagaaggcaactgaggcaaccactcaggactcggactccgcgtacccagattccgatcttcatgtctcgcacatcttcggaggttccatagcgtactcttcaaagtgagaatacaaaaaagtggagcgtgaggtttattcgacatggcagggggctgcacccaagatgaagtggtctgaacagaagatcgagttctcagatgaagaccaccccaaggctactgttataccaggacgatatccgatcatggtcgaactcactattcggaatatcaaagtagcgcgattcctcgttgatggcggcagctccatcaatcttctcttcgccagcactttggacgcaatgggaattccacgaagcgagttgacacctaccgatcaacccttctatggaatcacccctcaatcttcgtccaagccattgggcaagatcacgctcccggtgactttcggccaagcgagtaacttccgaacggagcagataacatttgatgttgctgagttcgacacagcatacaacgccatcatcagaagaacgacactcgcgaagttcatggccacatctcactacgcgtattaggtactcaagatgcccgggccgaagggaacaatcactatccaagggaacgcaaagctggcggtccaatgcgacaagcggagcctcgacatggtcgagcacactcctagccaacccgccacagccgagccacccaagaaagtgatcaaaacgactaagacgccgaaaccagacggcgcaatcaaaatcgtcccactctccagtgccaaccccgacaagacgatcaagatcggggcatcaatgaacgagaaataggaactcgcgctcatcaccttcctccgcgacaatgcggacctattcgcttggcagccgtccaacatgccgggggtcccagggaggtgattgtgcacaaacttatggtgcgacccgatgccaagccagtaaagcaaaaactgcagagatttgcaccaaatcaaaaacaggccatacgagaagagctcgataaactacttaaggctggttttattagagaggtactccatccagagtggctagccaacccagtcatggtgcggaaggccaacgggaagtggaggatgtgcgtcgatttcaccgacctcaacaaggcgtgtcccaaggatcacttccatcttccttgaatagaccaactggtggactcaacagctggttgtgagctgttaaacttccttgatgcttactccggctaccaccaaatcagcatggcagaagaggacgaggagaagacagcattcatcacaccgttcggtgtattctgctacgtcaaaatgccgtttggactcataaccgcagggaacactttccagcgcacggtccaaggggcacttagcgatcagctgggtaacaatgttgaggcctatgtcgatgacatcgttgtcaaaaccaagacatgcgactcattgattgacgatctacgggaaaccttcgacaaccttagacgatattgcctcatgctcaatcctgagaagtgcatgttcggggtaccgtcaggcaaactgctcggattcctcgtctctggcagaggaatagaagcaaatcccgagaagatcaaggaaatcgagaacatgaagtcgcccactagactcaaggaagtacagaagctaaccggatgcatggtggcgctaagtaggttcgtcgttaggatgggagaacgaggataacccttctttgcactgctaaaaaagcaagacaaatttgtatggacacaggaagccgaagaggcgttcatcgcactcaaccgctacttgtcaaatccgcatgtacttgttgctccccaacctaatgaagagttgtttctctatattgccgccacgccctactctgtgagtaccgtcattattgtcgaaagagaaaaggtgtagagactagtctattacgtcagcaaagctctacacgacgcaaagacaaggtacccacagatccaaaaactgctctacgcagtaatcatgacgtcgagaaagctacgccactacttccaagcccacagggtcatagttgtctccgccttccctcttggtgaagtcgtgagaaacaaagacgttgtcggccgcattgcaaaatgggtagtcgagctaagtcagtttgacgtccactttgtaccacgaacagccatcaagtcccaggttctcgccgatttcgtagccgattggactatgcctgaaaacaggttagacagccagactgacaacgaaacatggacaatggcgttcgatggtgcacttaacagccaaggagcaggtgcggggttcatcttgacatcaccttcaggagatcagttcaagcatgcaattcaccttaacttcagggcgaccaacaacatagctgaatatgaaggactactcgcggggataagagctgcagctgcacttggagtcaagcgacaaatcgtgaaaggggattccgaactagtcgcaaaccaggtgcacaaagattacaaatgctctagctctgagctgtccaagtatctcgcagaggtcaggaagctggaaaaaaatttgatgggatcgaggtccgacacgtatatcgcaaggacaacatcgagccagacgatctagcacggcgtgcgtcgagacaagaaccacttgaacccggcacctttctggacatcctaacaaaaccatcagtgaaagaggcaaacgacgaagatagcccagtaaccccccgacatcagcccgggggctacagaggcagaacgcgccgttgccgacatcgagaccacggacgactggcggaccccactcattaaattcataaatagcgacgagttgcctgaggacgacgcagaagccaagaaaataacccgtcaaggaaaaatctattgtatgatcggcaacgatttatacaagaaggcaccaaacggggtacttctaaaatgcgtcttgtccggcgacggtaagcacctcctcctcgacatacatgaaggggtctgcgggtcacatgccgccggtcgtacattggtcggaaaagcctttcgacaaggatttttctggccaaccgccctcaaagacgcttgcgacatggtacaacggtgtgaagcttgccaatttcacagcaaacacacaaagctaccagcgcaagcactacaaaccatccctctcacttggccattctcgtgctaggggctcgacatactcggtccattctcacgaggacagggcggctacagattcctgttcgtggcgatcgacaaattcaccaaatggatcgaggcaacacccacaggagaaatcaaggccgacaacgccatcaagttcattaaggggatattttgccgatatggattgcctcaccgtatcataacggataacggctcccaattcatcagcgccgattttcaagattattgcatcggactaggagtcaagaaatgcttcgcctcggtttctcaccctcagagtaacggacaggtcgaatgggcaaacagcatagtactacaagggatcaagacccgtgtctatgacaggctcatgtcacatgataagaagtgggtcgaagaactcccctcggtactatgggtcgtgcgcaccacaccgacatcgtccaacaaggagacacccttcttcctcgtgtacggctcagaggccatgctccctaccgagttacgacatcagagtatatgattacagaagtactccgacgagaatcaggaggaacagcgaaacgacgacgtgaacctactcgaggaatatcgagaacgggtcaccgtcagagcagttagctaccaataggccctccgccgatatcacgagaagctcatccgagcacgcatactttcgatcggcgactacatcctccgacgagttcaaagctaggcagggcgaaacaaactctcgcccaaatgggaaggaccgtacacgatcacacaagtcttgcggccaggcgcattcaagattgcagatggcgatggtcgcgagttagcaaattcttggaacattgaccagttgcgtaaattctatgtataagtcaatagtttccgtacttgtaagaagtcttacaacttcaataaagtctgttttaaggaacagatttcaatcacagtgccccttcccgatgatcccttacccggacgacacatagcgttgaaacctatcctcatgtccctttacgccgtcttgacaaggcctccaaggaacctaagggaacttcggctggggacacccagagctgataaggccttgtcggatccttcagagacgaaagaccatgtaagatatggtcgtgtaagagttctcgccgtgcatattaaccaagccgtgtaatcggaaatggatttttccaacttcacgactaggggctaggattagtgcttattcaactaaggcaagtcgagagtccaagagccttatctcccgagaagaattctccgatgacaaggctgggggctagggagagtgtataactcaagtgactgatcgaagtcgcgaagtgagaagacactcgtgcacaccgcatccagcgtaagaaagcttagttagatagatttcctttctgtttcacaagcatttcttatagatcgtaaagaatcctaaaatatattacaattttcttaagatgtgtgtcacagatatacaagcaataccaggaaggccaacgccaatccattgactagaagattttctccgccagcggagccatcgactttgctaggttgtctatctccgcaggattcctccgagaacaggaaaaacccttgtgaaggaactcgagatgcaactgcggacgatgatctcgtacacacgccagcacgtgccctccggcgtatcggctcgattgacgacattcctacttcagggcctcgtcgatacgcccaccgatgccatcaagctgagcacaagccccgttcaaccatgagatgaagccagccgctgactcctcgggatccccgcgaggtactcagagctctctgcagacaacgaccatggttgtgcaacaactcctgaggtacgagttgaaccatacctcgcgacctcggagcgcctccacggcccggtccctcttctcttccaatatagtcctctcaagttcggcgacctcgaacttcgtcctccagtactagatgcgacggtcgcgatcagcaagcatgctctcaaggtctgctcagcatgcaaacacctaagtcaagctaatcaagacagacgaggtaaaggaaagggaaacgacaagaaccaacctaaaggagtcgacgccacatccatctcctcgggcagatcctggtccatgccgtcccgcggcacatacggctcgagctcaagtgccggaacgactacaggcaattcgggatacccgtgctgttggacatcctcgacatcggcatctctacaaacaacaggcaaagtacccggaatcaaaacgccaaagaaaactaaggtaacgattgcacacacaaaagaagttggaaccaacgaaaagtattacaaagcgcgattggttaaggggtacagacaagcggtggccctactcttcaaaaagcgggaggacggattcccccaaatcaccgacttcttccatcacatccttgcgcgcgtcgctagccgccccctgatccaagatcttctgaagatcgagttcagggtgcgccagcttcacacacgcaaggacatggcatgccccggtataaatcccgttagacgtctcctctccgatcctggccgcgtgcttggagaggatcgcctccatcactgtcgcaagttccgcaagtgaagtcgtcagccataactcatcgggattcgccgggatggtggtcttgacaccgtactccccggcaagctggtgcagactagtgtaggtgacccgcagcgagccacggatttccgacaagttgttctcgagctccgacatacggtgctcgagcccctgccgttgtcgctcgttgccggccaccagttccctcatcttctgtaggttctcgcgaacctccgccagatcatgcatcagccggtcggcgcgctcattcgccgatgacgccgccgccgccctcgcctccgtgatcttgcggctaatgccgcgagcaccaacctcaaggaggcgccccatctcgacctagagctcctcccatgtgaggacggcagccggcgcaccccgaccagccgcgagattgctggctgggccgctgggcctcacatcgcggctcctgggcacgaccacaacatctgtcgaggccacggtaggagacgcgctagaagtccctccagatccgtcttgcgccgctttcgcccgcgccgccctgtgaaaggctacaattgagacgtgctgcatgagttcgacgaagtgacaaaacctcaaattcatccacttctcgcccagcgtcacaagccgctgctgtcgcggaggcgggggagacgcatccgaggcctggagtataacgggcgtgatgtgaggtgcaagttttccgactacgtgatgatggaccaggagagcttaccgagggggtgggcgtcttccgacgatttccgatcatggaggagaatttcctcccccttttcagaacgttgccgccacttgttgtggcagcagcggcagcaacatcaaatgcctccttggcgacgccctccttcagctacgccaccgcctgatggtccacgagcggtccgatgatatcagtcagagggagagcctacacttcgtgaagtcacaatgcgatcccggaagaaaaatgcaaaagggtcgccgagtacactcacattgatggcagcttcgcgttcggctgcccccttctcgcaaagagcaacagggacgttgctcaccgtggtggggccgctgatcatcacttgaccgatgcgatgctctacggtttcactgttcaaacctgtagatcaagaaccaaaatcgataagtcaggaggaaaccccgaggagaaacccgggtcgcgtcctccgaccctgagtagtcaaaggctggatgggctcaagcctggagcggctggatccgtctaccgatgaagtcggcagcgacttaatactccgacaaccctcgcactcggaggtcatcgatgacatcgatgaaagactgaagggaggggtcaaggcgggcttggcaggccaagacgaaatcttgtctggttgctcctcgggaacaacaaagaccggatccgagttttctatctgaagatagaaccacctcgcccgccatttactacgagaagaggggcactggaaggggatatagcgcgacttcaggccatcccgaagtcggaaaccaacgcatcctgataccctattggattccatccaacgcaactcatagtagaagcgaaagaggtcacgaaatagttctaccccaatgtaggcctcacaaagatgagaaaagatactgaggaaggtgatagagttggggttcaaatggagcagagaaagaccgtagaaattcaagaccaaaagaagaaactcagagggaggaggaaggaaaccacagagaatatagtcctcaaccgcaaccatgcggcccaggacaggttcaggttcaatacctcctggttccctctccatggtcccgcgatcggggagagcgccttcctcctacagcttcttcagcgacgcgcttgtagaagtggacttgtcgaggtccattcccgtcgaagatcgtcggagaaggggctgagatgaacaagctagggtttgtgtggaagcggagaagacgaagagttcttgaaggcttgaaagtttctcgcaacagccggactccaaaatggactcccaaaactcccttaaataggtgcactaccgacgatgcgaattccaaggaaaggagagagatgaccgccagaaatttctgggaccgttgcgcaaggcggtttcttggacttcaatttaaattcactcataaccgttggacttcgcatggtattgtcgatcactctttgtctctacggtccccacactgagatcgaccagtcgagaacgacaacaactccgacatcagaagtcatgattggttacacgagttcatttaagtagaagtcgggggctactgtcagggttacggataaggtataccctctacccttggatgtatgctatacggaaatacggtatagcagtacataatcagacgttctttgaacacactaaggaaatcaatcacgaagtctgccaatggaaaagttcctacccgtataggaatggatcgttactatatcgtacagggtccgatgtctccgagtcctacttcgagaccacctgacctgcgatataaaagggacccctcggggggacctaaggcatcgaatctcagagcctatacaacggccacagcttacgaagtcagagactacaggagcaagtcgccaggtgatctagtcgaataaccttgactacgatctcgtcggtaccgccgagttctattgctccctttgtaatatgtggttcttttcatataatcccatatcaactgattagggctattacctgctaaggagcttgaaccagtataatcgtcgtctcttgtttcattgatatcgtattacgtagatcctcgtaccagcgtaccccaataccctctatatccggtctacgggtacccaccttcgacagaggggcgctagtgagaagagatgccgagggagagagggagtgtgtgcagcgagggagagatgggtgtggggtgccgggagggaaggagggaggcaggagaggacatacgccagggaaaagagaggctgcgggggagggggagaaatgggggtgctaggagggagggaggtagaagcagaggtacgcgggagggagaggggccggacggacgaaaggaaggcaaaagccttacgtatttttttaattattaggtatatagatatagacttgtgctataatctatctatctattatatattccatccgtttcacaatgtatgtcattctagtattttccacattcatattgatactaatgaatctagacatatatacctatctagattcattagcatcaatatgaatgtgggaaatgctagaatgacttacattgtgaaatggaggaagtactaaaagtccattaaacttcctacaaacgctcctatgtctccacgtggcactctacaaacgctccgaagctgccacgtgccaaagaaacatccaacccttgatttttatttaaattagtgggccgatccttttcgaccattagagtagatgtcaaaaaaaaataagtaatccacccatactaatctacctccaaattgagcaccactctattcgtgcaaatgcatgtatacgtacgtactctgtacgctcctattcccattcttctcttttcattctattatctatatttaactctcctattttccttctcctaatagaaagcataaatttatgtaaaaacatttaggcaactatagcatttaaatcataaaggtattctaatatgcttatgttgttagattatttataaagtaactaaatcatatatatatgttttgatcacactactaaaaaaaggcacatagagatcggtgttataggtgctagaagtgataaaaccgacacctatataccatttctcacctctacgggttgaaaatacaaaaaactagcaactttaataaactataggtgccggttttctgtaatataggttttctgtaatataggtgctggtttttttaataaaaactgacaccttcaatttataagtgtcagttaattaaaaaacgacacttggtttttaaaaaactgacactaaaaatatgagctgagccgaccggtggtctcgagcggacaaggctgagagggctcagtgccactctctcgcgcgcgtataagaccgagagtttctcgctcgttctctctcgcgctcctctctatctttctctatctctcgctctctctcgtgcacgctgttgacggtcgttagcgatcagcttcgaccgtcaattttaccaaaatagaggagaacgagttatgcttgcaatgcatattcatgttagaataataatattccactagtatttggttcactaaccttttgtaaagaataaccctaaagtggtggagaatcgacatcaactcagacgataaatcaatcggacgatgtcgagaatcagacttatgcatgactgggccaagaactcagaattggcatgatgaactgggccaaaattcacaagtctgcgtatgagagcaacggaggaggccaccggccgattttgggccaggacggcccgacccatggttcggccgaaccccccgcagcgccattcgatccaggtttctcctggacggctgagatggctccccaatgacggttggtgagtattaccgacctttccaaccgtcacaaccgtcattctcaagatataaaaggagctctcatcctcacttcactcacacacctcaagcaagagttctctcatattctctcaagttagtttagtgttctcaagctagtggaataggaatagagtataaatcggagtctggaagccttcggaagagttcgggtatggctctagtagctcttctcttattttttgtatttagaatactcttctatatacatttatggtattgaaatactttccgagtatatgaataccaactttactttatgttcatgttatactgattatgttgctagcttatctgggagatgctttggtacgggtataatgtttgcttatgcaattactctatgtcatgacgatgatattagagtagtatctggtagtttaggcgttgtgtcaagattactggatatcattatttgggtttatatgctgtggatgagaagtgggccgctgatggtgacagctcagtacgggtattcctccgcgcgtgtatattgtcctaagttaattccctggggagggtactgtcgcgtcccaaaacgaccctaaaatacatcctctaaattatgcctagaataattaaaatccgtgtgaaagcctccaacaattaaaatgtgcaaagttaaaagtcaaataaggcttgcaggatttttgtatatttcctaaaagcctaaaatgcgtaaataaattttagtggaattttcagagcacaaataataattaagaagaaataaacaaagttaaaaaggttttataaaaagaaaaaccctaaaaagtctttttccccccctccacctcttgggccggctcggcccacctccctccctctctctcctctcccccgcggcccatccggcctcctccccgcgcgcgtgctgctgacgggcgggctcgcccgccaccctcgctgacgggtggggcccacccgtcatcccctacctcccgccgctcccgccgcctcgcccgtgccctagcgccgccgccgccgcaaatcccgccgctcccgtccgccccgcgtgcaatcaagaggggggaaatattccccgtgattccctccctctttccccccacttttccctctctctctccatcggattcgttcgggatcttttcccctaaacctcgccggcgcatcaatggcggccggatcttccgcggccgtttccccctcatccggccgctctctccccctcccaaccctatataaacactccccgtgcctccctccgccgtttccgccactcgccgctctctatccccgccggaatcgagctcgcgccgtcgccctctctctccgtcgtcgccgccgagctccggtccgccgccgttgtcgtcccagaccacctctcccctcggcgccgcctccttcggcttcgccgcatccccggcgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcgtttcccccttccctcccctctctcggccgccgctccgccgtacctatggccgccgccggcgaccatagggacgcgggcgcgccgcctcccgtcggctgtgccggcgtggccgccttcgggcgcgccgtgcggctgccgcgtggggcccggctgtcagccgctcgcgccctcgggtgcggctgacgcgtgggacccacggcgccggccggtgtgagcccgggtgcgcccggtccaccgtggaccgtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatctttgaacatattgaatcccagtttataaaattatgctgatttaaattattgcattatcgctttatttaaattcccgcgttatcattgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattcttaggtttggcaggatactaccggaggtttatcgagaacttctccaaaatcgctcgacccatgacacagttgttgaagaaagaagagaaatttgtgtggagcccgcaatgcaagaaggcgttccaaactctcaaagaaaagctggtttcctcgccagtgttaatcttgccggatactcgcaaggacttcatggtgtattgtgatgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcggcagaggagatggttagaactcatcaaggattacgatgtgggaattcactatcatcctggtaaggccaacgtggtcgctgacgctctaagtcgaaagagccattgcaacactcttaacgtccgtggctttccacccgaacttaaccaacagatggaagccctgaatctgagcatagtgggtcgtggattcttggctgcgttggaagccaagcccaccttgctcgatcaaatccgcgaggctcagaagaatgacccggacatgcgtggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtaccagattaaatttcagcaccgcgtatcacccgcagatagatggacagaccaagcgtctaaatcagatcctagaagatatgcttcgcgcatgtgtcctagatttcgggaagacctgggataagagtctcccctatgctgagttctcctacaataacagctaccaagccagtatacaaatggctccttatgaagcgttgtatgggcgcaaatgccggacaccgctattgtgggaccaagttggggaaagtcaagtgttcgggactgatatcctgagagaagctgaagcgaaggtcagaaccattcgggataatctaaaggtggcacagtcccggcagaaaagttatgcagataaccgtcgccgtaacctggaattcgcagtggacgattttgtgtaccttcgggtcacgccattgcgaggtgtgcacaggtttcagacaaaagggaagctcgcacctcggttcgtgggtcctttccgtatcattgctcgacgcggagaagtcgcttaccagttggagctgcccgcctccttgggcaacgtgcatgatgtgttccatgtgtcgcaactcaagaaatgtcttcgggtaccgtccgagcagactgacccagagcaaattgaagttcgcgaagacttgacctacgtggagaggccagtgaaaatcctggacaccatggagcgcaggaccaggaaccgggtaatccgtttttgcaaggtctaatggagcaaccatgccgaggaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtcttttccccccctccccctcttgggccggctcggcccacctccctccctctctctcctctcccccgcggcccatccggcctcctccccgcgcgcgtgccgctgacaggcgggcccgcccgccaccctcgctcacgggtggggcccacccgtcatcccctacctcccgccgctcccgccgcctcgcccgtgccctagcgccgccgccgccgcaaatcccgccgctcccgtccgccccgcgtgcaatcaagattccctccctctttccccccacttttccctctctctctccatcggattcattcgggatcttttcccctaaacctcgctggcgcatcaatggcggccggatcttccacggccgtttccccctcatccggccgctctctccccctcccaaccctatataaacactccccgtgcctccctccgccgtttccgaccctcgccgctctctctctctgccggaatcgagctcgcgccgtcgctctctctctccgccatcgccgccgagctccagtccgccgccgtcgtcgctccggaccttctcccgcttcggcgtcgccttcttcgggttcgccgcaacctcgccgacctcgtccacctctccgtttcgttcgccgaccgccggaacgccgccgtccccgtcgacccgtgccgcgccgccgccttcctccgctccggtcgccgttcccgtcgtcgccgtcgacccggggtgagccgtggaccgccgattcgcttcccccttccctcccctctttcgggcgccgctccgccgcgccggtggtcgccggcggcgaccataggggcgcgggtgcaccgcctcccgtcggctgtgccggcgtggccgccttcgggcgcgcccctcggctgccatgtggggcccggccgtcagccgcccgcgccctcgggtgcggctgacgcatgggacccacggcgccggccggtgtgagccgggtgcgcccggtccaccgtggaccgtgaggctgccgcgtgggccccactcccgtggacccggtccgcccgcccgctcccctcggctgacggaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttaatattgttattgttattatttccttgttcaccctagaataaacaaaacctcaactagtggacactctactcatggtaccactagtatgattttaggtagatgcttccctgtttaattaggtaacattaggtgattttacaactctagactttgggatgttcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctatgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacatggttacacgtgaggaagatgtgtcttgtgggtaaagatgtacacctctgatcagagtaaaatctattcgaatagccgtgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttactaaatagttttgagcaactaaatatctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaggtacacctccatatttagccccggttgtatggtcatgacgggctgtcgtaaggaactcgacagtcatgggtggcttctcgaagtaccaggagggcatcggatagaggtttttatctagtatatcagatacctaggatgtatgtatactatgtatactagaagtattggaatagattctatctcttttctttccttttaacttagatattttagtacacatgatttatcttaacccctgcttagactatggttattacaagtaacatataaataattagtcagttctctctactatgatctacccacgggattaaataaatacgatacccttggaatactctcgagtgaaatgctacaatgatatatccgtgtgcttacggattgattctgtaaccataatataccagagtaatgtcgttaagaaataccaacaagcatttcaggcgccgttgccggggaagatttataatagagattaccagaactaatactttttatttacctctgtataatcactttcctttgcaggctaaccttggttgttttcacttttgttttggaaacagggtagtgcatgactggtttcaacttaccggaaaactttaaggaaaatccagaagctttcttccggagcatcaaaccgcgagtcgttgctccgcagaaaactctcccgacaaagaaaccagccatactagcgccaccgaccttcaagactatggctgacaagactctccgtgaattcgctgctccctctgttggcaatgtagccattgggccgcagctcaacctgggagatgtggattttgatttgaagtccagcctcatcacgatggcgtaggctagcctgttctgcggcaagcctaacgaggatgccaacgcttacttacaacagttcctggagatctgtagcacgtacaccatgaagggtgtctatcacatcctgattttcgtttcaggatttataaattatttaataaattaataatataatttatattaaatgatctttaatttacaagtgaagttaaatgtgggaaataaaatttcctaaatataaagcatggatgggtttaatttttattaaattctccatggttaattacactctcttaaattttctcggatttttcggagctcaattcctaaatgatacaaagaacagttcagtaattatttgattattaatgatctaattataattgttaagagcttttcttgtttaaaaatccttaaattataaattgttgtttaaaaggaattattagaaatgattttaaaagcctagaagagaagatctaattttaatttgttaaatctcaatataaaattgggccagataagatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaaccctctctctctctttccctcggcccagtccggcccaatccgccgagccgccgctctcctctctctcagccgctgacaggtagggcccgcttgtcggatccatcgtcttcgtcaagccgccgccgcccgaaaccctagcgcaagccgccgccgtctccttccaaattcggccgatcctttccttctccggccgaatcttttgaggggaaataatcttctcgatctcctcttccttttctcttttggaatcaacggctaactcggtttggaaatccgtggattcgagttcgattcggatcgatctctctcctccgaaccctagctttccttcgccgttccttcgccgtctccgtcgccgtgggccttcgccgccgcctccttgcccctttaaaagcacccccggtgtctccgctacccgtcgccaccttcgccttcgcctctcgtcgtccgtagcgccctagcgccgtgccgcttcgtgccgccgtcgccgccgtcgctccagtcgtccttcgccgttgctccagtcgtcgccgtcgctcgggaagaccgccgtcgtggtcgccaagtcgccgccgtcctcgtccaccgcttcgccgtcgccgaagaccgccggagcaccgttgtcaccgttgacccgatctccgccgccgcttcttcctcgtcgccggcgccgtccgttgcccttccgccgttgttttggtcaccggtgagttcgccgcgtcgccctctacccgttggtgccttccgttcgcgccgccgtgccgtcgttcgccggcgagcatgcaagcccgagccgccgagccgccgccgccggtggtgacgtcatcgccgacgtcatcggggccgttcgctgtgagccggtcgtggaccgttcgatctcggccgtccgttttggatcaagtcgatctcggccgtccgttcgcatgagccgtcgcccgtgcgcccggtccaccgcgaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcctgtaaaattcataataaattcatttgaagtcagaatgaggccgttcaagtctcataattcatctaaaattatgatctacatgtttgtttactttttatgtattgtttatttggtttttattagtctttttttcgttttgcgtgttagcttgtcgtttccgtcgttgcgaaagttcgcgagtgcgccggaagtattcagaagattatttgaagaccgattattgcaaggcaagtcacacagatcctaaacacaatcctttgagcatgttgatcctatatttaaattctctatttatttcaactgtgcatttattttcgaatgtcactgggtgttgttaacctattctttgttatggcccttttgttcttgattactttattccttgataccttgggtgattataattggactagttgagctttaaatatattggttcaactagatattagatataattgcttagccatgcttagaaacattagcacactattgggataacttatgattcactattatttaataatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattacggagcaccagactgagaagtggcggagataagcccacgggggtcgctggggagtccatgccttgttttataagggggtgattatgatccaggaatggtgcactgtggtgagttgtgttgtgcaaaggatattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaatatttatagatgttatacctggtaataatttgcttagctcctggtttggagattagatctgtacagccgggtatggttgcttcagaatggttgggcctgagcagcatgggcgtgttgttcagtgttgattaaaatttctgattaattactcctctgttttacttctcttaaatgttttgctaaatgctgcttacgcaaatgagcctatattatgccatcctttggtatccttgtgcacttgcatatttgctgtgtggcttgctgagtatgtcatatgctcaccttgcaataatcaatcaacctcacttgaagaaaaagaatccagaaggagaagacgtttggcttataccccagttgagctgcctgtgggagtggagccggagcttcgctagattttatttttccgctgcagttttcttcatggtgaggactaagtgcctcataagtaagtatttatcgttttagtcaatttgatgaatctgtatattaaattgtcagtttgtgtacctcggctgatttctggacgaggattttatgcacaaataagttcgaaaattactagtgaatttccgggcgtgacagtgtcagtccggacgttgtcaggctccggttgttcccgttttccctcctcgggaaagcaaagtagtggttttatgccaaccgtgctacaatcaatacctgggacaaatgctctatagcatttctctcgaagttctttccgatcggcaaaaccaatccccttcatgggagaatttcaagtttccagcagacaagggacaagtctattcctgagacgtgggaacgacttcagaaatatgtggctgccagtcctcatgatgggatggacgactggttgatcctgtagaacttctataatggactcactcccatgtcctgtgaccacctggacacgctagctggagtagccttcttctctaagacggttctattgacgcttttttagtcaacacaagatcacctaacgatttgcggtgtaaacaatagaatcgtcgaaatcgataggtcaaaatcggctagtgaaaccgatttcgagattgattcactttcgcggaaacacacgactaacttacaagcaaattagcaaagaggataaatatcgtacttacgtgacgacgaacgactagtttccgagcaaactagcaaaggataacctcctcgctttcgtggagaagcacgaccatttttcagcgcaaaacgacaaagattaaccaaattctaggttactaaaactcagccatgaaaacgaaatagaaaagaacagaaaagtaaataacaagaaaatagtagattgataatttgttcggggtttttccagcgaagatggaaagagtaatttataggaggcacggcctcatctagcgggagtttgtttcctttgtgggccttctcttccagcgttccgggtcgatcatggaaattccatgtacagcatatcaatgccttcggtgatctgcactactccctgaaaaatactccgtacctgacatgcatgcatcaaatcgatgatcttctataaaggcaaccattatgtgcatgaaaactaaccttaaggaataaagtagtaatttttgttgtacctttgtacattgggagatgagctagggagagaatatagggagagaatagtgctatgtgcaaccttaagcttaaggctagccataagaattaaaaatatatatcatggctttgcaacatgcatgcacactttcaatcttgagtaaatatgtgtctttttactcaatgggtcccaccttaaggtcaagaagctaccatatacattgtagcatgtactatagataaacaatataagaatgtgggtctcaccttatggctcaattgatctaaaacattgaggatgctcttaatccatgacaccttgtggcctcctgaagccttttccttcacaaaggatccggatgcctccctgcacatgtacgctgcacacactgaccctatatactacttgcgacacacatctgcaagcactaattataaatccctaatgattaaccaaacaatgggtaaaatgaccccataaacctaactaattaggagtaacagctaacatccgaacttaacccactcaactaattaaccacctgattacaagtcaacgaaccaggttaattgctgcagccacccaacagcttgcacacatgatctctcagtgtatcacaaattcctacacacaataaacttaatctatgtttcaagctaaccactcaacacttaggatctatatattctaaataatttggcctgctcaaatgaaactaattaactcttagccaaactatggtacaaacaggttcaaggagccgttgatttaatagagaagatggcttctaatatgagttggagcaaggaacgactccaaacccgtcagcgaggcattcacaccatcaaggagatagaaatgcttgctgccaagctggacctcctcatgaagcgattggacgatcacgacaaaaggccacaaggcaccatcaaagccttggactcacacgttacgtgtgagatatgcggcagcaccggtcattctaggaatgactgcccggaaacccgtgaagaggcgatgtacatgggcaacaacaacaatgggtatcgtccacaaggaggtcaggggtggaaccagccacgcctatattatcaaggaggcaacaacaacggtaatttctctaaccagcactccttgaaggatcttgtctttgcgcaagctaagaccactgatgctttaagcaaaaagctaactgccaatgacaagatcctagagaacattaatgtcaagctagatgtcctcgtttctgctttccaaaaccagttgagctttaataagatgatagaaacccagctagctcaattggctttattagtccctgcaaatgaatatgggaggattccgaggcagcccgactcctccattgaaaatgtcaaggcaatcacaacgaagggaggtaagtccactcatgaaccgccgtatcctaaccctgcaggaactaacgggatcgccaaggaagcaccatctagtgattcagttgacaaaaaggttcagccagagaaggttgtgccgcaggagtactgcgccacacaattgctgccgtttcctcaacgaagtaggaaaccgtcagtggacgagcagttcgctcgttttgttgaagtaatccagaacattcacatcaacgtgctattgttggatgctatgcaagtgccaacatatgcccgttatctcaaggatatcctcaacaacaagagatcgctcccaacaacggaggtggtcaagctgacgaagcaatgcagcaatgtcatactccacaagctcccggaaaagaagaaggatctggggtgtcccacgatcacttgctcgattgcggcacagcaattcgaccaagctctatgtgatcttggagcaagtgtcagcgtcatgcccaaagacatcttcgacaagctcaacttcacggtgctggcaccaataccgatgcacctacaattggctgactcttcaatccgttacccggcaggaatagtggaagatgtgctagtcaagatacgggatttcttcatcccggttgacttcgtggtgctggtggaagtggagccacccaagacagacagcctggtgaaattcatgcagaatttcctggaaaaggaaacaacgatgcccaggaaccgttattggaagacaccggtaaaatcaagcataccggccaagaagctagagcagccggctcagaggaagccgtcttccacaccgaaatcaaaaagggcgtggaaggaaaagccaaagacacctgctccatcacctccggagacgagtgagaaatctggaaactaaactggaaggaggtacggtcttgcacgtcgaacccaaaatgacgcgaccttcgccaaccgaaaaattggtatgtatccatatatttgttttcaacgatttaaatttttgcatcaatcgcttgtttgaatttcaaaattgcatttagaatttttgaatttcgaggaaattcttcaaatgaatttttcagagcaatccaaaataaaattttcaacaaaaatttattgtgccacgaccacactgaccgttgaaacccaaccggccaggcaacggttacctgccacttttggcagggttacggctagtgggtcccacatgtcatttctgaccgttgtgggtaccctataaaagccagccggccgagagagagaactccaccccatttcaacacattttttattctctctccaaagtttgctctcaagttcatccaagctttgatagtttccctcaaattcaaacacttagttgcatatatacaagttgctttggtgaaactcttgctattctaacccccgtcgagttagtccattcttactccattgtgtagaatgaggaggcgattgtctcgcctgttcaaggggtctggctcttcatcaagtcatcatgacgagtctagtgctcattcatcagctgatgtctcgatggaggatgccgacgctccgcgacatctcctgaacgacgccgacctcgaccttgtcgatgatcgggaaatgcaagcctactatctgctgagtgaccggaaatatgctcacacgcgagaatactctccggagctgctgaaaaagataggtatggatgttgacttccgtgctatttggaaagctgttggttggcaaagatttgctgtaatagattagcctggttctcatttgctcactttgcaatttctgtgcactttgaaagaaatagaagatggaatttcttttcgctttttccataaggaatacacacctacatggaaaggattaagtacacttcttggttttcacgattcctgtaaaatcgatctcctgaaaggaatatctgggttcgagaaaaataggttttgggaagatatttctggtgctccaatttgcaagaaacctaggacgaatgatatccataatcctacacttatgctcatgcacaaatggattgctatgactttgtttactagaggtgatcttagacccattagggggatgaattaattatcatgtttgccatggttaggaaaatcaaaattgctcctgtgaaatgtatgataaggcaatggttagagagtataagattttctgctcctgttgagtgcacttttttgattactcggatagcaaatgggctgggggtcgtgagtgaccaaattgttttcatctcagccgctcgtccctatattgatgagaattatctagtgtaagggcacattcttaaacagatggatctttgatatacttcttccccagttgtacaaatgaaatccctttgccaaatgcggggtatcatttgtacaactaccatgaactaaccattcccctatagaccatagtagaatctcgtgcaggtggagcatacagggaaacacacaacatgacaaggaatgaatgagaaggttcatcatcctcaacacccgtacagatgtatgaggcaggttgggaaccaactggggatgtacccggatggaccccaagctccatgccacagcatcggagtctcaagctgggtgtcatgtcctgataaattcatcccgaattaaaaatcattctctaaaaggaataatagaattaattaaaattcaaaaagaaattggcaaacactaaaatacgtacaagaaaaattcgaatgaggctcggagaatttttgttaaattctccatggcctaataggagccctcaaattttacttgaattttcagagcaccggaaatatttattaagcaacaacaacaattatcaaagtttattaaaaagaaaaactaaaaataatcctccttcctcctttgggcccagtctagcccaaagtcttccgctctctcttcctcggcccgcagccgaagtctctcctccgtccctctcttttccggggattgctatctggcgcgcgcgcgccagcaacggaagtttcgcgcgtgtgtcacgcccagaaattcccgaataggattccaagcagaatatgcattaaaacccccgtccaggaccgcccggggtacacaaacaataaagttgacatacagatccacgtcttacaaatatcataaagtcttacataaatgcagtggaaaattaaaacataactggagctaagccttgacttggaccacagcgggatcaccactccacaggcatcctcgacggcacggatgaagcctactcctcggagaagccaccatctgacgcatactcaaactctggggtttggggaaaaatagagcaagactaagtattacccactgtactcagcaagtcaaactggaataggggtatgatgcagggaattatcaagggatagctatagaggttcgtttgcataaagcgagcatttataaacagtagatggaagcagtaaaaaaattataataattaatcaatattaatcatccactgtccaacgctacaccacgttgcaacaggcccaaccatccacctagactactcaaattcaatagactagactagggtgaaactaatcatggtgaatctggttgaccgcccatatccgcgggtacggctattcgaatagttttactctgatcagagatgtacaactgtacccacaagacacagcccaacgacacgtttccgtgcgccgacatgccaccatgacataccggatagaggccgtgacaagactcttcgcataaccccctctaaccaaacacaccacacctcaggtttcacccccactcctcgcaaggcagcgggtagtcccctctcgtgcctaggttaatccggaagccgcataggccgtcgcagggcccatccaaactccatcacgcccacccttgcctggatgcgtcagctagaggaaggctacactacaagcccagccgttgcccacgctggcttgtggtaagtacgagaaattcttccaaggtttcccgcgaatcggtccttaagtgccatgggcgcgactagcaaaaccatgtacccacagcccaccatttaacatgttttaatgaagcgacaccaggacggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggtacaaaatagcatggctataacagtaggtaaacatcccatggtaacagtataaaacaatacagtatttgaaggaaaacaatggagcatttgtaatataggatcaacatgttcaagtgacaagcatgacttgccttgctctgctgctggaggaacctcggcgactatttcaaagtacaccggagcatcgggagagccagaatctaagcgacagacaaagcaaacaatacaaacaagctataagactactaaaacagagaacaaaacaatttttaatggattctatgtatttttcttgatttactgagacttgaatggcattaaacggagctcggatgaattagatatgaattttagaagattcactgtgtttttactgtaatagaaaaaatccttaattgatttattgcgtaataaataaatcccgggagaaagaggggcggcgtcgacatgcgggccccacatggcagtggctgcagccgctggtccatggtggatcgggtccatggaccggggaaaaagggcagcgcaccacgtggtgcaaacgtggcgccgacgtggcacgcacgtgacggcctcgtggcagccacgcgggcggcgggatcggatggccccgatctaccgcccggtagatcggacggcggatgcggctcgcggccggcgcgcacgggcacggctcaagccggcccagcggccatggcgcgcggcggcgcgaggcggcgatcggccggctaagcggctaggcggcggcgcgtcggctaagcagcgtgggagagagggagaaaggggaggaggggccgcaccgacgacgatcgacgacgatgagagacgaatggtgatggcgacggcgagacgagctccgggaccacctaagggatcgaaagggatgagttagagagggagagggaagccatggatggctagagcggcgaccgaaggcgctggccatggcgaagctcaccggcgcgtggcacgggcggggttccggcgcgcggcacgggcggtgttccggcggcggattactacggaggaggggtggacgggacggcccgcacgatggcgaatgcgacaaagtcaacggcgcggctcggcacggcggctagcggtgaccggagcagcggcggcggcggcggaagggaggacgacggcgctagggtggtggagtgcacgggagcgggcgattgcaaaacgaaaaagagagaggagggaacgaggatgcattatatagacccacgaggttcgatcgtggccgggagaccgcgatttcgccggcggagtggggagaggtggggaggagagagaggcgggattcaaaaattgaatcccggccatctcgagcgcgggcgcgggcgagagataggggagtgggcgcgggggacgcgggcgcgagggcgacgtgggtgacgtggcccggaagacgcagggcgcggcggcggttgcggttacggggcgtggcggcgccggctggaggtgggagacgggcctgacaggtgggccccatctattggcgacccggggagagaagagcgggggctcgggcggctggctgggccgtggccttcggccagcacagcggggagggggagagaagacagaatgggccggcggcccattcgaaagagaaaaatggaaaaagaaaaagaaaaggaaggaaatgaattttcttgggattaaatattgcttgtgctcaattttaattggttaaaattatttctagagctctggaaattccactaaaaatcttgttagcgtatttcgacatgtagaactcaagaaaaaaaattccacatgccaattccgattattatttgtattgatttattagggtttactcttgcttttacaccggtattttcttgagaccatttataacttcaatttaggcttgggaaagaacttcagggtgtgacagcgcgccagctgtcatctgccaccgtttctttccctttttccgactttctctttttttttctagcatttatttcacgcgagttagctaatcgatctgtattttgttgccatctgtttcctattttagcgcacctctcacgctatttccttttttgtgttttcttttccttttttttagttgctagcacacgtgtttcttaaaatctttgaattgaaagttttcaaatcttgacttgaaagttttaaattttgagttgaaagttttcaattgagggttgaaagtttcaaattttcagttgaaagttttcaatttttgagttaaaagttttctattgtgagttaaaagtattcaaatatgggttgaaagttttcaatttttgggttgaaagttttcaatttttgggttaaaagtttttaaatttgagttgaaagttttcaaatatgggttgaaagtttcaaatttgagttaaaagtttttaaaatttgagatgaaaaattaaaagttttcaaaattcaacttcaaaaatacaaattttaagttaaaactttacaaatctgggttaaaagttttcaaaatttgacaccacatatagatttctttttaatctattatttttaaaaaaatcttatcttaattatcgttattagtatctaaaactaacagattagttatcatcattacgttaatacatgatttcgaaaaaatcaaaaaaaaggtcaaacctcctccacctacgcgccggaaaaaagaaataaaaaaaagtgaaacccttcgcgtgcgcgttaccagcacgtacgcgcgaggtagcttttccgctcttttcctcgggggcggctagctagcgcgcactccccttgagtccctcctctgttagttattactcccttaactcccccctctattagttattagttatagtattaggaaaaattctaaatatttttcttttggagattttttttactaacaaaatgaaaatttttaagctagatttaaaaactttcgatttaagatttaaattttaaagtcaaattttgaaaaaactttcaactcagattcgaaaactttcaactcttagattcgaaaacttacaagtccagattcaaaaatttgaaaactttcaactggagatttgaaaattttcaacttcagattcgaaaacttttaaatccagatttgaaaattttcaactcgagatttgaaaactttcaactcgagattttaaaaatttcaagtccaaaattgaaaatttttaagttaaaatttgaaaactaccagtaaaccaatcactagtaaaaacaggaaactaatcactagtaaactaattacggttgtttctcctattcgtgcgatagcaaactgcagaaaaagaaaaaaaaagagagaagaaaacaacggtagcaaaaaactgcgaaaaaaaagaaacagaagagaagaaacgcgcgcgcgtgccatgggccttgtggaccggaagtgagttccggcacagcgcgcgcgagctagcattcctgcttttcctcccggaataagttcatctgaggtcccttaacttatcaacgaatccgattttcgtccctcaaccgaaaaaccagacacaacgggtccctcaactatcaaaaccggtgcagattagatcccttagcggttttgagggtggttttggctgatgtggcgcctacgtggcaaatttgacttggtcttcatctgacgtggcattgacgtggcgcttacgtggtaattcgatccagaaaaataataaaaatccgtgggacccacatgtcagtcttacatagaaaataaaaaaatagtgggacccacgtgggccccacatgtcagtccaacttaccctcctcttcttcctcctctctccccatctcccctctcttcatctctctcccctgtcttctctctcatgtgcgacacgacagagaaggagcggaaacccgctagccatcatcgtcgccgccgccgacgtttccccgcaccgcctccaccaccgcatcccagtgatcaccgctgttgtccacgtgaacaccgccgacaacggcacccctcgtcgtcatcaatgcgggtgcttcgacggcagtgtccggtcgccaccgccacggtggtcgactccggtcagcctcgccgcgacggtcgactccggtcagccacgccgtgacagtcgactccggtcagcctcgctgaggcggtgtctggtcgccgccgccgccatcgacaacgacgacgacgtctgccggagcttcttgcccttgcgcagccgcacgttccagaagttcttgatctcgttatctgacctccccggcagcctcgccgcgatctgtgaccagctgcacacgcacgcacggatcatgaacactccattgatcaaatcgatcgtttcatcatctcatggttaattgagcaataatctagctacctgttgcatcgcggcatctagatagcagtacaaatggtatctacacgcataacaatttataaattgcaccgaccatcattgttccagcctcccagatcgctcgtcgatttctttcagtttttcgtctactccgatgtcgttcgacggggtctcccggctggagacgtcgccgccgccggcgttggaggaggagatggcgactgtgactcaggcgccggggctgtcgacgccgtccatgctcggcaatccagatggtggagctccggcggcaaccatgatccagagcgcgccgtgcgccaccggcggcgaggcgttggtgggcgagggccggctgcgaaaggggaagatggtcgccgaggaccagagcccgccgagcgtcagcggcggcgcaccggctgacctgcctcccggcggcgacaagctcactgagaacggcggtgacactgacaccctcctcctgggtgcccgttgttcgtggatagagaggatggtaggacccattgacatgtgggtcccactattttgtccttttgtatgactgacatgtgggccccatgtttttgtt

SEQ ID NO: 58303 - DNA, 14076 bp, Oryza sativa
catgttgtcatcttttgcaaaatacattctctaaatattaactaagattatcttcttcttttaatctcagtgggagttcagtttcatgttagtaacgtgagtccggagcaagtaagcttgttcagaagaactgagcgtgaaagggtgaataagcttttagacgaatacgtccatcaatgctggaaaatgaaggtgctatccattttccccatcttcctccatttctcctgcagtttcatgcacctggcatcagatttttgtgcagtagttatcattaagatgaccttttggttggttgctgccacattagtagtagtacttttttttttcgcgaacacgcaaaggattgcacgtcaatatattaaaagaatagagtttttgttacacgacgcactcagccagaccggcctatgccaaggaaggaagaaaacaaagataaaaaacaaggaggaaaaggaaaaaaaactcgatacgacggtaactctactccaaacagcgggagggagcagaagtagtagtactaattacattaaccgttgaaactttgcacagaatcaaaatgttttcgaaggtgaagattcatgcttaaccttgatttacaatggttcgtatatttcaggtcaaatgtgagaaactagtcattgagaaagaagatgttgtagctggtcttcttgaacttattgcctctcatggcatcaccaagttagtaattgcagctgctgcagacaagcactactcaaggtacatctagcattacaaaattgtttcggtgtaaagattcaattgtgctatgtatttggtagaattaggaagttcagattatatttatccttctcggtttcagaaagatggacaaaccaaagtccaagatagcaacagaaatcatgcagagagctgacgcatcatgccagatttggtttgtgtgtaaggaacagctaatctgtaccaggtataatctgatgtgttgcacacttttcgatttctgatgactattgaacatcgaaccctcagaatctctgattcagttctccatgacagggacaagaaagtagaaaccacacaatcagttacacctctcagccaacttttcaagattgatactcctcccagccctgatattggtcagaccattctgcaaccgtcagctgaacaggaacaggtttcatcagattatgcagtagatattctgatttttaaaattgtatcttcaaagcatgagtataacatgatagcggtgcttttgttttcagaatgacaatgagatggaattggggttttctgatgagctcaatgatgcacgcgtagcagctgagaacttgatggagagagctttaagcgaatctttgaggcgccagagagcagatgaacaagtggtttcatctcttcagaaagtaattatgctacccatttgactgatttcttcataaatgctaaactaaaagttggcaatactatttattttaaaagattttgataataactctgaacctcccaggtcaaacaattcgaggagttgtacttggaggaggtgaaaaggaggaaagaattggaaggagctcttgtcaaagcaaacttagaacttacacggttaaaacaagaaatggacatacctaggaatcaccagagcacaatcttgggggatcgacaagaagtgattaccgataaatttatcttgagacaacaaactgtcgacatgaagagtgatttcggagccacaggacaactaatcaagccacagcaggagtatcttcagttacatcctgaccatgacaatggtgtcagacaaccggaaacgttgctacaccgaaggagcctgactgcattttctccagcatcaactgtaccatcacagtttgataaagactccattccttcccacttcatctgcccgatttctcaggttttcatatcctcagacaaacaaaatctcaaaattctgtacttttctttacagtaatataaatacttttgacaaattatgttgcttcagaagagacgtttgagttgaccatgttttgatttgcatgtaattgcaggagatcatgagggaaccctgcattgcagcagacgggttcacctatgaagctgaagcgatcatcaattggtttgatgaagggcacgaagtgtctcccatgaccaagcagcctcttgtgcaccgcgacctgatcccaaactttgctcttcgttctgtaatccaagattatacaaggagaaaacagtattcattttcctgatgctatttgctccttttccccttctctgactcactcaattttttttgtgaatattgttgtgggtgacatcgcactgacaaatggattcagctgaaagcaacagcatttttaaacagttgtcatgtgttgtttgttttgagctgtcagctagtgcagcaacagagatgctgtgttgatgacctttttttgcctctttgatttataaccaatcaggtcagacaagattatgtgctggcataaatcataatatccctgaatgtcacattttgcacgatgaagcctaaacaatcacatgaaaacatgatggaaatgcagcccatcgttgatggcaaatatagtggaaagctgatactttctctccatcgttgccagagcacaggaagatatttgaaataataataataataataataataattaaaaatcagattgagaattgtagaatcagttgatggttcagaaaggaacacaacaatttcaaggcagcgaaacaactctgttagcatacgtggcacctcattagccaagaaatacagctcttaatgctgaacctagaaggtcaatttccatgtttgttgacaaacttaatacccaaattgttgtatctgagacgctaatttatatcagaattattcaaccaaatcagagtactctcacaagcatttcagcgcactaaattaagggcctgtttgattcagcttaagattattataatctggattattatgagcaagctgaaacaaacaaataacttattataatagattattataatctataagccagattactataatctggtaatccactctaaagatgttttttttaattattgggtggctaacaactaataatccagagaatcaaacaggtaacagcttattttttattggcttattataattcagtttatagtaatctaatttaataatttatattatataattatcttaagctgaaacaaatagatcgtaaggtctctacgggaagaaatggaggaaacgaatttttgggaagaccaaacatgtgttcctccctacatggccatgatcatgagactccaatacaagttctcttcctcttcgttgctccctcttttctgcttacacgtaggccgtgtcattgagttatgtgcttgcgatcacctcgattgaaggagaggaatggatgggtgctttgttctgtactccatgcctcagcctcttcttttcctccttgttgttttctccttttgctttggttcttcttttgttcctttctctttttctctcatgtaaatcttgatgacaggtatcagaggatgcctttgtgtcgtttctcttaatttatttcgtgtaaaccttctgctggtttaccttctgattttctgaatgagaaaatacacccactgaaatagtgagtgatttcatgcactgaataagcttatcacttaaaagaaaactttaattttggaacctaactgtggagtttctttttgtcatactctgtttttcagctttagcttttaaaccgtaaataatatagatataaaagatttacttataagctatttttattatttcatttatgttttcatgacttatcaactaaagctcaaacgatcaaagcctaaaggcacaacaaatcacttcagcttggccgcgttcttttcagtggttgggtttggacgattagccaaatgtaaaacgagaaacacgaataacatataattagttaagtattaattattaaaaaaattaaaaaataagtttatttgttctttaaaacatcttttataaaaaaagtttcgcacaaaatacaccgtttagtaatttgaaaaacgtgctaacgaaaaacgagaaatatctaagcggaactagctgtttagaatgtggaccctttttatatcacgtgtcgtttgtcaatggcacgtatttctcatgtgattacacagctccaacctttcacagcgatgatataaaactttcactcactgacagcatatatatttgtagtcattgtttttttgagcggtatatttttagtcattagccaataagaaaaacaacttttatcctggagtaaatagtaattagctggtaatcacatgggcaaagttgtaaaattacctaacagcgggccccataggtcaggccccatcccatcaggggtttaatccagccgaaacggcgagtagttctcgttcccctgaggcctgatcaccaccctctctcctcccctttccctgaccccgcgaccgcgccgcgcgaggcgaactcgccactccgatctctctctccggcgacgccgccgccgccgcacaggttggtagtcaccggagccctcccttccgatcaacccttgcgcgcaatctacccatgcatgttcatggacatgacctgctgcgtttgtttttcactgttcattctgatgtctctctctttttttttaatttaattttatttatgttgtttgatccgtttttgtttgtgatggttggggagttagggttttgctctctctcgcgcggaatggagagcggcggggtcgacggcgagaggcccctgctgcgcgaggcgggggatttgggtggcgaggacggcggcgcaggcggagtccccgaggagggggatgcgaagggcgatgtgatggcggcggcggcggcgcaggggggcgatggcgatgagggtgtggaggcggtagatggggacgggagtaacgaggaggaggaggttgtgcagacgcccgatgtgaagcagacgcccggcgccgcggccgcggcggcctggcgggaggcggcgtgggaggaggctgacggcgaggagttcgtggatgtcttggaaggggacgtggatgagaagcgtgaggatggatcggccttggagaatggggaggatttgttggcctcccgttctctcgctgtcgagggtgacgaagaagggtatggttcttgtgctgatattggtatagaagaagacgctgagggtgatgcgagtcgggagcgcttggaggaggaagccatgacggaatcaatcagggagtatgtgacagaagctgttttggctgaccatatccaggagcaaccggacaaatcgaagagtgaatctgaacatgtgaaggttgctcagcacaagtcgcagattgcgaagagcagggaagagggacccaaacaatctggaggcgaaccgtccgttgttgtcgaggaattgaatggatcaagctcgtctgatgatgagagtaaagctacctccgctcctcctgcacgatccattagtggtgctgcaggtcgttctaatggcccctctttgccatctcgtcctgctgggcttggagcatcgacttccttgtcgcagccctcagctcgacctgttcagcagacccgcgctaatggtccagtcgctgtggacagagaaactcggcaggatgttgaatctcctgaggatggagacgaaaatgatgaaatccgtgagaaactccagatgatccgggttaagtttctgcgtcttgctaacaggtttgggcaaacacctaataatatggtggtttctcaggttctttaccgacttgggctggcagaacagcttagaagaaatacaggccagggtgtttttagttttgaccgggcacaagatatggcagaacgtcttgaagctgctggaaacgagccccttgatttttcttgcaccatcttggttcttggtaaaactggggttggcaagagtgctaccatcaattctatttttgatgatgtccggttggaaacaaatgcttttgataccagcactagaaaggttcaagaagtagttggtgcagttgagggaatcaaagtaaaagttatcgatactcctggcctgtcatgctcatcttcagaccagcaccacaaccagaagattctcaattctgtcaagcgacttatcagcagaaaccctcctgatattgttctttattttgatagactggatatgcagaccagggactatggtgatgtgcctcttctgcaaaccattacaagagtctttggagcatcaatctggttcaatgccatagttgtgctaactcatgctgcatctgcaccacctgatggtctgaatggaattcccctgagctatgagatgtttgtaacccaaaggtctcatgtagtccagcaagctataaggcaagccgctggtgatgtccgtcttatgaatccagtgtccctggttgaaaaccactcagcgtgcaggaccaatagggcaggccagagggtgttgccaaatgggcatgtctggaaaccacagttgctattgctttgttttgcctcaaaggttttagcagaggccaacgcgcttctcaagctgcaggacaatcctgctggtaaacctcgtatgaggattcctccacttcctttcctattgtcttcgcttcttcagtctcgagccccactgaagttaccagaggagcagtttggtgatgatgatgatattgaagacgatttggctgatgattcggattcagatgatggttcagactatgatgacttgcctccttttaaacgcctcacaaaagctcagcttgcaaagctaaaccatgctcagaggaaggcatatcttgaggagctggattacagagagaagttattctacaaaaaacagctaaaggaggaaaggatgcgccgtaaaataatgaagaaaatggcagcagaggccagtgcaagaacagatgacttcagtaacagcaatcttgaagatgatggcagtgctccaacaaatgttgcagtgcctatgcccgacatggtattgccctcatcgtttgattctgaccatcctagccatcgctatcgtttcctggacacaccaagtgaatggcttgtcaggccagtgctggagacccagggatgggatcatgatgttggttatgaaggtctaaatgttgaaaggttgtttgctgtgaaaggtaaagttcctttatcagtgtctggtcaactttcaaaagacaagaaggattgctccctccaaatggaggtcgcaagttcacttaagcacggtgaggggaaaaccacttcactggggcttgatttgcagtctgttggcaaggacatggcatacactcttcgtggcgagtcgaggtttaaaaacttcaggcgcaataacacggctgctgggatatccgccacactccttggagattctgtatccgctggtgtgaaggttgaagacaagcttgttgtgaacaagcagctcagggttctggttagtggaggcgctatgagcgggaggggagatgtggcttacggagggcggcttgaagcaacattgaaagacaaagattacccaattggccgcatgctttctaccatagcgctctctgttgttgattggcatggggatcttgctgttggctgcaacatccagtctcagattcctgctggaagagctagcaatttgattggtcatgcgaatctaagcaacaagggaactggtcaagttggcattcgcctcaacagctcggagcatcttgagatcgcccttattgccctcgtgccaatataccaaaacatcaagaagttattgcagagttaatccgtatcaaccagtatttatgtaagcgagaaaaggcagcaagataaatccattagagttaatgcaagcataaattagaactagagttaatgcaagcataaattagaactatctatttattttcttcttcccttacctacacgtaatagtgttttcttccaagtttttttttttttgatgaagttggatttgcagaacacatccttttcaggatttttgttgttatccttgtactctcaatagctgataagaaaaaaaaatgcactgctgttttgaaggctgcaaccgccgagtatcagatcgttttgctatatttgttaagatcgttttgctatatttgttactcatattaaattgtataaccatatattcttgtcccaatcgacttggaaaatactaatactccacattctattgtgtatagatattgtttggtcttatgattcttgtgttgtcattattgcctctagtggaatggttttcaagagtgatgtgataagttacaagaataatttgtcttcagtcagcttgactgcttcaagtgtgaaagcaatgaattagccccatcatttagcagtttggttgtttgaaggcaaaggcaaaacaacatatttacaataaaaaataatttataaataaaacttttatatacgtgttctcgacgatctagaaataaagattaaaaaacaaacaacaatgaaaaaaactctaaaattaactctaaattaatattaaaaatttaaattttagctgataaatataaacgaaaagagatggtgccaaatatgtatattttcacaagtcttcccatacaaaaccaattaacgtctcaattgggtcccactgccttaggcagttgactacttgactttgattcccgccaagtcttcgagggccccacctgtcagccgtggacccgcgcttctcccccgaacaaaatgaaaacgactaatctttataacgagcagagtagcatcatatctccagtttgttagacaagttaggatccttaaataacgtcctaaactaacccaatctgcgacataatctcgtttagttcgtggacttaatccgcgtctccgttggttaatatagttacagctctagctctggatcatcgcgagggagttagtttagttagttaatcagttgggaacacacacgtcggccgtctcgtctcgcgccattttttttgatgggctcgaggggcggcgacgccgacgcgtgggagacggcgagcgcgcggagcggcgtctcctcctcctcctccggccgcgcgacggccgcggcggcggcgccggcgccggagaacaaggtgttcgtggctctcccggcgcagcacaagagcggcaggtccacgctcgcgtgggcgctccggcacgtcgccgaactggctccggcggcgatcggcggcggcggcgaggtggtggtggtggcggcgcacgtccactcgccggcgcagatgattccgatgagcagtacgtgtgtcctcccgcttcttcgccttctctcgtcgtcgctctgcaaacccccacgccacaagctgcagggcttatatcagccgttcgattagctatgtacggtcaggattcagacggccctgattggctgatgcattttttgtgaggaagcccctgtagtttttacgtattccattctgatgcatttttgtgaggaagcccctgtatttttttcgtattctattctgaactcctttttagttcactactgagtcccagtcctgaatcccccaatgcggcgccccctgcctcgccggggacggcggcgaggggtgtcgcgacgggagctcactccggcgacggcgagcatcttcgcgcgcacaattatcccgaggatgtggctgggctaggatcgtgcagagattcccgcttccttttggtccaaatgcgactgggttttagccttttagggcaaaggggaagtattatttcctactgagttgttcatcgattcgcttgtctgaattgccaaaattgtttagtgtctaggtgattgtattcggttttttttttcaaactcttaatgcgaactgataatttctagtattggtgcccatggatgcacgctgagtcagttcagaatagaactgaagtagtggtcagtctcagtccacagttcacagtaaatattcattttagaagaacaaatcgcgtgaaggttgattagatgttgacctcatgtgttaaatttcagctaaatctgctattgcaacttcaaatgacatactttgttcgcgtggtgtactaattactaaacaactcatctaattacatggtagtgggaggcaagttccatgcaagtaaattgagaccggaacaggtcagtacttacagaaaatatgaaagggagcaggtggagaagaatttggatgaatacctcgagcaatgcacaaaaatgaaggttcaggcaatcttctcattcattcttagtaatgaagtctgaattgctatggggaacaagttaagtgtattatatttttcaggtcaaatgtgagaaaattgttattgagaatgaagacattgctaatgggattacagagcttattttgctgcatggggtaagtaaactcgtcatgggagcagctgctgacaagcaatactccaggtgtgtcttcatttctgctaccgatttgtacttttgttgcatcatatatctagctaagtgatgcctcaaaactctaatttcaggaaaatgaaattgcccaagtccaaaacagcactctcagtcacggttaaagcaaatccttcatgcaagatttggtttgtttgcaaggagcatctgatatacactaggtattaagaatatgatcatgagcagtatgcatgccatacctctggaccgaccagtcatctgtatattcatttcataccgacttcatatattgtttcctagatactagccattctgttagtgttctcccttttccaaaatcattttgagtaattctctctttaaactgtgttcagagattttgttgctcctatttctccaaattcacaatcacctgacactatcagaggctcaatatccaatctagctgcacggggaggaactacaaaccaatatgcaaacaatgcagttaacggttacgtacagaggtccatgtctgaaatggttgtccctgcatctagcagggtatcattgcaactgcattctcgatcatcgttacaggagtcccttagcaggctaaacatggagggcacctctgttgattcctgggatagcttccgcagaggaagctttccaagttcataccgagcttcttctactgtgactgaagaagtgttgagcgattctagttcatctggaatacctagagatggcatctcaacacttgcaggttgtgactttccaaactcagcactgcaccatgaacaggtaagctctaataccaaatttaagctttggatgattagctaggaatcttattccattacatggtgctgtatccagggtgacgcaggttcaaatgctaacctatttgataaacttgaagaagccttcgcagaggctgagaagtataggaagcaagcatatgatgagtcactgagaagacaaaagacagaagaagaattgatttcatatcaccaaaaggtaaacccttcactaagttagcataaaaaattgcaggtttttttacacaaagatctaatggacctggttacaggccaggaaatctgaggatttgttcttaaatgaggccaagcaaaggaaagaggttgaggaaaccctagcaaaggcaaatgtggagatacaattattgaaggaagaaatggatgcactgaaacacaaccgagatgacctcagcagtaagctttccgacgtgagtgaacagaaagtgacactagagcaacaggccgtggaatatggaagcattatcattgatctcaaggatacagttgcagcaagccaagccctcattgattcaatgcaaatggagtttgaacaattgaagcatgaaagagacaatgcactcaaacatgcagaagagctgcacagagagaaacaaaacatggtatcgagctcagacttggaatggagcactgaattctctttgttggagctgcagcaggcaacacaaaatttcagtgatgcaatgaaaattggagaaggtgggtttgggtgtgtctacaggggtcagcttcgtaacaccactgttgcaattaagatgcttcgctctcagaacttgcaagggcagtcacagtttcagcaagaggtaatagattaatagcaactctgaaaccataattgcaaattgattttgtattgctttagttgtactaaactaatgttactgggcaggttgctgttcttagtagagtaaggcatccaaaccttgtaactcttgtaggttattgctcagaagcttcaggtcttgtgtatgaattcttaccaaatggaagccttgaagaccatctagcctgtgaaagcaacacgtctccgcttacatggcagatccgtacacggatcatcggtgagatatgttcggcgctcatcttccttcactctgacaagcctcacgcagtcatccatggtgatctcaagccagcaaacattcttcttgatgcaaatttggtcagtaagcttggtgactttggaatctctcgcctcctaaataggtctagcacagtgtccacgagcttctaccaaacaacaaatccaaggggaacttttgcttacatggaccctgaatttcttacaactggggaactaacagcacggtctgacatatactcatttggcattatcatactgcgactggtgactgggaagccagctttaggcattgcaagggaggtggaggttgcacttgataagggtgagttggagttgcttgttgaccgatctgctggagactggccgtttgtgcaggctgagaagctgatgcttcttggcctgcagtgtgcagagcttagcagaaggaagcgccctgatcgtatgaatcatgtgtggagcgtggtcgaaccccttgtaaagtctgcttcgctgccagtagaaccagaatccattggacattgggtgaataagaaccgcacgccattctacttcatatgcccaatttctcaggtatgcatgtccaacctctccgcggtgcagtaaataacatgtcatagactcatagttgcattcacgataactgggattacaaatgtggtaagcaaaagctgtggatgttttgcttctttattgcaatcgagtatgatggaagcacaacaccatccatgtttctcagtacttggctgtgaacatccgtttggatgtagaggccggtttaatccattatctaaaagcaaatgtttctcagaactatccaaaagttattgtgttggcggttctgtgtatagtacgactgaatttaactttgatatttttagacttatggcatgttagtttagaaatacagcatctcgtgcttaaaaatcacccatgttcaaggcttaaagatactaggagctatctctgttctaaaacaagttctggttttaccgagagttgcttccttgagaactgttgccacacttaatgagggacagagatcggaacttctttctgagggaaaatatgaatgttaacaagtgtgcatgctttgatctctcagattttattgttgttctggaactattttttttttctgatataactttctgaataattatattatgcttgctgaagtagaatattaaagttccttgcagcattttttggtggggaataataatatgctactaacagtctaacagctgctgagcttggttgaaacaatattgtaggaggtcatgagggatcctcacattgcagcagatgggttcagttacgaagaggaggccatcaaaggatggctcggcagcgggcacaacacctccccgatgacaaaatcaactctggaacatcttcagctgatcccgaatctcgctcttcgttctgccattgaggaatttatgcagcagaagcagcagcagattccatcatagtaattagttcagtgaacttgattattcttagcttcataagttgtaaagttgatagctcattctttgttcagaagtctgctcgtgtagtgtagctgttttgttttgtgagcagcaacttacaataaatcgtgcatgctcatatgagcaggtgatgatcagctagcaaatgtttgatgtcagattgtgcttgaacataattgtttcaggccacttagaatcatgggacttatcagtttactgttgttggaaattggtaaaaatgaatatggagatgattttttccccctcgaggtgatgtctcctagtgggaag

SEQ ID NO: 58304 - DNA, 11102 bp, Oryza sativa
  unsure (1)..(11102): unsure at all n locations
aacctgtataaaaaaattctcgtctctcgtctcttttatcatattctcgtgtatgccttggtatcaacgatgcacatactatcaaataccgtaagtaggaatagcccatcaacaatatcgtacaacgtatttttagcatttggccaaaagatgagggcctacacaaatttggggtgagtgccctttttacctgacccacttgtgtacatcaccattaattctttcacgtcaaactagtttgctcgtgtcactgcactgatcattcagataattgttttacatatctagcttggggttaacccggcctttacatgagaactttccactagtagaagtaacatttatttattacaggaaagatcatgtataccagacatgaaactaacttctggagtgtggatgtttcaagagatgcatgcagtgccatgtaaagttagctagctaccctcaagttaaatagctttattgtggtgtagttagcatacatgtctagtgataaaaagtgagcatcaacagccaaagcccaaaagcattgcctagctagatggaaaatttgttgtcacaatgccattgtgcaaccaatggcaaaatgtcttgtcaggcaattaaaaaacggattgatggatggccattggactggccaatactatatcatcctcagcacatagtgcaagagaatgataattgaaaatgaaggggagaaccctacacatttgttttattcagaatatgatataaatctcgcttttctcaacacctttttccttaaagtacgacatgagatatatagggcatgtaatcaaagatatttcctttccttgctttttgttttaaaggaagatttttttttctttgttgagatcattggtaaattagctcaatgcacttatttttgtgtaaggaaaatcgagcaatttattaatttgttttgtggccgagttgccacaagttcagatgtatatctttcttttgagaaggttgacaaattgagttaaaagttagatactacttgactgaaaaataaggacaaatggattaaagcaagcacgatctttttttaagaacacaagaaagatcttatcaccggcatatatgcttgtagtcctcattgcacattctatactaagatacctgtgtatatgcatgctttttgtaaaggcttaaattgcccccagtagttactctaaaatgattacattatttcaagtagcagattccctacaattttcctatgatacatccgaatgcaatttttttttttttagaattcgtgaggtttagcttcccataggattggagtctatagctatttctattcctcctttttttctatttctatggatgaaattttcttcaaaatgaatagcccttagtatttagtatttgcaatttttgggaaaaaagatgaacggttaatgttttaaaatgaatagtgtccagcgtcagttatttgaaaaatggagggaatatttaagtttcagactggtcgagcttaccagctggaaccgatgcaattccaattaatcctctaattgattaagattcctacctaaatcctccatttcaacagcagagacttatcaatttatcactttctttatgtcacctcacacataccctgccatggttaagcaaaactacaaccgtacaaggtcaaaatatctagtctatatatcattactacctgactacatgaagatcattatatacattaacagcgatgtgtatactatggtttgacaagtacattgctaacaggacgaatgttggaccaacacactagctagatgatgatcttgacaagtttttttttctaaattaaagttgtttttcagttataagaaaaatgccaacttttttatcgtttcaacgcggttacattgatcaaagtagctagcagacaagtattgtcaatttgtcatggttagtgtaccgtacggctgtcaaaattccaccatcttgatctatctatccgactaggacaccaccaggcaccagccatggctgcaccagcaggataagtttttctgaactgtactgagtggccaagcgacttgttggacacacatatttgtaatgtttttatttctttcacttagcataagagtaattacacagtaaagctaagccacacagccacgcaatgtgccaagaacctaacatattttgcccaaacatataaatattcttcactgcatatacatcttagtttgttactcgaatgagtgttcttctccctttcctttcctttttccagggaatagattctaaactctccagagaagatgtgccctcgttttcttataccatccaaatagttatatttcttttttttttttgaaaaaaataacacaacagattctatctagattcgtagttctatgtggtgtctaattcagtactagattgttatattttaaaacagaggaatatgtaatatatcactccacaaacatataaatttaaatttgaccgctacaattaagttgtaaaaaaagaacaaactaaattattgctagtatgcgtatattcacatttatatttattttgttttttttacttgtagaaatcaaatttaagcttccatgcatgtttgtggagtgatgtatcatgtattaatctattttttaatttttttcataactatttagatgacatataagaaacaagaggacatcctcttaagggattaaaatagtatgccccttttttcaccaccttttgttttaatttcaatatataaggtgagtacttttgtactataaagagcagtaagtacatttacttttcaattccatataacatttgcttttcaatttcatatgctaattgtctagctagtgtgtatatataactacatggagaaatatatagggagtggaatcaagaggggaccaatgcacaacactctagctagatagtataagtcgccatctttgatatatctttcttattcgtacaagtggccagcataggaggtagagagctgttacgttggtgtgaccctgatttaatctgatcaatctatctccactgagtgcacgcatgcatcattaatctcactaagattaattaggagacgtaatatgcgaatgaattaacaaacgtacggtcggcagaggccgaagatgtaacccattttcgtaaccattgaaagaaaataatgttagagaacaacatgcctagctaacttaaatgtgcaatctagctacgtacgcactaggcaagatcggttaaacaaagagggagcaaattgacaagtgcacaaagccaaattaactttattaaaagttcaaaactgattgcaagtttggagcaatgaggtaatccggcatgcgtacttgagtcactagctcattcgctagtgctagctttgttgctatcaacttcattcaaacagagaccagctggcaacagggatacagtacatatatacatgcattctgctgttcatttgccttattaccatgcaccaatataatgcatcctcctctctagcttatcataagtactaattaactaattatcccagagcatggcaccaatataattgatccacttgagaccaagcatagtgtacacttgaacacatgcatgcattggcatgcacatagtacggcttgatcacaaacttaatcatcatactagcttccttggattaatatgatcatatcacatcccttgtaatttgcatgaattcttgcatgctcgatcattctgccttcttctgatcgttgtagatagtagctagccggattatattaattaattaatttaatgaatactagatgttgatcttgccgatgagagggatgccgatggcggtgacgacgagggtggatgggagtccgaagatgacgtggttccagaaggtgaggtcgtaggcgttgcgcgtcgcccgcctcgcctgctcgcacacgatcaggttcgccgccgaccccagcagcgacaggttccccgccaccgtgctcacccacgccagcagcagccacgaccgcgtcaccgccgccggtgatatcgtcgccgccgccgccgccacctcatcccccatcaacaacactacacccacatatataaattaatttacaattaccactcaaataacatgtaaaaaatgagttgttcttttttaattatgagagacaaaaaaaatttttttcttttaataatcattcatcttattaaaaaatataattacatttattttattttgacttgatttattgtctgatttaatctttttatatttacaaaagaaattgaataagatccattcatcgataaaaaaaagtcagatatcatgtattaaaagaaactgatgtactgtacagtacaaatgttagtgctgggtgagtcgggacacattgggtactagcaatagcatggtgcgagaaaggttgtgagtaagtacgtaccggtggggacgttggaggcgaggttggagaggaggaggatgatgacggagaggacggtgacgccggtgacgtggttgatctttgagtagggcgccatcacgttccagatggccccgggtagccccgtcttgttgaacccgctcaccgtcacgaacatccccgagaagaacaccagcagcgagtacgacacctgcatcatccattcacatccacgcacacgtggcacccagttcacatattgcttcttgtccgcatggccgccacgtgtacttgctcgtgtggcctagagttatagtgatttggacggatatgggttaccttgtcgaggcatggctcggcgtcgcggaagtcgacgacgacgagggcgatggcggtcgtgatggcggtccacgacatgttgaggccgagcatgtaggcgacgagcatgccgacggtgaccacgtacgcgaagctcttgaggaacagcttccgccggtgctccgagcactgcatgaaccaccggtgcttcgtcgagatgttctccgacatcatcgactcggcgtcgccgccgtcgtcgtcctccggcgatgcgggggtggcggcgtcgccgtcgtctttcttgttgttgttgagcgccgtgcggcggccctcctcgatggcctccatctgcttgccggcggcgacctcgtcggggctgcaggcgccgccgtcgagctccttccagtacatgcagagcagcatgagcatgttgatccccatgccggcgagcatggcggggaggatgccgaggaggaaggaaataaaggagatcttgctgttgaaggcgatgaccaggttctgcgggttgccgatgggcgtcgcgctggagccgatgttggcgctggtggcgagcgcgagcaggaacggcttcgccgggaggttgcgctcggcggcgagctcgagcacgaactcggtgaggacgacgcagcaggtgtcgttggtgaagagcgcgctggcgagcgcggtgacgacgcagacgcggcacatgaggtcgcgcccgccctggctccgccacgccagcagccggcccaggtgcctgaacatgccggcgttcttgaggtagccgccgacgaccatggtggcgaagaggaggcccaggatggggaggtcgatggaggcgtaggcgtcgtcggcgctgatcacgtggaacacgatcatcagcaccgcgcccagcagcgcccccgccgtccgcccgatcggcaggaacggcaccgacgggaacaccgccagcatccagaacacaccgaacgccaccgaccccatcaccaccttcggcagcgacgccagcgccatggccgcctctctctctcactacaatgcagctagcgtcttggagtgggaggtggtggtggcgattagagtgaggaagagaggcgactccccgtgggcttaagtactcccagccaggacgaacagctggcatcagttgcagctgatgtcagtgtccagctaggtaggcagatgattacgatccagaggcaagggcacgtacatttaagcacttaattacatgccattcttttgctaattttttcctttttatcttccagatggtaatcttgtaactttttctactatatctatataaacttctactccctccataaaaaaaaggcaaaccctaagttttcgtgtccaattttaactgtccgtcttatatgaaatttttttataattcgtatttttattgttgttagatgataaaacatgattaatattttatgcgtgacttatctttttaatttttttcataatttttttaaataagacggacggttaaatgttagacacgaaaaccaacgtttgtcttttttggtacgaagggagtagattgtaatcttataatttttttctgctatatctatataaacttcgcctgtatggtgcgagtagttagttttttacctaattgttataatgatgacattaattagtgataatgttaattattatctaanactgtattaagtaaactacaaancaacataatagtatgctgtttgactactactgctactccatactccttttaaaggaaatcgtcttgggaataagggagtacattcatgtgcagcagcaattccgtaacatttatgtgatactactagctactattccgtactacacatctacacagatgcatgtgtaacacatcatctatgtagggtggacacgtgtacgtgcaggattcatccttagccacgactggagctaagcatcgatatgggtccatgggtcaacgtgtcagtgtcatcaaatgttcctgtccggttcgtgtctgcgaagagaatgtactgtacgaaaaatggcggagcacatgcacgcagtgatctctctcttacccgttgcgagtgctaatttcaggttaagccttatctaaataataaacaatactgccgtataaattaattagttaaaagtattaaccaacttgctaagcaaattgtcctttattttactttatataggagagcatatcaacgtcgtcagacaagttttagagggatttatttacccgactatatgtatttaaataaggagaagaagataaatttatggcttaagaaaatacctcaagctatttgctccgttcattttaattataagtcgatttgactcttgtcaaagtcaaactataagtttgactaattttgtagacaaatataataatatttacaacaccaaattaagtttattaaatctataattaaatatattttcataatatatttgtcttaagataaaatataactattttttttataaatttggtcaaatttaaaacagcttaactttgactaaagtcaaaacgacttctaatctgaaacggatggggtagtaaccaaggtttacataaaaaaatatacctcctaatactttcttaaatatgataaaattaaagtagaatgcatggagaaaaaagccgttgctagcttaagcgtgcaccgccatgaggccattaggatgaacaagtgatgatcatctgatcaaaaggtggcaaatgcttattacattttaattactagggatatgtcataaagcatgattaattagctagctagcttcctgttcgattaaacatgaaagccatacacctatatgctttcgtagcggcgacctggttggatcgatggatctagccttcacgactagaaaaagcattttcgccgatgttgggtattaattttcacaagtggatatgatccttagaatcaaatagccacctacaaaaatataaattagggtgaagttcactgtctattttcgcaaacggaccacttaagccgtgcctgcaaaaatgattttcgcaggcggaccacatgagatgtgcctgtgaaaattagcgtggtatatatacagtgacacatcggctgatatttttctaagtgtcatttctcccctcactcacctctcctctcccctccccttcacctccccgaccgccggcggaaggggcagacgtgcacgggacggccagcggctggcggcggctcccctcccccctccctcccagatctagccagaggagggacgggggaggccggcgggggcaacggcggcgactacggcacggggcggcggcggcgacgacggcgcagggcggtggcggctcccctctccccctccctcctagatctatccagaggagggaggggggaggccagcgggggcagtggcggcgactacggcgcggggcagcggtgactatggcgcggggcggcggcggctacgacgacgtgcggggccacggcggcagctcccctccccccttcctccagatctggccggaggagggaggggggaggccggcgggggcaacggcggcaactacggcgcggggcggcggcggcaacgacggcgcagggcagcggcggcggctcccctcctccatccctcccagatctggccggaggagggaggggagaggctagcgagggcgcgacggtgactacggcgcgaggcagcggcggtgacgacgacgacggcgcggggcagcggcgacggcgacgcccggcgcggctcccctcccctcccctcccagatccggtcgggggagggcggcggcggcggcaaggcgcggccgcgttttttttttttcgttcaatggattttcgtaggcgggccattatcccgactgcgaaaatcgttggactgcagacggtccaacccccgcgtaaaaaaatcacttttggtcgcctgaaaaaaaatactttttctactattgcttatggccagatccggtgacctcgcgtagtaagcaagacggtaacggcgcgcgcaaaacaacgtcaggcttgttgccggtgccgaagatcatgaggcgcgacgttggatctaaggtctaagagcctcttattttcttttgttattcctcggttaagtctaagtgtttgctacaacctttagctgttttatatccacatatagatctagacgctggatttctatccatttctttttataaaatacacctgtgcgctgctgggacagcttcagaccatagctaccattccatgatcaacacgtatatataagagcaggataaattaggtcacagccctgtaaattaattaattaatctgctcattttgcagccctgtaaattaattaattaatttgctcattttgcaggatgctttgctttgtgataagtatattattatgtaaaaaataagttgtccaagagatcttgtggttacacgttcctttctcgcggccttttgacttaatgaaattaaatttctaagatcttctggtcgatcaccgtttcgttcgtgtatgcatagcttaagcaaaatttccacttcagttttacagtctgttagttcttgatggcaacttgcattgtcattgttaatttacactgctggaagaccagcaggtaagtgtgttggttcaaataaagtctggtggaaaatgaacttaaaactgtatattattcatatctattactccctctattttaaaatgtacgacgccgtttgatttttttataacgtttgatcaaaggtctgattaagaaaaaaattaatatcatttaacatgtttatattataaatttttaataagatgaatgatcaaatgttatagaaaaacaataacattttcaaaaggaggttagtactaataattaacttgatatatgtatatcagctatgtcttagatggtgccgcgagatcgtgagactcaccacggtctcgcggaccgagggtgcaaggccgcgacttcacatccgaactagtgcgattaatcattaatagattaattagcatcattagcaattaattaatttattgttatttctttaattagcattattagtaatcaattattcactaatcatgataacgaattacaatcattaatcatttccaaaggggtgtcactgtcatcgtttgaccctgttgaggtcttgttcggttacacaaggattcgttctgggtcagaaatgatatgtataacaagaaatttataataggtacaacaagagaccgagatttattccaggttaggaatcaatttaatcgtattaggtataacaaaacatccggattagttccacacttcttgactagtggattgattcccggtctcttattctccctatcatgaataaattggttcctggcctggaataaatcccagtctcttctcgttgtatctatcataaatttcttactatacttgtcattcctagcccagatcgaatccttgtgtaaccgaacaaggcctgagactgctcgaaccgcaacacgtcgtcgtttttcttaacggttcagtgatatcgggtcaattttacactcccatacagcgacggcagtatatttgtgaaaaaaaaatgtatcccggatatttctgagaaaaaataaacagtatatttttaaatttaattcttttcttggcgggtattactatgatcacaaccaatgtacgtgctattatagttgatagatatagattgatcgtagtggtttcgcgttgttacttgaggtaggcaccgctaatggatgtcaatttgctcttgaaaatctggatgctagtatcgatcaaatcttttcattgagctgatcatatatactgatccaatcatatctcggctaagaaatataatgcatgcttggtcatccctaaggttggagatattttatacaagtcggcacacatcaagctagtcacttcggaaatgaacacaaaggcttcgttccgaacatgagaattccatcatatacgatgagaggattataattgtagagcatgattcaaaaagacgctagacgctaattagacgactagctaggtgacacctaggccagaccaacaagttaaatttaagatattaagaaccatatcacatatataataacaactaaactatatatatagcacgaaaatagcaacgaaatatcaacaaaggcagtttagccgtctaatgcatcatctaatgcctaattgtgtggctacccgatgcctagctagcaccaacttttaaaacattgttgtagagagcttgtttcaagatctacaaaataatccatgatttttttatgggcacaaaccaccaaggatatagcatcaaagccatcaagtaatatattttgtcagccaaccgagtaatacccgccaagtctaaagagcaaggaaaattttattttcttgacggctaacca

SEQ ID NO: 58305 - DNA, 9340 bp, Oryza sativa
ccacctactcactgtcatgtgggcccatgacgatcctactttcaaaatttaagcaacttcttcagagttggtcaatacccaatatacttctccatgactcccaaattgtacaaggttctccagtgtagcaagtgaccattccctctacaatgaatgaggtctctaaaaaagtgaagagttttctccttttagataaaatgaagttccccattatgatgtctatacttactatgcctagactcgaattaaaacagtcgggtatatgtatcaactatcaattctaacatgtcctgttgaaactcctatagtttattattatttcttcaaaatccattacaacgcatgggcactctgctagtaaaagtaaaagagtacatggagtacgatggacctcattccctttattggacgatcacttggtttaagtgtgcaaaatgttcaacaaggcataagctaatgttgtttcgtgattttcggaaaaccctctcatgattacattagtttgtcatgattcatgacctgaagagtgcaatttaataaacgaatttcagattcctgtcaatctgcaatgtatctgagcttttgtatcctccacttctttgttttcttccctgcagatttcctaatgatttgtgcaacaattgtaagcgtccaggacattttgctagagattgtccaaatgtggctctttgccatgcatgtgggcttccagggtaaggactatttgttattctgttttgcagatatttcatgttcttatagcctttaaagaagtcttccattattcagtatctatttgtggtgtacttgtgtttattttctcttatattgttttgccatgcttttaaaattctgtattctcaatagcactgcttgtttatgtcattgtgtatttagaaccatatccatctagattacaaatgtgcagtgaatgagacgtgatctcaataattgtgacagttcaaccgtaatgaagttgatgttaggtgaacatgatagatggctacattgatttgctaatatttaacagttttgaggtaccccatgctcctttcgtgatggatgagacttagtgttggcatcaccaattatttgagatttgttcccaaaacacgaaacatggttcattgtcttttaacagttcaatttatagtatgcatctaatatttttttattagcttattcatatttatgacaaatcagcaaaaggtagctaaagaaactgaaatgttgaagcttaagccatgcataaagttgccagaagatggttagtaacagttaagcaataacttgtggaattaaataattgtaatttaagtcacagattatagtttcatgtgatcaagaatgcttacatgcttcaccttcttatctgtgagctagcattacttactctaatgcttactttggcaggcacattgcagcagagtgttcttccaaagatctctgctggaactgcaaagaacctggccacatggctaacagctgcccaaatgaagggatatgccgcaactgtggcaagtcgggtcacattgcaagagaatgcagtgctccaccaatgctgccaggtgaaatgaggctttgcagcaactgctacaaaccagggcaccttgctgcggaatgcaccaatgagaaggcctgcaacaactgtaggaagagtggccatcttgctcgtaactgccctaacgagcccgtctgcaacctatgcaacgtgtcaggacatttggcccgagagtgccccaaatctgatgctatcaatgagaggggtgggcctcctcccttccgtggtggatacagtgatgtggtctgccgtgcttgcaatcaggttggtcatatgagccgtgattgcatggccggtgcgttcatgatctgccacaactgcggtggtcgtggtcacatggcttatgagtgcccatctgggaggcttatggatcggtttccccctcgccgtttttgagtgattttccaagtgctcaatcagatgactcttcgttgggaccggcattatgaataatcatatctcgtgctttatgccttaagaatgttagtgtatttcagatacttcagttttcatagtttgtcagcttacttgtatttgtcggttctgctgtttaactgcgatactcgttgatcggtgaggatgaattccagatgggatacttgttttaattcctacaaacttgaagttagtcttatatgccttgcagttgcatctgtgtgtttttataccccaaactgtagtctgtacttccaatccggtactgaagcgcccttttgaactggcacacaagctcggcattgctccgttgcaagctttttttctaccccctaattttggtgtgtgaacgtaattcgggtaattcgggaagagtatgctgctgattttctcctgtttattgcatatctgagccaagtaatatttctggaatggacgttaacatgcctcgatagtatcaaaaggcataacttgttatccttgcctacgataaagtctcgattagtagtcgatttggcatcaaaacaccagagaaatgcagatcatttgcttctacagcgcatatttcacccaaaaaaaaaacatatacagcaattggttctgactctttcaagttgagcgcaaaccacataaagactacccgagtcacaatgttattggtcagcgtaacaagttccatggatgctcacaagtcacagccacaaaaacaaaaggcacagcagcacgacactactacagaaatcgaaacaaaatcaaaacactacacaagccgtaacgaacaaaatgaccagggaggcattccagattttggctatatataggacagtttaatccaacttcgcgtagctcaatccattgctatctgctttctcgccttccgtttgccccagagccttcatctgtttcatccaaggaaacaggaagagagaacgaaaaaaaaaaaaggtcagctactctgtcaactgagttgcccatttgacacataacaattgtacaaactgaaaattctctggaattgaagcatagaaaatgaccggagatagcaacagtgcaaaaagaaaactacctttgcttggtacgccttatggtatctgtaaccctgaaaaaacaagagcacaacataaatatgtcgttcttgtgtgttgggggtgggtgggtttaaacagttgcattgtgtaaaagcagatacttactttgtcggttccatatagataatcacaatacgtgaaaacagaagcgaaattgctctgactctggcgtccaacatagtgatgataatcatggtattctgcgcctccatagaatggaatatactttgtcaggttgaacgggaaatcaaagctgcaaaaataacaagataattttgttatgccatgtaaacactacacgagtgcaacagcaatgtgatgggcgatatcatttggtcagtgcaatagcaaagtgatggggaatacggcaaaaagtatggtcatgatactcaagttttatgagttgacactgacacaatattgatatgaccaaagcatatacatgtctttttatttattttagaaaaggggttggcggctttccatccttttaagttaaagttcaagcaacttaattgcttctatatcatccatggtcacatactacaattttatgagtgaacacttgcagaaaaacaatggatcagacccaaaacagtctagtaatcttgcattgttgctagttctccatgtctagcatagtatcatatacactagtaaatatgcatatctatttaaatttgacaagctgcttaaaaaaaactaatatcaatcattacactccagattgcttagagttgtataattttgtaattaaaatcacaaatgcacttttttctcaaattaattagtctaatcaactttaatgaattgaaagtgtagttgcaaaattgaacaaggttactcatttgctacttaaatttctttctactaaaaagctgcagcgaatgctgaaccatggtctgtagtctattctagcattattctggaaatagtagataaaagcatcctatttctaggtaaaccttttctgttcaataactccaaatgcatcaacataggtacctgtatcctatgttccaagcttccaattggaaacaaaccctctgtccaaaaatccatttatcactaacaaatcaaaatgccatgcagctagatttgcaatcacccactaaatctatccacaacatatccatccatcactagcaacaaatccaaatacttgccaagtcaacacaatgctgtgcacatcgttagacttatattacgtgataaattatgcatcctccaaacaatccaaagaaggggggaagtacaaagtttccttacccgctgtgtgtctctatggcctccatctggcggagtacaatccagagccagaaggtgatcatgtgaccaggtgcaagcgctggcccgacaaaggaggggatgccgaggatgagcacctcagcccagtgtgcatatggcgcggcgaatccaatgggtgccgtgaactcatggtggacacggtggatcttctcatagccccactccccatgtagcaaccgatggatccagtagttgaggtagtcctcaaccaggaagtacaccagcagctgcgccgccatctcccccagcgacggcagtggcagccctgtgtggattcccaccatctgcaatgttcaaaaacgacctatcttctttatttgatctctagaactactataataatgcaccacatataaataatagtaaatgatataaaaggaacaatcttcttttacttaagagtattaaaatatcatcaagacgaccttagatcatgtgattgcatctcacaagggttcccggatcacaaatcccttcaaatctcgcaatctcgaactgatggatcacccaccatcttacaaatccaaattctaagcgccgcatacgcgtagtaaccaaatgtcgcgttcttccttcgaatctaatccccgcggcacagcattgcgcggattcatcgacgagagccgcagaaaaaaaaagaagaggaaacgcaccttgacggtagggtaggacacgagctggagcgggccgatgacgaggaagaagaggcgcatgacgtccctgtagcagcggaagaactcctcccgggagagccgcaccttgggctgcagcttgaacggccccacggcggccggcgcgcggagctcgaggagcgcgacggggagcggcgcgagcgtgaagacgacgaagaggaagaggatgttgtgccagaagaggacgtagtccgggatccccgccgagtacctgaaccacagcgactccgccgccgtcatcgccctccccagcgccgcctccgcctccgccgccgtcgcgtagggcagcatctctccccgcctccgccgccgccggcgagccactcgagatggccccctctttgcgattcccgataactctagggggttaggtgcaaaatgccgcttcgagtggcctcgcgtcgtcgtccacagctggacagtgctgtcctctgctttttatgatggcatgtttgtctcactgacatgtggggcccacgtaaggcgcggtgtgcggtgggctccacctggcagtgagtggggcccgctgctcctttgttgtttttgctaatgctgtgtggctggatctcgcatgcatatatggtatggagaattggagatggagattggagagagcatctgttgctctttgactttctgtggccatgaatccactccaaaaactacaaatactcgaaaattcgattgtttgttcaatgctgtggagtaatcagatgttcgatctggagattaagaaacaaattagctgcaatttgtgttacaagttggtggcagatcaaattaatcaaaccaccaaatcatatttttacagctgaagcgttggatactcctccaaatttcagcacaaatgcgtgcctagccagtgcattcatgatagagagaaaaagatatccagtgctacaggtcatagacaagatggatttcatttattatgggggtttttttatatataatttacatcttagaacagctattaaaatactggaaactattgagatggcaatagttttatcagagaataaaagagctatagtagcaataagtgatcaggggacaacaatgtgagtatataggatttaatttgttcgatcgcccatacaaatatgttcgtgcttttaaagcagcacacgtacgtacgtacgtcgaatcgtcgatgcatgcattgtttggtcatccgtatttatagccaatgcaaatttcttacgtgcgaaatgcaactacacatatgccacctatgcatccacgttcccaagagtccaaccaccagcagccatagatgtcgatgtcataagagcactacggctagggaaaagaacaaattcaaaatgttgccatcaatgtgcattttgtcacgttatattttgttttcccgattacccagcagaaatatacgtacaataccactacacgtaacatcacacttgcacgcccgtcaaaataaacacacactaaacaaaatgaaaaccaacaatgcttatataaatttattattattttattgaaagttcatttacgtatactcgtagcttaattttcatacacgcgaggatttaaatccggtaggtaaaattatatatcgatgactccaccattattccgtatcatttctcatttcaattcaatgctataaaaatactacaatgcacttgcttttcctcaacaacctacccgtcaacctctttcctagagagcgacgtgtcgggcatatactctctctgttttaaaatgtttgacaccgttgacttttcagtacgtgtttgaccattcgtcttattcaaaaaatttaagtaattatttattcttttcatatcatttgattcattgttaaatatacttgtatgtacacatatagttttacatatttcacaaatttttttaataagacgaacggtcaaacatgtgctaaaaagtcaacggtgttaaatattttgaaacggagggaatacattcataacaaaatgtcgtacatttttatacttcgatcttaccaaagttaattggattagctatctattatcgtttttttgctggtccatttcggaaagtagctagctagatgcatttttctatggctagctaggtacgatgtcgagctagctatgtgtcatcgcctcaatttcggcagtttttcttcctctcctctcgtgacttcttctgtcgacaaagtggcatggtttccacgtccaaattcaggtatgccaggccgccgcctatgcatacatgtatactcaagcaaaattgttaggaaatgataagcgaacaaacgataaaaaaataatagatcagtcacagaagacacgagatttaacgtggaaaaccctctcaatacaggagagaaaaaaccacgggcgccagccagcaaaatatcttcactatatctggggtgaggttacatcgccgcacggcggtttacaagaggtatatatatggtggaaccctaaaaaggatgacgatccgttttgcgggggctccggcccaagcctcccggtgacgggcctccgctctgctacggcagaagctggcctttattaagtgcaaatgaatttgtatcacaactcaacaaaaatgaacatgttttgttatgataaaataaaatatataataatatatcatatatgtaatatatttttaaataaaaatgctagtatgatttgttgcttatttgattatattttatttacttgatgcaaacaaatattagactattatgtgatattagaaactaatttaaaaagtccaaaagtagcggtatatctttcatagtagtagtttagataaacaggtatgcaataccacgcacatttcagacctctcaacttcatcaagcaattaaatttctgagtcccctcatgtactgtgttagatactttggacttgagtttgcttaatttgtcccatgtatagccccataaaatttatttttaaatataagtggtttgcatttagtttcaggcctccatccttaaacacacaagataccatcacaattgtatatttctatgagagtatgaatactacttatatagctttattttttataactattaggtacaaactttttaacagttcatagtataattatattataactcatatatattatatatgtatttaactaattagaagtagtctcgccgaggagcacttttgctcacgaggtagtgcggcttttttctcttgggcctgttcagctgcacttaactttattgttgtgcagtcaacacaaatagtaagttgagtttgcagctgcagcaacaacggctgcgtacaatggctgtaccagctagccgaacaggcctcttgtagacacgaatctcaagacgacccgacggtccacaaatcaactgtttggcaaaacaaatttatcaacaattgtatagcaattcagatcctttaatccacgaacagaggatagtttctttttccggcaggtacagtaaaacacaccaaaaacacatctataaatccaaggatagttatcgtccttggccctgtttggtggagtttaagattctaagaaacaactggtgagaatttggagaagctgggaaacccagcttctgacttctagtttattttctgtattctacaactacagtttctcataatctaagtgaaaatttggattgtttggggagcttctagcaatagcagcttctagaaaaatctccagctaccagaagctcacccaaacaagtcccttattaggtgcatcaccaaacatgtacatcctctcgtactcgatcctcctcggattgacgacgaagcggtgactgaaaataacacaaacacgtgataccgagccagcatgcacggtaaggatgtaagtggatcgatccgtaaactcacttatagtacacaaatgaatgggtaaccgccgccggcggactgtacagaggcgtcgtcaaacgggcggcgcacatagtttccctggggcgtgcagacaccgaacgctccgacgacttgcacgctccatgcatcgccgggaaacctgtctctctctgacggctcacgagcaattcgcctgacaagtgaccacccctcatgctcaatgttctgcatcacaaactgacacggcaatacaacaattaatactggtgcttaagtttaaactgcttgcttgtgtccatcttgtattcattgtttgctggctaatttggccgatctcactttgtatatctccagtggttgagcacgtgagtcgtcaaacatccactacaggcggcaattttacagcaaggatgagcaaatcttca

SEQ ID NO: 58306 - DNA, 45576 bp, Oryza sativa
ctcttagtgattatggatgcattgtaagtatgccagtgtttacatttgcagttaccgcttggtgaaaacaacattatgaataaaattgttatatgtgaaagaacttttttgctaccgaagatttcagtttattttgtgctcaaatgatttatactctactgatatgtcatcttttccctttcagttacttgttgccattctttccgttgttgatgacacaaagcttgttaccaaggttagctagctccagtcttctatgcacctgttctgagtattgtgctgtgataaatatcgtatggagcatttatataacacttttgtttgatttgatagatcgtaattcaagagctcgccaaacatttgaagcaacttatttttgacaaggtgaaaaggaaaactgagcttctgatatttttcaaaataaatccacaatgcactaatagtaatgaagcttcttgttggtacagaatggaagacgtccattgctgcaactacttcaccctaattgttcacgctatctgcctccagctgatctggcttgtctgaactatcgtgtgccttctcttatttcaaaggcaagctagctattctgtttagtattttaaggagaacatagtgaagtgctgtgttataaatattccacttttggttaggatgaagcttccgagagtgctgcagaagatatcccagagaataaggtggatgttgcaactaataaggagcaagatggttcagaaagcatgcagagtgcgtctgacagcaaaaaggacccatttcaacggcgacatgaattgttgatcaaaagtgaacttgccgaggtgacatttattcagtgctatgtttattcaaatacagtgttaaaaggatgcaccttttcacattgattactgcagtagggtacaatatgatttctttggtgctcgtttagtcgcatagcagtagccagtcacagtatgtatagctacatgcccaccatgtcctaaaccccataataccaacatgcacagcattttgtgtgctcacgaatattattatataaatgatggcaaaatggtccattagggattttcctatgcaaggtttcaagtatgtaactggaaaacaacacttacaataagggtctactgtattttcttgtgtgcccactattttgcccaattagtgctgacgtgacaactaacataagttaatcgtgatgaatttactagccttgctcataggcctttctttttgtgattattagatataatatctagatgccatcgtggcagcatagagttacttgtgactcaaagtattgaatatgctttatgtggatttaatataatgcagaccttcctgatcttttctcaggtgctcatccagactctcattgagaatgtcggggagttacttcgaacaaattttggcaaagatgtattgcatgaggtgaactacttttgtccttgcagatggtgaaacctgctttttattatatgctaacaatttttcatgtcataacctcattggcatggcatgatctttggctggtactcttctttccgtgaatatcggtcacttgtttactgaatcatgtatcagggaaatcatgatttgaataagttgcaccaagaataccctttcgtagtatatcaggcacaaacgagttagtgaaatacgatacacagtcataatctggaatattgaagcaacgtgtctttgccaatctgcggtgcttgattgttgtcattgtataaataatgtttcataagtgccactggtgtcactctgatatgttgacatttgcaaatctgaaggttgcggttggtggagaagataatattctggagggcatcactgacaggatccacagcttgcacaatgcaatagcttctgatgcagcacgtccaaaggcagaagatactgaacatgcctttgataactatcattccagccgtctaatcagaagacttatacttgaatctccagcatttgctgccatcctatggaaaaaagctcttgaaggcaaatgcaagacatgggctgatgggcacaggtacctcgatttttattgatatgaccctctcgcctcttctcatgttttccaggagtcacatatagatatgttctattcatcggatatttataaaattcaatcgttgattggaatttgacaccagtccctttaggtcatattccggtggcattgtctaatttatcatgcatactgtaaatttctgatattctctcagcttgcttgttctgcctgatgaacattttggttttgatttcttgatatttttattcagttccaaggtggtcgcagcattccttgaatcgcccgattccaaggtaagggatcttgcaaaagctgagctgcagccgctggttgatcgtggcattctgaaaatctcagaccataaagcagtcgaaaaatgagttttgcacctgacttccaagcatctacagcaatacgagaaatcgacagacgaacatccgtgcttctgtgttggatgttttttttgtaacatgagtatgttctgcggagcaattttgtcacctgttaaaagagtgtagctactgctgtcaccagtgagtgagtattaactctccgtaatgttatgtacctttacagtaaaattgcatttattttggtatgactgcaagatacgaattctccggccgtgtttgttctgcataggaatgcgattgataattttattgacaactgacctgaacaaatcttggagaaaacggatgccttaatcatagagttgtcatttttaatactagaaaacgatttttgcaaaacacttacaaatgcttcaaaacctgggcagtatttagagcagtatttagagcaggtacaatagtaaactattagccagctataaacatattttaatgagataaaaaagataagagataagagcagcggactgtagatatgtagctagctgcagcacgaactccaagacgcagtgtgtatatgataggtgggatcgtatattaatagtatagttagctattagattgactatagatgaattggagctagcagtggacagtggactatattattaaacttcttttagtgaatttcactgttttcctcttcttgttgccgtaaaatgaactaaagaaagctaagcaatctgaaaatgtaaacgattctttgagagagaatggaagctaataaatctgcaatgtcactagcaggagttcgtccgtcaccaatgacgctttgttcttgcggcgcgctccggcgcggttctgatctgatacaccggcgactcgccggcgccgctgccgcaccatctctggttccgatcggcggcgaggttctcctcgaaccggcagaactccgcggcgaacggcggcggcgggggcgggcgggtgtgcgggtagccggggaaccgcagccggtcggaggggtcgaagagcgggaacgactgccgccgccgcgcgccaccgccgccgttggccttgaggcagctgtcgatgacgcggcactcgtcccggagccggttctgcacctcccgcagcgcctgcgccgcgacgggcatcctcctccccccgccgccgccgccgcggtgcttcccgtgctgcgcgccgccggtggccgtcgccgccgccggcgtcctcctctccgcgcggtgcctgaacctgtcgtggcacgcggcgcagtagctcgccgcccgctcgtcgtcgaaggctcgccggcgagccccgtcagtgaggcacgcgtgcgcctgcacacgttacacgatttgatcgtcgcatcaaaagcagaaaccgcaacgaaacgaaacggtttttgcagaattagtactactaattacgaggcagtaaaaactgtagcaaatcaccacgtttaatcactgttacgttaaccacgaggattcaaagtttcaaatcgatttgaaaacgccgctctgtgggcgaccaccgctgcagtaaccgatggtggcggcgatcgaaaattgaccatatctccaagaagaggagcccaatgcaatgcaaccacccactaaattgaaagcaagaaaaaaggcaaagattccaagccatcattaggaagaagaagcatgcggaggcagagattaccaacctcggagacgatcttgaatgcgacctccgcctttgcgtgcgtgttcttgtccgggtgaagctgcagcgctgcatgcaaaccaaaccaaatcaaatcgaaccaaatcaaaatcaggtaatccgattcagggcattgcattgcgtcgcacgcaccgagctggcggtagcggcgcctgacggcgtcctcggtggcggcgtcggcgacggcgaggacgaggtaccagtcgacgaagggcggggatcgctgccggcgccggtgcgtgcacgcggagaacgccgccgacgccgcgcacacctccctcaccgcctgcgccttgctaccgccgccgccgtccgccattgccattgcccccaccgcgtcactcgatccgcttcacctccacggccatgcacattcgatcgatcgatcgatcggccgcagtgagagccgagccgagcagtgcaggcgtcgcggcgagatgctaccagttatagtaaccgtgtccacttcgtctctgcgtgtgaggagtggagtggcgagacggtaccgttcaaagcagcgatgagaggagatctcgaggggggaattcaacagcgcaaattgcggccaagcgacaaaaatcagaatagggaaataaaaaaaacaaaatgatttgatttaacacggatcaattaaattcatcacatactactagagaaatatttatcctgttttttaataatatatcttattatcatattactctctctaataataagtatttgataattatgataagatttggtgaaacttctacaattccgatcatcgataatttctttctcatattgttggttcaaagattaaataaattatgtacgtatatttgacttaaaaaagactatcgtaatttaataggtccatttatggatctatatgctttgattggaaccaaaagatctagaaattacagtcttaatagattttgaaaatttattctaataaaaacttcaccaaattttctactccttccgtttcatattataagttgtttgacttttttcttaacaattttttttagatttgactaagtttatagaaaaaaaatagcaatattaatgatatcaaattagctccattatatttaactttgaatatattttgataccatgtttgttttgtattgaaaatgttattatattttactacaaacttaatcaaacttttttaaaaaagatttaaaaaaaagtcaaacgacttataatatgaaacgaagggaatacttaacatctcatttatgggagtatcttttatggtaccacatgttagtctctctatattatcttccgatgctctccttgctcgaatgagtacatgttgtatggacagagggttgcagggatcaaacaagtgcagctcgccgacgagatttggtgtttgtcctgttgctgtaaacgtccaatgttttaggttggccatggcgatcaaagtcctgatgacaccgaatactgatctggaaatggaaatgcagagctgtgatcattcagatttcagagtttcgcatctctgatgatcgtcatctgaatggaaccagtccctgtttcttggactaaacttctcacataatccagttgcgccaaacattcagctggatgattggctttcaggttccgattgttcacactgtcactacgattggaagtactcgtagtataataatcaacaaacaataacagtatattatggtcttacagtttcagataataaactccggttgtcagtcagtcgccatttcaacgagactgaaccagaaggttcatactgaaccaaacatttctcaataatctgaactgtatttctgtaacatttgtcagccaggcaggattagtttttccttgagccgtgagaccctgacaccagtggctatgtcgaattctcgatcgattggcaaggctagtactctactgctacttgacaaatgaattcagtcaaaagagagagttgcttcgagactttcaaccagaagcactgtatcaagttaggctgctaatgcatcggttgccgatgcaagaattttgtccagtatacttggatcaccacagaatgccaataaaagaataatattttcaatgagcaatgaaatactattttcattttgcaaagacctgaagaacgactgaacacactagctaaacacgaaccctatcttttcaacgttccaatttgcgacgccaaacacaagcaacaaagaatccaaagctgatcttggaacagtgtaaaaattttacacacccaaccaattgctaatatgagagagcctttggagtaattgtggctgttcacagctaaactcaaatctgatgctagaataataaagaagacatattgattattgaagcgtagctcgcctgcagcagcaatcagacagagctaaactgctataaacagtttggtggctgcagaatgcggctaagattttcgagcttcatgttgcgatgatactcgaaagatcatacggatatcctcccagcaccatctggccgtccgtagcttgatccaacggctcggagagaaggagatcttcttcttggaaaaaaaaaacattcacgtgccactgcatgtgggccccacagctcagggctccaaactctcggcatcttcccacgagggtgccagcatcatcactcaccagtcaccacggagtaaaacccacggcctcattgtccttggcgccctcttacatgtgggcccagtggtagaagcgggcccacatgtcggtgtgtgtggggagtaatgggtgagaaaaaacccgtggtttttttttcttcttggcagcaatcatttcggtggggccatgtcgagctgaccaattggcgcttccatgtgatccacgctgtcatcccgggcccaccagctctcccttgtcgataagcatccggagctcgctgctgttcttgtttctaattgctggtttctaccagggccttttagcaaaaggggacaaataattaatcctactagcattttgtgatcttgagatccactgttttgtttggatgattgaccgagcacgaacgtaaaaaagactgtgaggaaagcaaattgtactgtacttatattcaataaatccatttttagagatcgttttacaatgcgaaattgcgaaccgagagccagaacattccttgaaaattagtagacctatgaaacttagggaaaatgcttccctttttttgtttggggaaaagaaaatggatcaatccggtaaataacatcgcgcctgcaatggataatttatcgtggtgatgtcaaataaaaatggaatagcgtttggggttatgtcgaatttcctttcattcaatctctatcgtaattggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttcgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaagtagtattaaatggaaaaaaaaccaatcacacagtctgcatatagattacgagacgaatcatttaagcctaatttgtgctatgatttgacaatgtggtgctacaaacctacagtaaacatttgctaatgacagattaattagacttaataaattcgtctcgcagtttcttagcagaatctgtaatttgttttgttattaggctaagtttaatatttcaaacgtttatccatgtatccaatgtgataactaaacctaaaatttttcccaaactaaaccgtgccttattttaaaaaccacctcacttcacttggggggcaagttgcaagtctcaagtttacaaatccacccctttcacaaacaaaccgaagcttcttctccacttcgtcccacacttcaacgcctcgcgatcgatcgccccaaatccccgccgccgccgccgccgccgcgaatcgccggatgcccgccgccgtcgccgccgcgggggcggcggcagcctcgggcaccgcgctgctcgcctacatactcctcgcatgctgccggccgcagccggcgccggaggccggcgaggaggaggaggaggagtcgcggctgttgtcgtccggggcggaggcgcgggggagggaggcgggggatggcggcgaggaggaggaggagtggccgtacaggccgccgtcaacgtgctgcgaggcggcggcggtggccgcgcgcacggcgcggcgcacgtgggacctcaccgtcgggcgctggggcctccacggcatcgccttcgggatcaagcgccacatgaagcgccaggtccgcgagatttttcgcatttcacctcgtgattcctcgctcttgtgcgcgattactgcgatgctgccagtattcagttcttctgttcgtttctgtgtctgcgctttgcgtttcttacttgcaaattgaggatcatttcgctcgatggctttaacgatagcgactgatcacgatgttctaactgcgctcaaatcgcactgagcggcggaacgtgtagttgctttgcttcgagtggactttttcttcgttttagttttactcttgctgaaaattttggtgtaaaaggcaggatttatgactatttcaaggtttgacttgatttgacttgcaagtaagactgcttttgcctttttatttgggaaataaaggctcaatgttgggtcagtggcttacaatagcttcacctctaccactaattcaatacattcctcgtacttgcaatgtcagatcatacttaaattctgtgcgggacttaagatcgttgatgtaaatatgggtaaatctcatggatccgtaaggtcggattcatggattttttcagagtcaagctggtcatggtggtcaaggtctcctctagatgttgatctgaagtgagaaacgtttccaactgttctgaacttctgataaccaatcgatatgcgttttatacagagctggttattttgttgcgcatgtgtgaatttgctagaagaacaactaataaaattggaccagaattctgttgtcttgctaaaactaaaatggttgctcaaagaagaggaaacaggacgcactcaacattcagttcaatataatgtactctgtttatctgcagatgttctttgcaaagctattcaatgcatcaaaactcaataagatgtacttcccgtgagtgaagagaagctggctatccgatgttctgatgaatcagcataactagcattttgttctttaagacgtaaattcggcggtagtagattgtttgctgaagcaattcagttatgcagattataatcagcttggttctgtatagctgtcttgaacatattacatagtcaatggtgtggaatcatattgtgactgtattttttcctgtttgtgtgctctagggtgatttgcagcatgagtatagtggaaatgattgccttcaactaaaaggtcacgacgcacacactgaagtagcttatctacttgagcacttgaagatttgcatgttctactcaaagaaaacattttcagcgtttcttcagtttggtgggtacaatcaagaagacattcttattcacaaggctagggcgagggtgagtaagtatcactgtattcctcttatctcatgcttaaggtactcacatttacaatttgtatttgttcctccacattttgactcactcttaactatcaacttgatgcagcttatgcaaccttctttcgcgcttgtgtgtgacaaaaaatccaagtgctttctgcttttcattcggggtgctatcagtactaaggagcgcctaacagccgcaactgctgctgaggttccttttcaccatatagttttaagtgaaggacaaatcagcaacgtggttttaggatatgcacattgtgggatgcttgctgcagctcgttggattgctaaccttgccaagccccatcttcacaaggcagtacaagaattccctgattatcaaataaaggtatttcttattagtgctatgcatggatgaagtgactacaatttataggtgtagccgctgcagtgcgctgtgatctatatacatgaccttatttgaaataatttgtttttgataaatatcactgagacagttaagaagcgtaatcagatctctccttttgtcttttatgtcatgtttatttttgtgaagatttctgacccaaattatgtctccttatttgtcatttgtactaggtcattgggcattcaatgggagcaggtatcggagcaattctgacatacattcttcatgagcatcatgagttctcatcgtgcacgtgtctggcatttgctcctcgtaagtgacttattcatgatttacatctttaaagccacactttgcttagtttttgcattgtgccttcgagatattatatggctttatgattatcaggtgttttcttatattattttcctgagttgtaactttgttctgtttcagtacttaatgggtgacaaaagttgttttggcactatgttctcatgatctcatccatgccaactgtttggttgaacgttcttgtgtacaatttgcattattggacagtgatggagaattagccattgttttatacagatatgatagaattgcattgacttgcaagatttattttattaggctacaagttaatccaggaactgagacagttatactattttctagatttaagagaggaaatgctttcagatttttaaagggttcctgttttgtatagctgcctgtatgtcatgggagctggcggagtcgggcaaagaatttgtcacttctctcatcaacagaaatgatgtggtcccggccttttcaaaagtttctgctgagaacctgcgagctgaggtactctgaatttctgatggccagtgtcttatgtgtcagcataataaaatcagaccttcactagtatgaacttcttttgtaattaacaaggaaacattttaagaacttagcaaagtgttaatacattaatttcttgtgatatttcaagaaatatgtgatgcaatggagatcttagcttcaaacttgaaatgttaacctcattggcatactggacagtggccatataaaatttctgataaattgtgaaaacgaccatatacctgattcccaacagtgttctatcatcactgatttttttgtctctactgcaggtaatggtatcatcaaagctagatgatgagcaggatcaagctcactttagcttatttacggcaataagtaagcgtgtagctttcataaagtctcatatgctgtcagtatctcatccaacagagaagaacacagatcctgattctagcatatctgaggtaatacctcttaggcactttaatttctactatttaaatgattgcttctgtcacttgtcactggatcctaaactagcacaatgataattttgcgtccttaagccacatgtgaacccagcacgagtattaatttgattacccagcggttttaatgactgttaacagctgatccagcgatcctttctagcatccaatcccaatcaacaccgataacactgtggcgggcatgctaatattatctgttagtatactaggtagtaggcatatctttggtacggatgattttccttccattggccatacaagcatcacatctattacaaaagggcaaaatgagaatttccatcatgcacagttcctgcttctccgtgcagtgtaccttccaaaaatttacagaagcaaagtaactcttgggtttactgattagtgccaacgtgagtacagaagcaaagcaacgagaggattgacgattttctgacaccctatttattctgtcaatgcagcccttgctcaaacatgtccccgaaatcacgcagcctgtaacaaatgggctaagcacagactgcaaccagcatcaaacggacctcgttgctaatacagagcaggacttttcagctgtatcagttgttacctctgaagaaaagattgtactatctagcaacgataatgttatcagtacaaagtctgttgctggatcaggctttgcagcacaaggggatgtgaacatcaatggatcactggacactgaacaagaacaatcatccttgacagggcaggaggaaccagaatcactgaagcagaactgtgatatcaaagacaagctgaaagaaccgctaccaacctgcagttcgcgccagtttttccctcctggaagaattattcacatggttgcaatggcctcacctgacccaaatcctggtgagggatccagcagcaatgagatcattagcatttatgaaacgccaagagatttgtatgggaaaataaggctagctccaaacatgataaaggagcattacatgcctagttacataagcacaatggaatcattattggaacagctgctcaaagacgataatgtagatacaataacaaatgatttgtaaattatgtaaaaactcaataaattattaatccaattctttgcaaattgcattgttctaaaacaatttccatatgcctgcatgttatttctgtcccaatgctactctgtatatataccactaaagctaaatttgcatggtcaaagttggaaccattccgttgaccggatgacgtggacatcctccgtacggttggtctctcatgcatgcagctgtaaatcctctcggcctcacgctctatatcatcactttcaagtgttttcatgaaaacgaaaatttagctcgccatcacgcagatcgacatggctgctgcttctctccgtctggtcgtcgtcgccgccgccgtcgcgatctccctccggggcgccgccgccacggcggtgaccgtggaggacgcgtgccggcacacgaggcacgaggcgtactgcgtgaaggcgctgtcggcgaggccggagagcagggcggcggcgttggacatgccggcgctggcggaggcggcgctgtcgatggcggcggagagcggggcggcggcgacgtcgttcgtgaggaacctggcgaagatgcccggcggcatgccgccggagtgcctggaagggtgcgtggcgaagttccaggaggcggtggcggagctgaggcggtccgaggcggcgatggaggtgcgccatgacgccgccggcgccaaggcgtgggtgacggaggccagggcggacggcgagacgtgcatggacgagtgccggatgacggagggcggcgccgccccggagatcgccgacaggatcgacgagctcgccaagctctgctccatcgccctcgccctcaccaatgcgtccatgagcaaacatccgtagcaaatcatcgtgtataacaaaaacgagatttggagggggagacctctatccaaacatttattaaaaagaaattatgagcgtgttaaagattgaacacgagatctcggaatcgggattgaaaccatataccctttaccactgtactatcatgtgcatttcatgtatcctcgtgtatatatacgaccaccaaattctctcttgttatattcatgacttgagcacgtctcattgcaacgtttcaaatttccaacaaaatttatgttggacacatcaggctatgtaaatctgccaaatttcaatttcaagagtaaatattgtatttatcatgcattagcttgtgaaatagatggtatcacctatcacgtaacagaccaaacgggctaaaaccggtgacgaatgtggtacgattcgattggtttggaattttggatgctgagtgagattcacaaaaggccagaaagggctgagtacttagaatcatcatttttacagttttcacacaaaatcaatttaaatcctacaaaaactatcccaaaatcctataatccagatgagccgaatattcttggatgggccgtggagactattgcagcccacagtcgcccgtcccactttcggaataagttcatctgaggtccataaacttgtcaacgaatccgattttagtccttaaccccaaaaccagatacaacgggtccctcaactatcaaaactggtacagataaggtccttctgtggtttagatggcagttttggctgacaaggcgcctgcgtggctattttgactcggtcttcatcggacatggcactgacgtgacgcttatgtggcaattcgatatagaaaaataataaaacccgtgggacccacatgtcagttacacaaaaaataattaaaaaatagtggggcccacgtgagccccacatgtcatcctcaccctacccttcttcctcatctctccctatctcccctctcctctctttccacgcgccattggacggggaggttcggcggccggtggcggcggcagcgacgcaagagaaggggcggccggctgggttcctcaagggcgacgacaacctggacgacgacgacgacgactgcggtggcgggagcgttgggtgaagggggcggagcggggcggccggcgcacgcctattaacagtgaaatttggtaatcggcaaagacgtcatcggcttagaatcattatctgctgcagcatctcggaatcagccgatgggagttatcaagtcgccaatagtcggattcctgctatattcggttaaggaaatcaatctactaaaggatacttatccctaagtgaccgagtttaaagaggatgcggcatggcagtttatctattaattaggaatagtttgttagtttccttttatctttaggaaagtgtgtccgataaggactttatattttccttttatctttaggttagtttctttcttgtccgacaagggcttgtatcaacccatgggtataaatatgtacacccggggtctatgtaatctatctccacgatcgatacaattcggcgcatcgccaccccttttaccttttctactttattttatcgtctggcgggacttggcacccgacgcggggctgcatcggtgttcgatctccggcttcgatctccggcgaaggggtaagtccaatgtttcgccggtccaggcaattgtatcatttatgtcggcgtcgttcaaggctgcactagtacattcgacctcttggattgctctggtttggatgatatatttgcctacctatttatcatatgtctctgttaatctagtcttagcatatcaatttagctctatcggctgcttctcgttttagggtttttgccggtattagctaaatcgtgtttctagattagattagcttagacatctaccaccctgaaaactcagtcaacggcttgattgtctagatataatgtttcttttcatacttagtgctgcatcagttaagtttgatctactaagtcgtgcttagaaccataatctctagcctgcttcttgattgccaataagggtatcatcggggttttagccggtgagttatctggacgttgcatcggctcataaggattgtatatacatataagttggatttagcgatgacaacaaaggtttcactgtttaatctaatcttgtggatttcatgacatcggacctccagccgatgtgtgctttaaacctcggatcgatgcttatttatcatatcattgctagccgattggtttataccggattatattgcaatattatattatcatcagccgattgcctttatatcatcatctacattggacatatagccgatttatcaaaaccctatcgctatcggctggtatcggcatcggctattatcgactatcggctggaactactctatcggcttgtcagccgatcggttgttttgatctactatttgcatatcttgtcagttgcaggatcaaactgactggcacgcccgcatctcaccaacctttggacctgcacaggagttaagcagatctcctaggccggtgtgttcgattttttcgtcaacaacgccggattcctcaagggtggcgacgacctggacgacgacgacgacaactgcggcggcatggaagcccacgtgatcctcccatgaggaacccgcgcgtgcgccggccgccccttctcttgcgccctccccttctcttgtgccgccgccaccgctgtgccgccggccgccgaacctccccgttccgtggcacttggagagacaggagaggggagagagatgaagagcggggagatagggagagatgaggaagaaggatagggtgaggatgacacgtgggccccaccattttctaattatttttttgtgtaactaacatgtgggtcccacaggttttattatttttctggatcgaattgccacgtaagcgccacgtcagtgccacatccgatgaagatcgagtcaaaaatagctacgtaggcgccacgttagtcaaaaccgccatctaaaccgccgatggaccttatctgcaccggtttttatagtcgagggacccgttgtatctggttttggggttcaaggacgaaaattggattcgttgacaagttcagggacctcagatgaacttattcccccactttttcgatccccctggcatattcggcccaagataacccgatacaaaaaaagcccaagagtgtgtgtgtgtgtgagagagagagtgagtctgatttgcttcctccgcgaaccggtcgtcttctccagcgagacagccgccgcagaaatgggtgggagtcagctcagcctcaactcacttccgctaattcgctgcatgcaagctctcccacgtccatggcggatcccgcccgcgcatctctcgccatggcagcattagcacgcctcgctcacaaaacgctcccgaccacacgaacccaactcccgctccccaccaccatatatcgctcgccgcggtgcctccacccatgatcctccatcgacgacaatggcggcgacacgcggctccgtgcggctcctcctcctgatcctcctcctccgccccgccgcggcggggagcccactgatgatgacgtgcgccaagacgccgcacccggacgtgtgcatcaccgtgctgggcgccatcccggagtgcaggaacaccggcgacccgcgcgtcctcgccgagaacgccgtccgctccgccgccaccatcggcgcggcggcgggcacgttcgcgcgcgcggagctcgacatcgtgaaggacaccgacatgtggcagtgcctggacgagtgcgcgcaggacatcgaggaggccgtctcccacctcgacgacaccgagggcggcgtcgtcgacctcgacgccaagttcaaggacgtgcggctgttcatggacgtcgccgagagggacacgtggtcgtgcgaggagagctgccgggacgcgccggactccaccgtcaaggccaccctgctcgacaagaacgaggcgttcgagaagttcatgcgggtcaccggcgcgctcatcgagatggtcatcggaacggccggcgagccggcgccggagccgtcagctgatgaacactcggacgaactaataccggatgtccagttatgatcaattcataatgtactaatcgctcatgtgacttctcatctccatttttgatcgatcgtgttcaggtattttgattaggttaattaagggcccgttcaatttgacgtcattttcaaccataccattttttttaaagttgtcaaaaaaatgtctacgtttagtttgctactaaatttgataaatatataagaaatcctgccaaaatttggacaacattatcatcttgccaaaattttgatattgccaaaatttggtaagatttattttggctacaatctgaacaggcactaattaattaattagctcttctaattcgttgaatgttttgtttaaccatcaataaagtggttgattcgttcattagctaactaataaatcatcagattataatctttctttgtcatatatgcatctctctctctcccctctctaagcttactgagccagtgtgatcatgattttaaggtttaagattattgtaatctagattgttaagccagattactataagctgaattataataagcggacataaaataagctgttagctgtttgtatctctatattattagtcgtttgttagttgttagccacccaataattaaaaaaacatctttagagtggattattatattatagtaatctggtttatagattgtaataatctatcataataagctatatgtttgtttaagcttactcctaatagtttatattataataattctaaactgaatcattcttaattaaagggcattatggctcagttcaactcatatgttgactatagagtgctaatcagatattattttttaggtctaacttaaatatggctacggctgggaccttcttaattttctttcttttgtcaattaattgttatatataggagtagaaaaagaaaacttatctttgtgttcctttggggatactataaagtctttcacactgtgctgagctagaccggaacctcgttgcgccacatcggattttggtcgacgtgtcgcatgcgcccgcgaccaaactaggtgtctcgtgcccacaagaggggcgcaaaacttcgtcgaggcaaatccacgcgcggcgccgaaatcgtgaggcacccgcgctgtgagcagcgtttcttggccgcccgtgccctcgcgtcgattccgcccggcgaaaaccccgaatcaccctcgaaaaatcctctcctaccacagcaatttcctcctcccaccaccgattcttctcctcccacgccgtctgctcccgccacccccgctgctcccaccgtcaggaaaggcggacccgtccgccgctgcccgccgccggtgctcccgagtccgcatcgaccaccacatccgccgccctgccgctcccaccatcgagaaaggcagatccatccgccgccgcccaccgccggtgctcccgagtccgcatcgaccaccacatccgccgccgcggccaccacatctacctcgtacgccgaggggagaatgggccgccgcggcggaccgggaggtggagcggtgggcggcgacgaggccggtgatggtggttgacgcgacgggtggtggtgggctggtggccgacgcggcgggcggcggcgaggccggtggtggtggccgatgccgccacggcagccggagatgcctcccgccgacaagagccggcggccacgcgcgcaccggcgagctgccgccaagaacgagggagaggaggtggcagatgccgaggacgagcgtgccgaggagagagcgggccgtcgtgacggaccgggaggaggagcggtgggtggggcggagtggaaggaggcgagctcgcgatgggatggaggaaaacgggagcaagggtgggtgaaggaacgctcgcccgtgctagccggacccgggtcacgcttgttgtgggcttagttgccttgcacaatatctctatccaattaggccatgcaaaataggatcctttcactgtggaaatgagtgtctttgtgtgtgttttttttttttggctaagccacgaggtccggtgtttgtactgtgagtgccccaagagatactaagacttaggcactagtggacactagaccggccggctgaattctcccaccctttgcaagtttttccaaactcccatgattaaattctgcggaggaaggagatgtgcaggatgcagacaacgaaaggaaccaaagaagaagaaatcaggtaggacacggacaccaatgatggaagaggcagatacattggacgtgatggaacacgtgaatactacagcagcaattaacaaccaaatttgtcgaattattttcttgtatagatcaaatttcgaactaaaattatgtggaacggcgaacaccaccgggttgtatgttttttctttttctttttctttttttgcaaacaaaggtcaattatcttaatataataaaatattacaagttttccctgcaaaaaaaaaacaagtttgcaatcgtgtagtattaacaaattaacaaccaaatttgttaatattcacctcttggaatgagagagatacaagcaactacaagtcttgacttcttttttagctatttgtgtgaagattaagatctcactggatatggattgcaggggatgaatggtagactattctgattttacgataattattagggcataaacaaataaacaaaatattaataagttacaaataaatgtttaaatattactaagtggtataggaaattgcagagtataagaaatttttatatagtaaatttctagaaaatcagactatttatagcttaagaagcatgtccataagggcacccgcaatggttatctataggctctctataagagatctatgtcagcatattttcctatttggaagagattaaatgaagagagagagcaaagctatctactaacctgaagatagtctatagagaaaaacgaggcaatgcattagagagctatagatacccatatagacatactattaagatggtttacaattaatttagtctattgctgagatgtacatgttttataaatagcaccttactttaccattacaggtgctctaatactctagtactaagtggttgttgctgaaaataacgcatcaaaaggacatggagcccattggccctctaaggtctgcaatatcaagaacgacacaacacgcatttcagtcactttgaacacgattagctgacaaaaagaaaatcgcttacctcattttcaaaaactaggggtgtgtgatgttttgacatttcattattacgtttgagtatttgtcttattaaaaactattatttataactttcattataaaatatagttatttctagcataataccttgtcccataataaagctattttttcacctacctcgatcctcctctcaaccaatcacaaccattctctttcacctactttcttttttcaaccaatcacaccatttcttcaaccattctcatctactttaaaaatgcccgtgataacctaacaaatgtctacactttgagacagaggaagtattttgttatgatttattttatcattaaaggtattttgtgtgtaactaatatttttttatatttgtactaaatattttaacaagacaaatgatcactgttatgtaaaaaatcatgaacattatatatttaaaaatagagtgaataactctttttccaaatcaaagcgagtgttcagcgtcttttttttaacacattctacgtccttatttagtttgttcactactggacaaccaatcttttatcgtggtacccaaaacacaaatatctcggttagatttagaatcattactaaagatatttttaagtatcggtttgaaaaatccaagtcctaaaaacgtctttagttttggttggtgttaccaaccggtaataaaaatacatctttaccaaccgagactaaagacaatcgagactgaagatggagaatctttagttccggttggtgttacttaccgatattaaagatatctccaaggttagtttacaaataaagcatctccatccaagtcagatgtgtgtagtatgtgcgatggtaacatgcgtgagggctgaagtttaaatctcatatcccacatattatttttgatttagtatgtatctttagtactagttcttttaactggtactaaagatttcgatttttagtctcgctttactagctattcttagctgctacaaccgagaataaaggggattttaaactggtagtaaagatcatttctctagtggtggttatttgtcaaattaatatatatattactactataaaagataatattggtgatggaagtatggaactaccatcaatccaccacaattactcctgcacatttttacaaattagtccctaatttttttaatattaaacaagagtttaatatttgtttgaatcaaatgaacaacatatactaagggtgtgtttagttcacgccaaaaatagaagtttggttgaaattggaacgatgtgatggaaaagttagaagtttatgtgtgtgaaaagttttgatgtgatggaaaagttaaaagtttgaagaaaaagtttggaactaaacaaaacctaaataagtatggacattataaccgtagcaaaacatgtgctttttgctagtcgtacgaagaaaaatggaggtacaaacatgtgcaaaactgagccccacggaaacactgctagggaaactaagtcccacgcgcatttatattgggcacttgttccgaacacacggcttgttcaacgacagttagggctgctttagttcccaactttttctttaatttaaatttttaatttttttatcacattaaaatttttttacacacaaatttctaacttttttgtcacaacgttctaattttaatcaaatttctaattttggcgtaaactaaacacacccttacttgttaagttaactatacctgcttggtttcgcataaatttggtcctttttcgcaaactgatttgagtatttgaccggatatagctaattgcgtatccggcaccgcaatcacgtgcagtgcagcggcggcgcagtcgagagtgtccatgcgacaaacacacgttgttttggccggacacggagtggatcaagtgcggtggtggtggtggaaagtttggttgttggtatacgtaatttatccatcaattatcaagcggcacggcactttcagtatcagacggggtcctctcctctcctctcctctcgtgggatttgaagaaattaaaatccatggattattcatgccatacgttttgcaagaaacatcgcagaaattccatcagttccccaacgcagtacatttttgcatgcacatgggcaaattaatgggcgttacatatcattaatgtagtagtaagtacgtttgttttttaatttatgacaccgacgtttcaccatttgtattatttaaaatatatataaaaatataagttaaaattatatactctttgatgataaaataaatcacagaaaaataaataatacttatataatttttttaataaaataaatggttaaacaactcgttaaaagttggcgttgcacgttaattagaaaaatcgagggagtatataagatggtggtggcagctaacctaacccaacacaacacataatatattaatgtaaactctcgatcagctggtaaactaacgaaccaacgttcgcggtttgtaagacgaatcgctgtagcatatccttccgggaaatcgacttgctgcgtacgttgttggagtgtgtgacatttttcttttcaggggaaaggactttattaaatcacacgagacatattacaatcattttcgatcaaaaccatgagatagaattggactcaaattaatcaaaacatttagaaagtaataaataaataaattgcagtaataatcatgtttgatattttaatatcttaatgacaattagaggagaaatagcgggcgggccatagagaagtacaatggtgaagtcgttgatggtttggtgggacttttacaaagtaaaaaaaataaacccaacgataattatgtttcattctcaatggcagtaaaagaggagacaaacatatggatcgtagaggagtacagtaacgatgtttgacaggtgttctgaaaatcgtaaaaacgaaacccaataagacgatgaactctaaaaatgcaagatttagtgtttaaatgtcccaagtaggatgaatagaagccgtggtagattaagcaaatacgagtaacacaactggtagtgtgataaaggagtaactggtaaaaactatacgattagaaacacgggatgataatgttcggcctttcaaagatgacaacaagatacaagctatttaacaaattttaaataaaagtcatatataaaaagcagataaatttgtacatatgctagtcacgcaatttgagcgggtacccagctagttaccttaaaaaaagaaaataaaattgatcaaacaaatcctcaggttaaggattacgctcgaagtgtaggtaggctgtgtttagtttctgaaaaaagttggaagtttgtggaaagttggaagtttgaaaaaaaagttataagtttatatgtgtaggaaagttttggatatgatgtgatggaaagttggaagttgaagatagttggaggtgaagtaaacacgaccttaccaaggttatatttggctgctagctagtgctgcttctggcagcgagccgtcaactgtattgggtcaacgaaacggtggttggaccggccggtcaaacatgcgtgcatgattactgcattgatccgaccaatcaattcgaagcatacacacataccagagttcaactcgccgctcgcgcactatataaagcgtcccctcactcccagctcatgctcattcccaccacaagctaattaaggtaccagcaactccatcacatccttaatttgcagcagcaggtaattgtacaccggcgaaggaaattaaaggaaagtaggagatcgatggccaagccaagcgccgccgcctggtccaccggcctcttggactgcttcgacgactgcggcctatgtacgtcctcgtcctcgccgccggccgccgtgccatggctagatcatatgcaaatcctccgtagtactactaatgcagtagccgtagctgacacgtgggttcggatccccacgttaatgtctactactacatcagcagtagtgcagataatctctactgtgctagatcatatcatgaacactgattcgttagttctgatctgtaactaacttattagttcacattgatctgcaggctgcatgacgtgctggtgcccgtgcatcacgttcgggcgggtggcggagatggtggacagggggtcgacgtcgtgcggcaccagcggcgcgctgtacgcgctgctggcgacggtcaccggctgccagttcgtctactcctgcgtctaccggggcaagatgcgcgcccagtacggcctcggcgacgacgccgcctgcgccgactgctgcgtccacttctggtgcaacaagtgcgcgctgtgccaggagtaccgcgagctcgtcgcccgcggctacgaccccaagctcggatgggacctcaacgtccagcgcggcgccgccgccgccgcagcgcccgccgtgcagcacatgggccgttaaatggattagctagctatagcgtcacctcgtatctatcatatcatcgatcgatcgtactttgggcgtgtgaagtggtgtccagttaaaaaaaagttttttttttgggagctagttatagtatccagttttttaaaagaaatttataagtggtatattaattatatgcgtttttttacttgatactatctactatgcctctatatactcctgtaattaagtttgtgtaagtatggtgacgcatggtcaggttttgtttgtaattctctgcacttaatcaattgtttgttgtatttattaatttgctgcaaattagctgccggccccgtgtttggaaagactcctctcatttcaaattacttgttgctctattaaatcttgcacaaactaataagatttgacatattatttttccaaagcacatgatccaatataatgcactaaatttgtaggtgtttgatccaatataatgcactaaatttgtaggtgtttgatccaatataatgcactaaatttgtaggtgttatgactgtactaatttgtaggttgctctttacactaaattattgtaacggataattttcataacactaaatagaggtaaaatgatctttttataacacttaacggatagttgctaacggaaacctaatgatgatgatatttctgaaacaaagacgcttataccatgataattattttcaataaggtagggttatcgataacatttcttatgttttctcatattaattgtaacctgtgtccatcctccttgttgaccgacaacatgcagatcaagctagctaatcttgtgtttcgttggcagcatgtggttatgatggtgatgggtcaacgagattgtgtatacttcgtacttaaataattggccaaacaaagcgtcgttggctgtgaaacttatagtacgcagatttgtagggtaaaaaaaatgcactgttaggttcatttcgcatatatcacgagttctaataatttagaccattttcaaccaaatgattaggatgatatccataacattaaataagctaccaactaagatgaaaaatgatgtggcaagtgaataaatgagaaaagagaaggaaaccatatcttgcatgagatatggtttctacgcaacattcaagacatcatgtgagataaatagtattaaatttaagtataaaataatggtgtatgtattgaaagagtagtgtctagtactagagtttatgaaaactacgtctagctatatgttttgctgaaaattcggaaggaacgacacttcatctttttgacgatgtgtggtagacgacacaagcaattaaacaacgcgcatctaacctcattcagtaagatttaattagtacgcgtatagccgtatccacgcttatacaatagtgcattgtcaactactggtactatcaacgacctagaattttttaataatataaattaaactcggtctttacttcagtggccaagctagcctggaaatatatatcaacaacatttgtattactcgttctccacgacttcaaaattacgacctgcattactaaagatcccctaattattaacctcgccattgataatcttgtaaatctccaaattaagatgtgtgtgatgatggttaattaggttaatctgcatgatgtatatgccccaaatttattagccaccgtcggtttcgtttgatctgacggttgtaaacaccttatacctgtagtaaggaaaggctgggccagaccccatactgtactcacttccttcgcttctcctgcaaagcaaagttgggccttcgggccttctggttcggttggcgatgtcagccggcccacttaagggactcagcgtgccgctaaatgggccagcagatcggccaattgaaataagttcaaataaggtctcttaacttgtcaacgaatccgattttcattagaaaaatgaaacgagccgagccgagtttgttataagccaaacgagctacgagcttttcgtccacccctgaaggacactagatcgccgcctgaattctcccaccctttccaagtttttccaaactcccatgattaaattctgcagaggaaggagatgtgccggatcgagacaacgaacaagaaacaagaaatcaggttggcgtacgtacggcaccaattaatgatggatgaggcagatacattggacgtcatgcatgcatggaacacgtgaatatttacatatcaccaattcataaccaaatttaccaaaaaatattttctcgatgtgtttgatcaaattttgaactaaaattttatggaatgccaaacatcaccgtacgtgttgtatatttaccaggtttttttttcgcaaaacaaggttgattatacttaaatactgagtagccgcgggcatatattggtaagcttgcaaaatcaaaagacactcatttttcctttttgttttgttttgttttgcaagttttccatggattggggtttgagtatttgacgggcatatatatagccggtgtatatgcatgtatcatcactgacacggcacgccaatcacgtgcagcggcagcgcagttgacgcgacaacaacgcgtcgttgtttcggtcggacccggaccggaccggagtggatcaattcagttcggtggtggaaagtttggttggtgtacgtaaaggttatccatgatcatgaagatgcatgcactttcagatgggctcctctcctctcatgggatttgaatagatgtgcagaaacatcgaagaaatttcatcggttcccagtccatgcgtgcctagaggttgcatgcaaatgtgcaaatacacgatactggtcgtgtttagttctttggtcattttttttaagcatacgaatacacatttaaagtattaaatatagactaataacaaaataaattacatattccgactgtaaattatgagatgaatttattaaaattaattcatggtacaattagacaacatttaatgctccatgcatgtgtccaaacatttgatgtgatatttttggccaaaattttttttatctaaacacacccataattaagcactacatattatattctgtcctttcttttacgtatagcgccggatagtctaaatttgaacttaatcaacatcatataataaaatcagagggagtattagtataagatggtgggagctaacctaacccaataacccaacctaaataataacgtactatgctggtaaacgaaccaatgcctgctgtttgtaacacgaatcatgtcgctgtaggcctgtagcatatctcgatcgcctagcttgttgcgtacgttgtgcgagtgtgtgatactgacgcgttgtttcatatttcctactccctccatctaaaaaaatcaaatctaatgctagaatataacatatcctaatataacgaatctgtatatagagcatgtttcacataatattttagtactaggttaacgtttttttacggagggagtaggtcctaatatataataatctgaaatatatttaatatattttaagactacgaatctagacaaatatatgttaaaattcataatcataaaatgtatcaaattcggttctaggttactacggagtatatattaagacaggttagtacttcacttttccacacaacttgtgaccacagctatgatttgatattttcttcgaaaacgatatatctttaatttgattgacatttatacaaaaaattaatagaaaatcgtactatgcgtacatgagatatatcattttagctggaaaataaaaaagatattactggcctggattagaaaaaaaatacaagtgaactggcaatcgatcgagaaaatagtggcgatactcccggttggctaggtaattagcatcaacgccagagggattattactgtggctaagagcaagtataatattgagctataagtctactataagcttatgtgaaggagaaagataacaagaaatcaaaagtgttggctcttatatgcaagagctagcttaacacaagctccaagatagagatagagagaggagaagaaaattaaagccaaccttataactaatataatatatgttggctttaaaatagactaatagtagaaaatgagctctaattaaatcccaactggcacgcgcattgattagtctcatgtcgatcacggcatcacgctctaattaaaacgatttgatgccgtcgcaaaaaataacatacagtactatgctggtaaacgtgtatgaatacatcctcagattgaggattaatctgaagctaaacctggatataaacacagcctaaaccttttacccatgcctagaagactggcgtatataaacacagcctaaaccttttacccatgcctagaagactggcgttgtgaaacaataataccacaccactctagtgcgttgtggaacaataataccacactaatctgggcggtgttccaacgtaatttcacatgacattaaaactgtcatgccaactattggtgacgtgacaatgtaactattagtgacgtggcaatattttgtcacgtcagacggggtggcgtgataaaaaaaagggattttgaaattggtattaaaacagtttattttaaaaattaaaaaaataaaaagtttcaaaaaaataaaaaaaatctagctagtgctgcttctggccgccgtcaactgtattgggtcaacgaagaccgacggagcaaacatgattatagcatcgaccaatcaaattgaagcagacacgctttcttaccagatcaactcgccgttggcgcactacataaagcgtcctcccattcccagcactagcagcaactcgattgatcacatccttgcagcagcagcaggtaactgtgtacaccggcgaagaaggaggaggaggaggagatcaatggccaagccaagcgccgctccggtgaccggcgtccccgtcggctccgccgcctggtcctccggcctcttcgactgcttcgacgactgcggcctatgtacgttcccgttctcgccgccggccaccgtgccatggctagatcatatcatgaacactgattcattctgatctgtaattaattaactaactaattgacattaatctgcaggctgcatgacgtgctggtgcccgtgcatcacgttcgggagggtggcggagatcgtggacaggggctcgacgtcgtgcggcgccagcggcgcgctgtacgcgctgctggccatggtcaccggctgccagtgcatctactcctgcacctaccggggcaagatgcgcgcacagtacggcctcgccgacgccgcctgcggcgactgctgcgtccactgctggtgcgagtcctgcgcgctgtgccaggagtaccgggagctcgtcgcccgcggctacgaccccaagctcggctggcacctcaacgtcgagcgcggcgccgccgccgcgcccgccgtgcagcacatgggccgttaaatagcgtcatctctcctcgtacatcatcgatcgtacttggacgtgtgaagtggtgtccagttaaaaaaaaatgttttttttggagcgtacgatcgatcgatcttactagatccatctttttcaaaattaattatgagtttttttaacttgatatctatacctgtatgtactcctgtaagtttgtgtaagtatatggtatgcatggtcaggttttgtttgtaatttctctgcacttaatcggttgtttgttgtattaatctatatgtctattatattattaaaacagctttgaaaaaaggcaacacgttcgctgtggaggctagaaattcccacgttaatcgaagaaaaaggaaaatatatgtgtcgttggatcgtatttgtctagattttgatggtctagatcaagcagggaaatacgtgagtccaaacaaaaaaacatctagagagattgactaggaatcggacatgtatgtatttggactaatttgactaggagtcggacatgcatgtatttgcatgcatgcgtatggccatttgagcctgtaaatttgtaattagagtcatgcacgttcatccacgaaagaataagcaaatattatgttaattattaagcgctcaaaggtagattaaaatatattccaataggttatggtaggactaaattacaatgctataattttatctatagaaacagaagataagtgttgtacactaaatctaattatacatgcatgtataataaaatatttatgtgcttaaattgtacgctatatttgctctaaagaaattatcacgttaattaaacaaaataaagaaaataccaaccatggatagaattgtggtatacttgaatattaacggttaagatttaattaaaatttaaaaagttaaagagatgaaacggatacgagtgtgaaaccgtatagcaattgaaccaattgcacacactgaccttgcatccaaatcagaataggaaattaatttttgaagtgatataaacgcgaaagtttgttcatgttaataagagggaaaaggaaaaaaaggaccaaatatatttttatttagaaaaggttttataggaaatacaactatactactataatactaacagtatataaacagaatagaaatctaattttccctgtgattaagctaaatcgtaagtcggtagctgagtagtaatgtaatgacatgtaaaactagcacccgtgtctgtctcatgcaccatacccatgacaatatgatgcgtgcacacatgaaaaacaaacgacgataacgcatgcatgcgaggtgttggacgcatccatcttattgactaaacccaattagcacatcaatgagatgctagcagcttagcatgtcatattactctctaaacctacattaaacaaacagtgaggttagcacatcttagtatattaccatgggaagttcaattattggaattatgatttttttaatctttagagtaatctagaacatatgacgagattaattaattaacatgtctataaagaagtaaagtggtggcggttgatgggatatctaaaaactattaataaaacaccaaatgaaatcctaatgacgattaaaataaaggatgatagagaggtcgtgaagcaatcggtcaagacggttatcgggatttctagaaaaaaaaaacccaataataatcatatttgatttttaaaatctcaatgacaataaaaatgagaggcagcgggcgaatcgtacaggagtacaatggcagagctgccgatggttggtgggagttctagaaagtaaaaaaaaaatttcaatgatagttatgttcaatttttaaaatcccaatgataataaaaaatggtcggcagacgggtcatagagaaatatagtggcaacatttgatgagatttctaaaaaattaaaaaataaaaccaaacgagacaataaactctaaaaactataaggtccaatttttaaaggtctgaacttctaaaaagtacataaataaaccctaatgataatcatgtttgattttaaaatctcaatgataataaagaaggtaggcagcgggcgagtcgtagaggaatatagtgacaaagtcgttgacattttggcggaacttctagaaagtaaaaaaatgaacttaaacgataattatgttcaatttttaattaaaatatcaatgacaataaagagaagaggcagtggatggctgtagaggagtataatggcagtgtttgataggacttctataaattataaaaatgaacccaacgggataataaactctgaaaactataagatctaatttttaaaggttcgaataagaatgaatagaaattgtggtagatcgagcaagtaaataaacaaggatatgacagaagtaagtggtagcaactaatgtgatttttaaaaactataaaaattagaaacacgaggataataaggttttgtcttgcaaagtgatcttaagacaatgagataactatttaataaattttaagtaaaaccatattaaaaaatatataattttgtatggtgctagccgcgcaattgcgcgggccatctagctagtttgatgcaaattagttgtgccggccttgtgtttggaaagagtcccctcgttttaaattacttgttgctctgttaaatcttgcacaaactaagaagatttgacagattacatggttacccatattttactgccacgtagtcgtcacgtcagcgaaaccgtcattcaaaaccatccagggagtcaaattgcgctggttttaacagtttaggggtcaagatttctggtttacggttcagagtcacggattagattcgggtcacttttaacatagtcaaagtgaacttattccgatgagctaccttcttttcccgtgagtgtaattaaattgctaaacataattttttttaaaaaaattacgtatactccctccattataaagtatagaaagctagtactatattagacacaatatagtactacgagatagacaacctagtaatataaacttagtcaagcctcacaacgaaaaccagaaagttgctatttggagttgccaagaagaactcagcctaacggttcgtttggtagtgctctaactcctaaatttagtttcagaaattgggtctgtagtaaagttgtggggtaacctaaattcagctttacctctctagttcatttcctctcattttatcctgttcacctcaacgactaattttattgtgcttataactaattaatcaagtaagtcataggtcatggattttatttttgactggattgtggatttttctttcgcgaacgcgtaaaaagcttacatgtcaataaatggatctattggtatagcatcacgaaagactttagcgtggcaaatcttctcttacatgactttttggttacattacggacacttttcaagttatcaggtgtgatcctatcctgctcaattgtttcaagtttcaactcaaataagggagagagtgagtgggtgtgtaggagataaggtcgagagaagggagggaggggggtgtagtggctgggagacatatggtcgagaaaaaaaaatcatccctttggctggttctactatttactacaccatctgttttaaaattctactatttactacaccatctgttttaaaatataaaaatatttgaatgaatgagacatttcctattatccgatttattaaaaaacccggcatggataagacggcactgaggaacattttttaagtagtgagcagcagcagcagcaggtaactgtataccggcgaatttcctttaaaaaaaactgtataccggcgaaggagaggattggaggagatggccaagccaagcgccggtgcggtgaccggcgtccccatcggctccgccgcctggtccaccggcctctgcgactgcttcgacgactgtggcctatgtacgtacatctacgtcctcgccaccggccatggctagctactagtagcttgcatccatggtgatcgatcgatcgatcaacatgaactgattcattcaatctgtaataacaatctgtgcaatattgataggctgcacgacgtgctggtgcccgtgcatcacgttcgggagggtggcggagatcgtggacagggggtcgacgtcgttcggcaccggcggcgcgctctacgcgctgctgtgcgcgttcaccgggttccagtggatgtacctgcacctaccgcggcaagatgcgcgcccagcacggcctcggcgacgccgcctgcggcgactgctgcgtccactgctgctgcgagtcctgcgcgctgtgccaggagtaccgcgagctcgtcgcccgcggctacgaccccaagctcggatggcacctcaacgtcgagcgcggcgccgctgccgccgccgccgccgccgcggcaccggccgtgcagcacatgggccgttagaaaaagcttcacttcatgcactctccatcccaaaataagtttatttgtaggtttctatatctagcgtttaacaattcattttatttaatttttttatgattagtatttttattgttattagatgataaaatatgaatagtactttacgcgtgacttattttacttttttttttcaaataagacggacggtcaaatgttgaacataaaaactcacaaataagcttattttgagacggaggtagtgagtgtgaagagctgtccagataaattattatacttgatatatctagggactatgcctgtactcctgtaagtttgtaagtatggtgatgcatggtcaagttttgtttgtaattctctgcgcttaatcgattgtttgttgtattagtttgctgtaaattagttggcgtccggcccattggatatagtctttctgtttcaaattatttatcgttctattaaatcttacacaaaccaaaaaaaatgacagattatgtggtttccctaattaaatacatatcctttttttctaaaacatatgagcccatataataagagttgtgactacactaatttatatattgctctttacactaaattaatgctaacgaaaaaacaataattttattgagcattcaacaatatataacaataaaataatcttttatagcactaacggaagactactaacaaaaatctaacaatgatgatatttctgatataaagatgcttgtatcataacattttcataaagttaggttcgtcaatgatatcttagaatagagcgtttgttgattacatttcttgggttttctcgtattaatttgtaagctttgtctatcctccttcattgactgacacttgcagatcaagccggatatcatgcatgtttgtgtttcgttggcagatatcatgttgtgtttcgttggcaggagtggcacacatgttttctgatggtgatagtcaacggagctagtgtatatactccgtacttcaataattggaactttggaagcgtcgtcggctctgaaacttatattacgcagtcttttagggtgagaacaaagatgcattgttaggttcatttcgcatcacgagttctaattaataattcatgaagctgtatatattgctgaaaattcggaaggaaacacttcatttttttgacgatgtgtggtagacgacacaagcaattaaacaacacgcatctaatctagttcagtaagatttagtacgcgtatagccttatccaggcttatacaatagtgcattgtcaactcctggtactaccaacgacttagaattttttaaatattatatattaaatccgacctatgcttcaaattaacggcctaactactagcttgggaatatcaagaacatttgtatatatattactcgttcgctacacgacttcaaaattaattacgatctgcattgctaaagaccccttaattaatctcgcatcgctaatcttgtaaatctccaaattaatgtgtgtatggtgatggtcaagttaatctgcatgatatatatgccccaaaattattagccgccgtcggtttcgtttgatctgacggttgtaaacacctgcaaatcaaatttgggccttctagttcgcttggcgatgacgtccggcccatttaagggactcagcgtgtcgctaaatgggctaattgggctgatcggccaatttgcgaatgcactaaggccctgttggatcaagctcatcggatcaactacctcctttttccgtgagtccaatttctaaattactaatccttttttctaaaaaaaaagaagcatactccctctattataaaatgtagattagtacaatattagacacaacatagtactaccagatagataacctactaatataaatctagtgaagcctagatcggtacaaaaaaccgatatagaatttcctctgatcctctcccttatcccacttctattcgacggctaattattgtgctcagccttaattaattaatcgagcgagtcataagcagtggagctatataccaatggtatcacgaaagactttggcatggcatggcatgccttctcttgcatgcatgaattttggggccctctcggaagtctcgtttgaacacataatgcaagttagaatagcctaccaggcttgaatcgtgatcatttccagttcggtggtttcaagttcgaagcacacagtttgctcaacaaaaagcccccttttttctggatttatttatttaacctgtgtatcagtatagtagcagcagcacattatacatatgtgaatgtgatgggctgattgggctcaatgtttgcgagatctcgatcaagatcgatctcgtgggggttgaagactaaatcaacggttcgtttcgtaagcaacagcacagaaatgtcgcgagttcgtagtaaattaacatgggtgcttagctgtgttgttcgcttgcattgcataccagatcaactcgccgctcgcgcgctatataaagcgtcctcccactcccggctcatgctcattctcagcacaagcagtagctagctagcaactctgatcacatcgccggggaagaaaagtaggaggagatcgatggccaagccaagcgccgctccggtgaccggcgtccccgtcggctccgccgcctggtccaccggcctctgcgactgcttcgacgactgcggcctatgtacgttctcgctcttttttataagcttcagctctttattttgctttttctcccttcttctgacataagttggtctggctgattccattgtggtatattgatatgtaatcattttacgtgttcacgaaaaaaacgttctcgctctcgccgccggccaccgtgccatggctagatcatatcatgaacatgatctgtaatttactaattaattcacattaatctgcaggctgcttgacgtgctggtgcccgtgcatcacgttcgggagggtggcggagatggtggacaggggctcgacgtcgtgcggcaccggcggcgcgctgtacgggctgctgtgcgcgttcaccgggtgccagtggatctactcctgcacctaccggggcaagatgcgcactcagtacgggctcgccgaagccggctgcgccgactgctgcgtccacttctgctgcgagccatgcgcgctgtgccaggagtaccgcgagctcgtcgcccgcggctacgaccccaagctcggctggcacctcaacgccgaccgcgccgccgccgccggcgccgctcccgccgtgcagtacatgggccgctaaatagcgtacttggactgtgaaataagagttgttcagttaaacaaaagtgatttgttccggtcaaaaaaaatctcaagatattggtatctcacagtatcaaatcgtttctgattgttgaatttagctggacaggacgatgagcattgttagattcatcgatcggaaactatttgataccgtgaggtatcagtaccatgtgatactttttatttggaccggaacaaatctctaaacgaaaagtatccggaacaaatttcttttagagtatccagttaaaaattttaattacccgtggtaaattacgtgtgttttatttgatatctacgactatagtcatgggattaagtttgtaaatgcgtgtttggtgatgcgtggtctcagcttttgtttgtaattttctccagtttaatggatttctgattgtactctccaaattagccggcctgccccttgtttcggggcaaaataataaatgaataatttcgttgaaaattaagcttctctggttcaaagtcaaaagtataggtgcatttatatttatgagtgtgattattcgtcaacgagagtactatacgtatcctacggtctacggcgccgaagtatgaaaatgtttaggtgtacaagctagtggacacacgcaatattcaagtataattaattcaactgtctatttcgaacttttgtaattcttttttaaaaaaacacagtgcaaatgtaacgcccatataatgactgggccaatatatcctaaaattcaaaaagtcattccaaacccctctatcatatacccattagtcgtcgtattatgagattcaagaagtcactgcagacgtatcctgtcatcgatgagtatgtcgtctatcactgaaacaataattaaccgtaaatgtaaatactcaggacaagttgacttgaacttgtgtgggtatattcctccaacagaaacctaaccagttgagttacactcgtatcaagagtggtaagaatattctagtggtaaaaactacccaatgtttactttttaatttttgcgggaaagggtggatattacaatcgtttcagtacaagacagagattctacactcgtactgcctaaatttgctaactcaagagtagctttagtacacatagaatcgcatattaattagaaactaaaaattcagccttttcaaattcttagtttacggagtcaagcacagggtttgctaaaatactaattctgccttctaactttccatttcaattcctaacccctttgcaacaaacagacgcaatatgtatagcatatgacaatatgaacacgtattacggttgaatgtgtgtactctagccacatgctgtgtttgtatatcctccttattgactgataacacgcagttcaagccggatatcatgttgtgtttcgttggcacacatgttacaaacttacaatggtgatggtcaacacggagctagttcatactccgtatatacttcaataattggaactgttggccctgaagtttatatatatttttgggagaatagccactatgatccctgaagtttcgctccgagatcgttttagtccctgacctttcaaattgtccaagcaagccattaaactttatcatgtggacatatatagtcattggcccatcgaaaattgtcacgtgaacatgccatgtcatcttccaatgcaaatatatgatgaaatacccaatttgcccttgcacatatcgtcatagggaaaaaagagaaagaaaacgagaaaaatacaaaatataagtaggtgatcttgcatattaaatatccgttagagttttaacattaaaatgcaactacttacatgaaatttatttggcatggtaattatatatttagtggttatagctaatttaattttgtattagcataatccagtgaaaaaagtttgccatatatccatagtcacattgaacaaagtttgtaaactcatttcattgtttttctatggtatatagaagggcaaattggacatttcaccacatattatgcatgagagcataacatggtatgctaacgtggcgatttaagttggcccaaggactatattagcccacttgacaaattataaggactcgtttggacaatataaaaagttagggaccaaattgatccccgagcaaaactttaaggatgatgttggctattctccctatattttactacatatataaccccgttttatagggtgaaaattatatgcattattgttaattcattaggttcatttcgcatccatcacgagttctataatttatgaagctgcatatgtattgctgaaaattcggagggaatacttcatatatcttctgacaatgtagaatgtttggtagatgacacaggcaaatagacaaatgcccaactgaattaatctcgttaggtaagatttagtgcgcgtatacacacattatacaagcagtgcgatgccaactactgatactatcaacgacgacgacttatcaacaatcgtttgtaatatatactcgttctgcacgactgccaaattacgacctgagttgctaatgatccctaattaacctcgcattgctaatcttgtaaacctgcaaattaatgtgtgtatgatgatggtcatgttaatttgtccgatgtatatgcccccaacaaattattaattagccgacggccagcccaatgttaattttggattaaaattatgaagctatatactcaaatcttagtaaaacataatcaaatcgtagtactgtccgttcaaaaaaaaatcgtagtactgtgtatcgtagacattctttaacagtacacagcttttgagtcggttttcgtttaacagtacacagattttgagtcggtttcgttttgatctgacggctgtaaacaccagccataccccatactgcacgtctgcacccactcacccttagaattttttttatttttaattttttttattaaaagttttacaaaaataattttttattttgaaaattgacagaagtggtcgcctaccgccctctgggagggcgatttttaaaaatcgccatcccagagggcggtgaaagtgacgtggcagacggccgttcgctctcgggcgacggccgtcaacgaaatttgcaggcggcccccttgccgccctctgctagggcgattttgtactgtgcggggggccgcctgcaaatgggcggcggggggcctggaattttgcaggcggcccccttgccgccctgggggagggcgaatttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggcaccttctaggtcggtcagaatgcattgcattcccgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatgattagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcttaggggatttacgtgccattctaaagcctcagcagcaattcgacgttcatgctcatccttccaccttaggtagtccgatcttgtttcactacgtgggtaagcacgggttccgtcgttttgtgggttctccatgtctacccactcgatgaagttgcacattggacgatatgtctgcgtaagatgttacaattatgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcattttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacatcatctcaataatcttttgtttggctctctaggcctttgcatagcttatggtgtacttgaatttgttctcgatgtgcctaataattgattttggtttaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgttgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgggcctgatgaaaacaataactgcgtaacctcgcatttctgtactacaccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaatataacatattagtacaaatgcaaaagatgtatgggagcaaacctgtgatgaagtgagcgaagcagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgc

SEQ ID NO: 58307 - DNA, 8541 bp, Oryza sativa
catgcaagcttccatgcatgtttgtggagtgatgtatcatgtattaatctattttttaatttttttcataactatttagatgacatataagaaacaagaggacatcctcttaagggattaaaatagtatgccccttttttcaccaccttttgttttaatttcaatatataaggtgagtacttttgtactataaagagcagtaagtacatttacttttcaattccatataacatttgcttttcaatttcatatgctaattgtctagctagtgtgtatatataactacatggagaaatatatagggagtggaatcaagaggggaccaatgcacaacactctagctagatagtataagtcgccatctttgatatatctttcttattcgtacaagtggccagcataggaggtagagagctgttacgttggtgtgaccctgatttaatctgatcaatctatctccactgagtgcacgcatgcatcattaatctcactaagattaattaggagacgtaatatgcgaatgaattaacaaacgtacggtcggcagaggccgaagatgtaacccattttcgtaaccattgaaagaaaataatgttagagaacaacatgcctagctaacttaaatgtgcaatctagctacgtacgcactaggcaagatcggttaaacaaagagggagcaaattgacaagtgcacaaagccaaattaactttattaaaagttcaaaactgattgcaagtttggagcaatgaggtaatccggcatgcgtacttgagtcactagctcattcgctagtgctagctttgttgctatcaacttcattcaaacagagaccagctggcaacagggatacagtacatatatacatgcattctgctgttcatttgccttattaccatgcaccaatataatgcatcctcctctctagcttatcataagtactaattaactaattatcccagagcatggcaccaatataattgatccacttgagaccaagcatagtgtacacttgaacacatgcatgcattggcatgcacatagtacggcttgatcacaaacttaatcatcatactagcttccttggattaatatgatcatatcacatcccttgtaatttgcatgaattcttgcatgctcgatcattctgccttcttctgatcgttgtagatagtagctagccggattatattaattaattaatttaatgaatactagatgttgatcttgccgatgagagggatgccgatggcggtgacgacgagggtggatgggagtccgaagatgacgtggttccagaaggtgaggtcgtaggcgttgcgcgtcgcccgcctcgcctgctcgcacacgatcaggttcgccgccgaccccagcagcgacaggttccccgccaccgtgctcacccacgccagcagcagccacgaccgcgtcaccgccgccggtgatatcgtcgccgccgccgccgccacctcatcccccatcaacaacactacacccacatatataaattaatttacaattaccactcaaataacatgtaaaaaatgagttgttcttttttaattatgagagacaaaaaaaatttttttcttttaataatcattcatcttattaaaaaatataattacatttattttattttgacttgatttattgtctgatttaatctttttatatttacaaaagaaattgaataagatccattcatcgataaaaaaaagtcagatatcatgtattaaaagaaactgatgtactgtacagtacaaatgttagtgctgggtgagtcgggacacattgggtactagcaatagcatggtgcgagaaaggttgtgagtaagtacgtaccggtggggacgttggaggcgaggttggagaggaggaggatgatgacggagaggacggtgacgccggtgacgtggttgatctttgagtagggcgccatcacgttccagatggccccgggtagccccgtcttgttgaacccgctcaccgtcacgaacatccccgagaagaacaccagcagcgagtacgacacctgcatcatccattcacatccacgcacacgtggcacccagttcacatattgcttcttgtccgcatggccgccacgtgtacttgctcgtgtggcctagagttatagtgatttggacggatatgggttaccttgtcgaggcatggctcggcgtcgcggaagtcgacgacgacgagggcgatggcggtcgtgatggcggtccacgacatgttgaggccgagcatgtaggcgacgagcatgccgacggtgaccacgtacgcgaagctcttgaggaacagcttccgccggtgctccgagcactgcatgaaccaccggtgcttcgtcgagatgttctccgacatcatcgactcggcgtcgccgccgtcgtcgtcctccggcgatgcgggggtggcggcgtcgccgtcgtctttcttgttgttgttgagcgccgtgcggcggccctcctcgatggcctccatctgcttgccggcggcgacctcgtcggggctgcaggcgccgccgtcgagctccttccagtacatgcagagcagcatgagcatgttgatccccatgccggcgagcatggcggggaggatgccgaggaggaaggaaataaaggagatcttgctgttgaaggcgatgaccaggttctgcgggttgccgatgggcgtcgcgctggagccgatgttggcgctggtggcgagcgcgagcaggaacggcttcgccgggaggttgcgctcggcggcgagctcgagcacgaactcggtgaggacgacgcagcaggtgtcgttggtgaagagcgcgctggcgagcgcggtgacgacgcagacgcggcacatgaggtcgcgcccgccctggctccgccacgccagcagccggcccaggtgcctgaacatgccggcgttcttgaggtagccgccgacgaccatggtggcgaagaggaggcccaggatggggaggtcgatggaggcgtaggcgtcgtcggcgctgatcacgtggaacacgatcatcagcaccgcgcccagcagcgcccccgccgtccgcccgatcggcaggaacggcaccgacgggaacaccgccagcatccagaacacaccgaacgccaccgaccccatcaccaccttcggcagcgacgccagcgccatggccgcctctctctctcactacaatgcagctagcgtcttggagtgggaggtggtggtggcgatgagagtgaggaagagaggcgactccccgtgggcttaagtactcccagccaggacgaacagctggcatcagttgcagctgatgtcagtgtccagctaggtaggcagatgattacgatccagaggcaagggcacgtacatctaagcacttaatttacatgccattcttttgctaattttttcctttttatcttccagatggtaatcttgtaactttttctactatatctatataaacttctactccctccataaaaaaaaggcaaaccctaagttttcgtgtccaattttaactgtccgtcttatatgaaatttttttataattcgtatttttattgttgttagatgataaaacatgattaatattttatgcgtgacttatctttttaatttttttcataatttttttaaataagacggacggttaaatgttagacacgaaaaccaacgtttgtcttttttggtacgaagggagtagattgtaatcttataatttttttctgctatatctatataaacttcgcctgtatggtgcgagtagttagttttttacctaattgttataatgatgacattaattagtgataatgttaattattatctaatactgtattaagtaaactacaaaacaacataatagtatgctgtttgactactactgctactccatactccttttaaaggaaatcgtcttgggaataagggagtacattcatgtgcagcagcaattccgtaacatttatgtgatactactagctactattccgtactacacatctacacagatgcatgtgtaacacatcatctatgtagggtggacacgtgtacgtgcaggattcatccttagccacgactggagctaagcatcgatatgggtccatgggtcaacgtgtcagtgtcatcaaatgttcctgtccggttcgtgtctgcgaagagaatgtactgtacgaaaaatggcggagcacatgcacgcagtgatctctctcttacccgttgcgagtgctaatttcaggttaagccttatctaaataataaacaatactgccgtataaattaattagttaaaagtattaaccaacttgctaagcaaattgtcctttattttactttatataggagagcatatcaacgtcgtcagacaagttttagagggatttatttacccgactatatgtatttaaataaggagaagaagataaatttatggcttaagaaaatacctcaagctatttgctccgttcattttaattataagtcgatttgactcttgtcaaagtcaaactataagtttgactaattttgtagacaaatataataatatttacaacaccaaattaagtttattaaatctataattaaatatattttcataatatatttgtcttaagataaaatataactattttttttataaatttggtcaaatttaaaacagcttaactttgactaaagtcaaaacgacttctaatctgaaacggatggggtagtaaccaaggtttacataaaaaaatatacctcctaatactttcttaaatatgataaaattaaagtagaatgcatggagaaaaaagccgttgctagcttaagcgtgcaccgccatgaggccattaggatgaacaagtgatgatcatctgatcaaaaggtggcaaatgcttattacattttaattactagggatatgtcataaagcatgattaattagctagctagcttcctgttcgattaaacatgaaagccatacacctatatgctttcgtagcggcgacctggttggatcgatggatctagccttcacgactagaaaaagcattttcgccgatgttgggtattaattttcacaagtggatatgatccttagaatcaaatagccacctacaaaaatataaattagggtgaagttcactgtctattttcgcaaacggaccacttaagccgtgcctgcaaaaatgattttcgcaggcggaccacatgagatgtgcctgtgaaaattagcgtggtatatatacagtgacacatcggctgatatttttctaagtgtcatttctcccctcactcacctctcctctcccctccccttcacctccccgaccgccggcggaaggggcagacgtgcacgggacggccagcggctggcggcggctcccctcccccctccctcccagatctagccagaggagggacgggggaggccggcgggggcaacggcggcgactacggcacggggcggcggcggcgacgacggcgcagggcggtggcggctcccctctccccctccctcctagatctagccagaggagggaggggggaggctagcgggggcagcgacggtgactacggcgcgaggcagcggcggtgacgacgacgacggcgcggggcagcggcgacggcgacgcccggcgcggctcccctcccctcccctcccagatccggtcgggggagggcggcggcggcggcaaggcgcggccgcgttttttttttttcgttcaatggattttcgtaggcgggccattatcccgactgcgaaaatcgttggactgcagacggtccaacccccgcgtaaaaaaatcacttttggtcgcctgaaaaaaaatactttttctactattgcttatggccagatccggtgacctcgcgtagtaagcaagacggtaacggcgcgcgcaaaacaacgtcaggcttgttgccggtgccgaagatcatgaggcgcgacgttggatctaaggtctaagagcctcttattttcttttgttattcctcggttaagtctaagtgtttgctacaacctttagctgttttatatccacatatagatctagacgctggatttctatccatttctttttataaaatacacctgtgcgctgctgggacagcttcagaccatagctaccattccatgatcaacacgtatatataagagcaggataaattaggtcacagccctgtaaattaattaattaatctgctcattttgcagccctgtaaattaattaattaatttgctcattttgcaggatgctttgctttgtgataagtatattattatgtaaaaaataagttgtccaagagatcttgtggttacacgttcctttctcgcggccttttgacttaatgaaattaaatttctaagatcttctggtcgatcaccgtttcgttcgtgtatgcatagcttaagcaaaatttccacttcagttttacagtctgttagttcttgatggcaacttgcattgtcattgttaatttacactgctggaagaccagcaggtaagtgtgttggttcaaataaagtctggtggaaaatgaacttaaaactgtatattattcatatctattactccctctattttaaaatgtacgacgccgtttgatttttttataacgtttgatcaaaggtctgattaagaaaaaaattaatatcatttaacatgtttatattataaatttttaataagatgaatgatcaaatgttatagaaaaacaataacattttcaaaaggaggttagtactaataattaacttgatatatgtatatcagctatgtcttagatggtgccgcgagatcgtgagactcaccacggtctcgcggaccgagggtgcaaggccgcgacttcacatccgaactagtgcgattaatcattaatagattaattagcatcattagcaattaattaatttattgttatttctttaattagcattattagtaatcaattattcactaatcatgataacgaattacaatcattaatcatttccaaaggggtgtcactgtcatcgtttgaccctgttgaggtcttgttcggttacacaaggattcgttctgggtcagaaatgatatgtataacaagaaatttataataggtacaacaagagaccgagatttattccaggttaggaatcaatttaatcgtattaggtataacaaaacatccggattagttccacacttcttgactagtggattgattcccggtctcttattctccctatcatgaataaattggttcctggcctggaataaatcccagtctcttctcgttgtatctatcataaatttcttactatacttgtcattcctagcccagatcgaatccttgtgtaaccgaacaaggcctgagactgctcgaaccgcaacacgtcgtcgtttttcttaacggttcagtgatatcgggtcaattttacactcccatacagcgacggcagtatatttgtgaaaaaaaaatgtatcccggatatttctgagaaaaaataaacagtatatttttaaatttaattcttttcttggcgggtattactatgatcacaaccaatgtacgtgctattatagttgatagatatagattgatcgtagtggtttcgcgttgttacttgaggtaggcaccgctaatggatgtcaatttgctcttgaaaatctggatgctagtatcgatcaaatcttttcattgagctgatcatatatactgatccaatcatatctcggctaagaaatataatgcatgcttggtcatccctaaggttggagatattttatacaagtcggcacacatcaagctagtcacttcggaaatgaacacaaaggcttcgttccgaacatgagaattccatcatatacgatgagaggattataattgtagagcatgattcaaaaagacgctagacgctaattagacgactagctaggtgacacctaggccagaccaacaagttaaatttaagatattaagaaccatatcacatatataataacaactaaactatatatatagcacgaaaatagcaacgaaatatcaacaaaggcagtttagccgtctaatgcatcatctaatgcctaattgtgtggctacccgatgcctagctagcaccaacttttaaaacattgttgtagagagcttgtttcaagatctacaaaataatccatgatttttttatgggcacaaaccaccaaggatatagcatcaaagccatcaagtaatatattttgtcagccaaccgagtaatacccgccaagtctaaagagcaaggaaaattttattttcttgacggctaaccattatttatgcccaactcttatagatgtcatgtgtcgatctacgaaaaatggttaaacttgtgcaagcatgtataatagtccttgtcccataatatagttatctttatgtttttatattgggactaagaaagtgtttggaataaggagaactatgtaaaaaaataaatgagatgatcgtgatttatcgaaatgatcgagagagtatacaaagaagtaactgttgtattttgaaacgaaagaagtaggtgataactagccttccaatttccaacataa

SEQ ID NO: 58308 - DNA, 15500 bp, Oryza sativa
ccccccccccctctcctctcctctcctcctcacaaacataaacacaaacacatcaagagcaagaacaccaagagagagagaaatcaaactccaccacccaccacgacatcgagctcgcaagcaagaacaagattgcaagaagaagaagttgttgttggtcgaggcgaggaggaggaggaggaagaaggagtttgtgtgttggtgttatgaggtgttggattagatgagaggaatgccctttggtgggagcgcgcgagaggggcacgcggggacactgctgcaacaccacctcatacacggcgttggcctcgccgcggccggcaagctcgtctcctcctcctccgccgccgccgccgccgccggagcaggtgggttctgggagccaaggtcggtgctcgaccaccgccacagcccgagccccagcccgcctacctcggcttccacgctgtcgtcgcctctcgccgacgtggcggccctcgccggcgccaacgccaagaacgtctccgtctccccgccgccgccgggatggggaacgggaggaggaggtggtgggggggaggaggtggtggcggccaacgaggagtgggtgcaccagctcacgccgcttgatatggggctcggcgccggcgaagggtgggatgccgccgggaacgtgctgtccgacgcggcggcggcggcgacgtcggggatggcgccggacaacacgttcctccgctggatcattggcggcggcgaggacgcgtccgccgcgatggcaggggtcatggacccgccggtgctcgagctcgaccatggcggcggcggcggcggcgccgcgcccgccgcgttcgggccgttcgcgccgccgccggccatggaggacacgaagcccgtggtgccgttcgcggcggggcaccccccgccgaacttcctcctccaacaccaccaccaccacccgcagccgcacgcggcgttcttcggcgcccaccacccgtcgttcgacgcggcgccgccgccttccaagcggcaccacccgatggccgccgcgcctgcgccgaagctgcctccgttcccggcgggcgggttcgtccccgccctgaagccgaaggcggaggcggcgaacgacgaggccgccgctgcggtcgaacagctagccgaggcggcgaagctggccgaggccggcgacgccttcggcgcccgcgagatattggcgcggctcaattaccggctccccgccgcccccacggccgggacgccactgctccgctcagccttctacttcaaggaggctctgcgcctaacgctctcccccaccggcgacgccccagcgccatcggcgtcgacgccgtacgacgtggtcgtcaagctcggcgcctacaaggccttctcggaggtgtccccggtgctccagttcgcgcacctcacctgcgtccaggcggtgctcgacgagctcggcggcgccggatgcatccacgtgctggacttcgacatcggcatgggcgagcagtgggcgtcgctgatgcaggagctcgcgcagctccgcccggccgccgcgctcaaggtgaccgcattggtgtccccggcgtcgcaccacccgctcgagctgcagctcatccacgagaacctctccggcttcgccgccgagctcggcgtcttcttccacttcaccgtcttcaacatcgacaccctggaccccgccgagctcctcgccaacgccaccgcgggcgacgccgtggccgtgcacctccccgtcggccccgcccacgccgccgcgacgccggccgtgctccgcctcgtgaagcgcctcggcgccaaggtggtggtctccgtcgaccgcggctgcgaccgctccgacctccccttcgcggcgcacctcttccactccttccactccgccgtctacctcctcgagtccatcgacgccgtgggcacggacccggacaccgcgtccaagatcgagcggtacctcatccaccccgccatcgagcagtgcgtcgtggccagccaccgcgccgcctccgccatggacaaggcgccgccgccgccgtggcgcgcggcgttcgcggcggcggggttcgcgccggtgcaggcgacgacgttcgcggagtcgcaggcggagtcgctgctgagcaaggtgcacgtcagggggttccgcgtcgagaagcgcgccggctcgctctgcctctactggcagcgcggcgagctcgtgtccgtctcggcgtggaggtgctagaaagccctcgccgccgtcgccgtctccggcgagcggcgcagccgtggagccgacgtatcaaggagccgcggattttagttagggactaatgatcctgctacttcttcctctccaagtgaaagtcaagtgtttttttaccctttttgtgtaacttttttttactccttttttcttcttcttctttgtgttgctgtaatgatctcagctgagctgatcagtgagctgagtgtcctaagattgtcgtgtcaccttgcagcttggctctgcttctgcttctgcttgtgcagatgcagagtgccatgtcgcaatggtgttgtactggtacagtagctggcgcattctacttcaccatcatccatccatccatccccctgtgttactactcgattccccgtgaaaatcaatggctatggcatttgaaaatttgttcttccattttgatcaccagctttgacatgttttttgtgtcgtattctgaattcctgtttgtacaatttgtgcagccctcttatcaaagaaagagagagaaaacgatggaatgtacacctggttattgtattagttgtaaggactcctttgaaacataagaattttacgaaaaaatatgtagaaattatagttcagttcctacgattcttatacgaaaaaatatgtagaaattatagttcagttcctacgaaatcctcgcgaattcctctgtttataaaagagtgcaaaaggtattaaaaaacgaccgatttgtggccaattgacttacacttgatttagaaattccacgaggaatttcgcggaagtttcgtaaaatccattacattcccgtaaaaccgagagagaaaaaaatttcacgcaaaaatggaatacacgtttatgcttcactctccaagagtaataagacaactggaaaggtaactagatagatactagcaggcaggattagacaagaatttgcgtgtggttaggacgtaggagcacacgagaaacgttcaggttttccgaatagctctacaaggtggttttattcgaaaccacacttcttctatttatttgatattatgtttttctctaatattcgtgtctttttaagatatagcagcacacacagttgcaaacagcagcctccggaggtagcaatcgcgaggtagaactagaagaaacaaggattgggaataaagcggccatgggcgacccaagcaagcataaaggcgtcagacaatttcttttagctcctcttctacgagtgggattctgaactgcactcgcccagcaacaaacaagccccctatatttgacagacttggctaatcaaagctcaacactagattaggttagttgccttgcctccttagctgttaatcataattcatgctacatcatgggctcatggcttcttcagcaatgcatcttccatctactcataattctattataccctgtctgcctatgtagtgtagtagtagtagtagtatcgtttatctatcaatatgttttggtatctgtcacttcttgttctgcataatagtatatattgtccatacttcagagatgtgtacagtttgttactgtaatgtattggtactatactagtattaatacatttattggattactgaaaatgattaccaataagactatagatattaattaaatattttaataaataaacttaacaaatactagtttaggacaagagatctaaacaatactacatccgtcccaaattagtggtcgctttgacttttttttattataacgtttgactattcatcttatttgaaaaattagtgcaaatatataaaatgataagttatacttaaaatgcttttgataataaagcaagtcacaaacaaaataaataataatttcataatttttttaataagacgaatgattaaaagttacaaataaaaactcaaagcaataagtattttgggacggaggtattacagcgtaagaaattatgttttaagaaaacgtatcatttatctattaatatgttttggtatctgtcacttcttgttctgcatagtatactgtccatgcttcagacatgtgtactgtttatacagtaatactatggtaacaagcctatgtaaaaaaaaatacagagattagccatgcaggcaatgtgtactgttgccattgtctgggcctcatggtggcttccttgttactcaaacgacataattaaaagcatacttaaacattggctcctttactgttaatcaatgcagctgaagcacaccaccatcctgttactgttattgctttatgctcctgccttgcacctctaattctgtttgcactggaccacaggggagtgatgatttgtcaatccgaactcaactgtttggacacatgacagcctaactaattaagctctctaatctgctccttccaaactggaaggccacatttaatttagattattgaacatattattgtgaaggactatcaatttaattatgaggataaattaaacattttcagagacaaaattaacaataacatgaaacaaacaaaaaaaatctaagcaatgtaatagataaagtttttcctttcaaaaactcatattttccgaaacatggaaaaataatccggtgaaccaaggccgtgtttagtttccccctattcccaacttttcatcacatcatatcacatcaaaaactttcctacacacataaacttccaacttttttttcaaactcccaactttcttcaaacttctaaatttttttaggaactaaacacaccccaagctgaaaagaaccaaagggaagtaggaggatatgggggagagaaaaataaaatcctgtcagaatataatgtcagtctaaaagcttcagataagggcattgcatttggcaagcactgttgcacattgaagaacatatggtgatggggtgccaacgcgttttgtcttggttttttccccatctatcatgacagaattcttcactgcaacatgaaccgaatccttgcttgttctccagctgctgcctctgcctgtgctggagatgcaaaggaaggggggcaatcatggtgtaaagcgtccatgctttactgaaatggcggcaaagcatcttagggtaaggtgattagggtaccgaattcgtccacgttttgtgcaccctggttaacgatggggaataaaacatcctctccaattagcctgaggttgagaataatattgtaacttgtaagatatagatggcatcatcactgagcgagtgagactggaaatcacctcattgggtttacaagagggcaatgtatgctcaaacttatggatgcaagtccttgttataccatatatacattttttgtggttttgaggacttgctataccatatataaattccatcgatgacatttacatcaacaaaaacatttataacacgagtttaaacaagcaaatatcattgtcatttcaagtaaaatcactatgaacagtgttatttgttcgatttcgaaaattaaggatgaaaatgtggtctttttagtttagagtgaaaatatactttgagcaaattttaaagaacaaatgaaaactttctctatctcctagcatatctcattgtctacttgttggcctaaatttggacccaaagttatttttagttactttcttttacggcttaagttaatgttctttttcatctcctgttctattaagtgaaaaggtactcctgtgctgtttttcgttcaaaaaaaaagttctctttcatgctactcaccgaattactgaaacggattatttactgcacactttgaaaagtacattttcttataaatctgtcacctaaccattgtttacaccacttatttcaatcatacacaataatccatccaatgatctaaatcacactactctattaggacaaaggaaaaaaaaacaatagcaccacaagaagcataacagagtggaagtcaggcagaagatctgtccaaactccaaagcttgcaatgcatttgcagccaggattggagttcaccaagagagcatggggctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatccttattaccggtagtttcaaaatgcgaccataaccgcttggtaaagttgtgaacttgtcatgttcaaaataggctttgttcggcagcgattgctaaggcgcaagtccacgacaactaaatcaatatactcacccgtcttaaaatataaagattttagttggatgtgatatgtcctaattctacgaatttattaatgctttacgttcagattcataatactagaatatattatatccaatcaaaatcccttatattttagaacggatggagtaataaaagtactcctcagagctgtttgaagtctatttgtaattggatttcaaacatggctaatattgaaagtaaaattcaaatcgaaaaaaatgtttagtttcatctttttatctttcattattgaataatgaatggtaaccggggtttatgaacggagccgataggaagtggtaaacgtactccttccttctgtccaaattcataataattgaaacattatatcctgtattagatagttatattttaagatggacataatactttgtaaaacagtaacaagtcgcatttataaaccctgcttgccgctctactttttttttttaagtatacattgcttgctcatgctcggttgctaaggcatgtgctccataatttggcgtttgccatggctagatctggtttgatttcccctagtttgtttaacatccgaataaaaaacttaccagtctaaacaaatagcagtagtgttttgttttgtttaaaggctaaacaaatactttggttggcagaagtggccgatgcatgccatcgatgaactacgcataaacaaatctttctactactaacttagcttgtagccaccaacaagcagcctcagattacacaatacccacacatgccttcccccaaagtcccaaaccctaaggtacaggcacagccacaccgaactcccatgtgtagcgtgccaatgtgtcgacttgttgccaaacagctacacaagaatgcatgtggcttgcatcactcactcatggcatgttgcttcttggcctcgccgttttttgtcctctcctaatcctcactcaattaccttacctagttttagttactccatccgttccaaaatataaatatttttagctataaatctgaacaattgattcatagaaaaaaaatgttatattatgggacgggggagttactaccttacccccaactgctgcaacgatgaacagcaatcttttgtatcatgcaaaacaaaaccaaaatcctcaccgtgatacaatgaagtagtaggagctaaaatgctttgcctgcttccatcggttgagatggagcttttgcttgggatgagctcccagtttgagccacaccgtttgtcatctctcttctcgcaatgcaacgccagctcgtctcgtgaagatagggggacactgaacagaacttgactggacttcacttgtgatgtttcaggacaggcacatcaagaacagcagcagcaacattggatgggtacaccactttaacctgggactcagctccagaatggccatggcaccgcatgcacaaaccggataggttgagatgggctcactggagagtcactggagagccacagtgtgcagcaggagcagtagcaataggtcaggttaacatcatagccagcaacaaccagcctcactgttctcttgccaacactcttccagcttcccactgtaacaagaacaaccccaccgtgtgccgctgacgggtgggccagtgacggcgacggccggcgacgtacgagtgcccgtgacacacgggacggcgatggtgcaggccggccggcagtgtgcatccaatccaacaaaactatctgtcccggccatgctcacagtcccattctgggcacaaaccgcagcagggaccgcgtgcttgtcatcactcttaaaccggccgagcttgttgctgcactgcatgccttaacactgtttcctcttcatcgccactggcaggcaagtggccacactggagtacgggacactgcaggagcaaactggcaagagacctgcatagtagttacagagatggatgttaagcttgctgataaattcagaaaaaagtggtaccacagttcaaaacttcaaagtaagtgaggccaagatccagtctcagacacggtgcatctttcccaaggcgtatctgtactgccaaaatgtaccatttctgacgaggtatttcgtgaatcattattcctcagccatccaaattgctcgcaatacaaaaacaggctaaaatgtggtttgtgccggcgactcgcaaagcgcccagggacaagagttcgctttattcccccctccaacatctgcacattttagtcgtagcttggtttcacacctccaaccgttaaagtaccacgaatcaatcgcagaaagaaggtgcactgttggtttaattaagcaggacttgaaagttcaaaaccagggaggggaatcagaagccagtagacacaaaggcctccagatctcattcagacaggttcagatttcattgcggaagccaaataggaaatgcaagcatagtggccagtgagtagtagtagcacattgtgggctcgaagtaccccctcccttggaaagagctaaagatacgcaacttttaagagccaaaaggaaaagaaaaggcagtgagagatgaagcaaagagatggatgtgtcatggtgaagctgccttggagagtgggattcggtgccaactacaaggttgatgcatggggtcgcaccatgcattggccagcctttgtatcctcttttctctaaaatagagtttccgatgaggaaaagatagtatagggctgttaagccctcactgtagctagtaatagcctagcaatatccgtacgtgcaatgcctatgaattgagcttgcagaaaagaaaaggcagtaaaggagctaagcagtaaagaacgatagatttttatctacttttgatcaaaaggaaggaaagaatgaccagaatgatgcattttttttccctacggctgtttcctgggctctctacgatgaaaatcaacagctcgagtccctactcgctactccctaccacgtgaaatgatttcaggactgcaaagttgatcaatgagaattgctattacctctccactaaaataaacaacttaatgatttcaggactgtaaagttgatcaatgagaattgctattacctctccactaaaagaaacaacttaaagataaaagaggtaatagaaatctataatcaatattggggggggggggggggggttaatctgatacaacatatttgcaattcccctcgcccacctcctcctacagtttaaattcactaatgcaggcagttactatatttaagttttgtcgatgtggtgaaaacatggaaaatggttcatttgtcagaaagttcaagataggttttacagaacttcactaagacacataacttaagccaagctaagagtagcataacattgttagccaattgcctggctcctaaatggaagtcaagtcacagtattatacaagacatcacgaatcagttctttgatggtgatggaattgtgctcacaagcaatgtcattcatctgaagtaatagtcatggacagggcataaataatggcaacatggttcaatggttgtctggttgatattacaggtcaactacatatgctatatttatgctgaagaattgcatccactcaaagtcatgttcagaaatacacaagcaaagatatgccaaatagatgtccaaaaatcctagctcaagttggtgacaggattattgatccaccatgcaatagatgttttaaacagtcagttaccttggttatcttcattccaaaattcaatccaaactgtgcagataacttatgttttccccctgagccgacaagtattatatgtatgatctgcataaacactaactttatcacaagctgattaaacttgaatataccttagaaagctccgttgagggaaaacaggcagaaccttcactaatgtcacaaaaccaatgcagagaaacttgtatatgcaaaaaaggaactaggaaacaacatgacaaaatcatcaacgcagaagggaatcaaaggtattgctctcaaatccttcattgctaagagacttccgtgccagcaaagctcatgaagtaagcttttctccagaatataatgtccgtatcaaacatgcaaattttgtttctaatactaaatgcgcaacgccacttgcctatcactaaattgacaaatgaattgacattacaataatatccaataaaaaaaattctgcaaagcaggaatgtatcacaagaaattcgctaatgcgtcaataccgaaccacatgtctgccgtaaggcatctgatcaatgaaaaagaagatgaaagcagatgctctttcatcttcctgaagaaggttcttttgcgaaatataatttatagagaacctttgacacatactttccatgatggctaaagtatgataaatgtacctggaatgtttatcatgttgatgaaccggtcatgcagaatgaggctacatctagactgtgagtattggttatcccatagtttactgcaggatgacatgcatatccttcaggagtagatcatgaactttccagaccagatacaagtgtaaaaacagatgaatgacaaaaataatcatagtcattattttgtacccacgatagtaaatacatgtaacagtaaaggatatagtcaattgctacctgataaaaaatataagcaaatcgataaagctgttcaagagttgcagtgtagcataaacaataaagtaataaacaaggcaaaccaaaaattttaatcccattgaagtaaaatacatgaattatttaattctctctccctcacaacgaatgcatccaagcaagcagagacctgcataaactagtactatatattatagcgaactaaacagattacacttaaggtagcattgcaataagaaaaagtaggtgtaggtatgtacgtgtgcaactatatattgaaaaccttttgaaatatttgagctacaagatacagaaagagaaaatagcttatccttgtttacaattgcagaagagcaaaactaactaattcaatagcaacatatcgatttccctggaaattttaagtgtcttattacttgaaatagggtggtatgccatacaggctacttaataacacgaatactatatcatatttaagttcattgcataaagataatttaagtagtaaacatcggtaggtatgcatgacacacactgtgaaatatgtagctgctccagtaatgtaccatcaaatgcaaacagcttctgaccaaaacctgatgagaggacccttaagaatctcatcagcttgtttgtcaacacttatctccaggtgttcagagataacatatttgatctttttagggtttatcatgctctactaatgtatttgcctgggattataagcttggtctgttatctagaagttcatgttgtttagtcatctttggtttctacaaaacccttgcaaaaatttctttgtcgacttttattcttcatactatatatatttcaatagaactactgttctcctaaaaagtacaaacatgtagcaaaagctgatatttgacaaaactataaaacctgtgcggcttaagagtaacaatctgcatagatatacaaacaatgacataatcacaagggacaggtgctttttactttttgagtaagcccgatcactacagaatacaaccatcttcataggttaagtaatgctacagttaatctgataaagaagaaagagagaaaatccacattggacatggagatgatgaggtcacgagatctccaaagatttcaaaagcagacttatggggagaatatatatggccatatgggagtgcacgaaattacattcactttaaaaagggcccaggtatgacaacaagcttcctaaggtcagtgcaggactagacataaccaacaaacatcgctggagcttcagtatgtattcgatagaaagtgcagctaaaacatggatcagcatttaggttggcatcaatatctgcagaggccatgtaaaataaaaaacctactacattatgaaaataccgaccatgtaatcgattgtatcgaacttggaaagcgtgatatcatacattggtctaacatcagagaagtggacgattctgctaatttctaaaatagttcaaaacagtcagtactgaaaaactaaattccctaagatcacacatggcatgtcattcagctttacaataaatagatacatgcaatactattctaaggaaaaggttttgctgtatgatgctgtttgctgaaggtggttgtgcatttatcagtttggtgattaaagttcgctgtgctaacaaagcctcctacaatagtaagccaacactttcgaataaatcaatgcgtattcattttacacaacatagttccataattgcacttacctgaacatggcccaacaagtgtacagattggaaaagtgacttatcttgcttacaagttaaattcataggctctgaagttaaatcaataataagtacacaaggaacatggtatgctataatctaatacttttgttgcttatacagaagtgtgtaaagatcatcattaaacctactaaattgattgtaaactattagccctatttaaggtataaggtttacatggaacgaactgtaaaatgttacctatgaaacactgaggagagccaatcatccttctagcttgagagaggtttcggcttccctcgccttctacatcctactcttcctcgatatccctgatcgcgcaaccacatcctcacccatgaagctccatccattgttgtctgcaacaacctctatcgacccatccccttccctcaccagcggaatcgagaaatgcagcttctgttgcagtgcatcaacccaataaccaattcccaaaccctgtttttcttcagtctcctgcaccctcaccttggagaaatccctgagcattgtcctgcccctccaagccaccattttaacattacacaggtagcgccccctgatcggaatcgtccttcctcgccctagaatcttcataccaccacccttcttcccattggggatggacggcgcgagccgcgaggccacgctcgatccccattgacctcctcgtccccatcagcgggcgcctcgactcgagattggagctgcccaaacccctctcaccacaccggcgcactcatcggcgcatcctcgtagtcgtagatccacgcgaactcccggctctcgccgcggcgaagatgaggtcgtcgtcctggaccggcgccgccgatggatctcccgctcgcgaagaccagcagcgcctccgacatcgccgccggcgccaatccatccatctgatggagaaaaaaaaaaccaaaaatccaaaccaaaccgatcaaaattcaccttcgcaaatcgaacacggatgcctcgcacgaacgaaattgagatactgggtggcgaattcgatcggagactcgctacttttttgggtggtggattgggtttcgtcagccccgaaacgcgaatccgaaggaatcatcggaaaaattctggggtttttgttcgtagaatattcatatgcttgactggctcactgcctaaaatggaagaaaccaaactggctataggccgaattccaaacagaacatgaaagaaatttgggccttgaagcccaataaattgaggcccaataatacaagtacacctaattagcccagtagcctcggcctgacaaattgtccacagctctcaactagcccgtgatctcaaggcccataataaaaggataattcaaaattctggcatcctcatccacaaaaggaaaaagtacgccgaaggtccctcaacttgtcatcgagttacaaaatcgtcccccaaccacaaaaccagatatatcatatccctcaatttacaaaaccattcactttaggtccctaggtggttttcacccggttttatctgacgtggcagctgagtcagcgtgggacccatgtgacaggtgtccacgtcacctctctctctctcccccctcttctctccttcctctctcatttttcgctccgatgtggatggcggcagagtcttcgacgcgacggggaggagggccggcgtggccggcggctggcaggggaggagcgctgcggagagtagggccgatgcgacgggcgccgccaccgatggctgctgtcgtgcagatggccgcggcggtcgtccccctcaaccgtcggcctcgatgcggcccagcaatccgctcacgtccacgatcctctccgtgcacctccgcgccggggacgcgtcgttcgtggaggtcgtcgtcgcgcaagcgcggccgcgcgggtgttcgacttccggtcgccgctcgtcgacctcctcgccgtcttcgccgcgcgcttctgatactctgctgaggcgcggcgtacctgtgggtggtggcgatgagcgcagcggggtcggtccgtggtcgcgcgcgccgcccatccgcctcacgccgccaggtagctgatggcgaacccgccgccgccgaacgccatgccgtacgagtgcatcacgtcctactccacgctctccgacggcgccccgacgtagtacatctccgcgtggtcgtacttgttcagcacagccaccaggttgtccgggaagaacaccgtgtcgttgtcacctatcactcccagtgcatcgtatcacgtggcacaaccatcggaagagcaccccggaacggaatcatggcagcggcggcgacgacgaataagctccagacgatgcggtggagcgacctcgacgaggacgacgactacggtggcggcggcgacctcagcaccctgctcccaccgcgcgtggtcatcgggccggacgagaacgg

SEQ ID NO: 58309 - DNA, 30856 bp, Oryza sativa
  unsure (1)..(30856): unsure at all n locations
caactaaaaacaggtatattttaaaccaaacttacaagactaattgtcgagaaaaaacttacaagagtaatgccacgatatagagaaccatggtgtaaaaatggccatgccccttctccactgtaaatctcatatatacacacaggttgcccagtcctttccagttcaccttcatcacgctcgtttccttcaggctttagtctttctgattttcgggcatttttgtatacctcatcccatgataataaaggtctttccaccctttcatcaatctgtattgcaaaatataaatttgattctttttataacactagtaattagtattgttcaagaagaatatagagattatgtgaaaacaggaaaaggaaggggggaaaaactggcctcctcaatttccctcctctcaatgtcttcaaagatttcaacttcatttagatcattccagtcagataggctagggtagttatataaggaagtatcattgctatcagaataggtttggttactttcgtgagattcatcgacaagattatcaattatccttgtgaggagttggctgtcatcgtctgaagaactattttctagtgcggcttttgtctcgaaaagatcccataaccatgttctctcttgaagtttagaaacaggagatggtagtttagcgtaggaaggataatgcaacacactctcaagaagcataacatgagcagtaatacaatcataagctaacatgtttttggaaagcagcttcccctccagagcaacagaaaaggctctagctgaaagccttttttctcctaaaatttgtgcaaaagctgaaaccattgtgcttgggtcatcagcattaaaaaggaagccatgggtgccatcagtgatctgaaaacaatgatatattgttaaacatagaagaatcattcaaacattggcaaaacaaataacagctcatggactggatgaagagacatacatattttgttataacagttagatttggcacaatgatgggaatttcagaggccatggaccgcaatagcaaaggagggaaaacaggttcttgtcttgaagaaccatagagaacaatatcagcaaacactaacagattcctaatatcatgagtcagggagaaatgctttacggaaccaagaggaaatcccatatgagaagcaagttcctgcagaagaaattaagatggtcagtgaagccaaatggtgagggaaaaacatttactaccaaccagagacagcacatatttatggaaataaaatagagcacatattcatgacctaacaccagtcatcaaacctccctagtctaacatgctacgatacctagcagttcaaatgctgttgaatagaaattgttgttttctgaagaaaaacataaggaatctcaggtatgttctccagatggcaaatcacagtgacacaagggcttccccaatggatcttgatagaaagtttgaaactagcgaataattattacctggaaagcagagttataggcgtcagtgtcatttccgcagaaaaaaatgaattgcacacccaaatttttagtttttgccatgtccataatgtgtggggctgatgcacgcaaaactgttgcaaaatcccatggtaattcatcaaagaacaggtagctcccaacaaccaaaacaacaacatcatcttctttgctcccatactgattccttgcactttcttgagtatgtgatgagctgtatctttttgttgccaagatatcaactggtgaaccagaaataaccaagaagttcccagtatcaagggccgaatgtaacaactgaaataagatatttaagagtcagagaagcaaatgtttcttcttgatttaattattccagaatctaaaactgacagtcacacgtacaggaaggtagctatctggaaacacgacataagtgcatgcattaaaatgagttctccaatcttcaatatgattaggaatggactggtgcagttcgggatttctaaggaactgcccaagagcatcttcatgaataagccagaccacaggtagaaattggaaaggttcctgcataagactgaacacgatatgaatgtgcagcactgcagaccgaacaaatgatgtgataaagggaaaagaaacacttgggatggaaaactaggaacaatataataacacctgtcctttccatacaaattggatcttttgtcataaccgaatttatactattttgggaaaacttagttctgaaacgttatagctgctcaacactcaacagtcaaatagaaatgatgccaaaagaaagttccagttttataaaacaaacagcaatacaagatagaatgggaagaagaatacaagaccctacatgactatacagaagtaggtctaactgttctctagatttaatatttcaacttctgataacaaaaaaatcaactgaacggaatcaacagtccataaatgccgcattaaactaaattagctgatattttgtagaaccggtgtatgacagttactagcatttgcaaatggtgggttaatacttaacattggataagatcatatggtactggtagttaaaggggcaataaaagagtgggctgttgtccttctatatcctcctatgctatttttactaaatagcaaggcatgaagtagcagagaacacaactacgtaagtatccaagcagttgaagataggtaggttaaaattaacactcacattgaaacgaccattttcccttccagagagcttagaagcacagcattgtatctgtaaaatcaaatagaagtcaaaatcttaaaccaaatcaagtaaaagcaaaagcaaaatatcctattgtaagtttccagcacttactttgaccaatcaatgtacttcaagctcggagggctgacaacatttacatgacaaatattttccaaaatatcgttagctttcccatccgcaaatgctaaaacctgttccatagcaactgaatgaattactggaacaagaagtgttattgacacaagcatttccttttgtatggtgcttaacatataggagttggagtacgataatgaccgccaaacagtcacatgttaaaaatggcaacacaatttctagtacgctattcaatgaccattttagcaaagcaactcacctcaacctcgtaacccagattcttaagactttttgccaaagtagcaaccatcagggactgtgcatttatgttcatggttcccacaaactgaaataatacagagccaaagtcaactctccagcatgtagtttcagtattaaaaattcataagcacaagattaaaacgtgcatctgtctaggtaagcatgtctgttccttccgtttaataatgtgaccagtacagataaataatagtatcgtgcacgcaattaaactattccacatttcatccataatccaaccccgagttccagtggatcatttacaaagctagcatttctcacttggaaacaaaatgtgcaaacaaatgcagtgaaaccactatgcagcgagtgatccattagggtttatataagcgagcactcacgagtgccagcctcacgggcgcaaggccgggccaccaccgccgctcggatctcgcggcctcgagccggctctcgccgtggaactcccgcagcgccacgctcgaggccgagaaccgcatgaccccacctcccccgccgccgccgggccgcggcagaccctcgaccccctcctccgccttgccgccgtcgccgatggggagcagctgccacacgacgagcagggacgccgtgaagagcgcgacgaggagcgcgaagaacaggtggctcggcctgcacgacagccccggccgccgccgcctccgcgacgcagctcctcctccgcccgcggacgacgaggccgcccacccgccaccgcccgcggcggcggcggtggggaggtggtaggcggcgtccgagtgggacccgcgccgccacattggagcccccccacctcgccccccgcgaacggccgcgtcagtgtgcgctcctccgcctccgcgcggccgcgctcgacatggacgggagacggccgatcgggggcgcggcgagggtcgcgtacgggaatccggcggtggcggcggcggcgcgaggtaggagaggaggcggggtagggatcaggagcaaccgccgccgcggcgccgggggggagggaaggaggcaacgaatctgcgtgcgggccgcgtgggtgggggagaggagtgaggcagctgaagctagaataccggagctgaagcgggagccgtatatatccgtatcgaatactaccgtactgtatacggtggggggaatataatactggttgtatttcatacagggcagagctttttttttcaaagaaaaatacagcagactggttagtggagagatgccgactgaaataatgtcaaacagtgttatacagtgatttgatgggttggttgtgcatgtcgatgtggttgaaacttaatctcctgaaaacatactacctccgtcctataaaaaaacgaatctagaaccggatataatatattctaatacgataaatcatacgtatatctaaattcgcaatactagaatgtgtcacatctgatactacgttgatttttatgggacgaatggagtattagatataaagtacaataaatctagatagaatgttagtcaagattcgttatactatgaaatgtcttatccagtattagattattgtattatgagcggagggtggatgaaaattttgtactagtacacaaaaatctataatttttaaccaatcagaggctttcgaagaaatctaaacattttgaatctaacactaatgtggctaaaagaacttttcctttgaactaaaaacgtacaagtgcaaaataatattagtatttgttttattttttggacaaatggaaggactgtatatgaacttatagtacaaaatgattggataatattgcgcatgatggtggcatgtgtaattgtttttttgcatacgtgatatgtgttatgctttgtattaccaggtacttcctccgtttcacaatgtaagtcattttagcattttccacattcatattaatgttaataaatctagatatattgtgaaacggagggagtacttctttggttagtactattttgtattgacatcttgcaaatgccataatcggtattgccatttacactcgagattcatagagctttaggttggaataaaacaaagtataatcagaaactcacaatccgacaatattagctcaaaagtactattgcatatcacagacacaccatcagtccatcgccgtttacaaaggccaaacaacacactaacaaccaacggaattatttctgcgcgttctcaaaaccattggatatcatataacggaaaaaacttaatttataggcctgctactgaaaagatcaaaagacggtcgatcagtaggtggcaccgtccttaacgtcacactgggacagggtgaagtagaaggggccggcggagtaggtgacccttccggggtagacatgggaggggcggcacggccgctcgccagtcttaccgccattgaagttggtgaagacggcgcaaccgtggtccccggaggaggcgaggcggacgaggcatgctgatgggtggaggtgggcgctgccgacagtgtatggcacctcaatattgaacatacccttgtcatccgtcttgtctgtcccgtggtacaccgtccttcccgtctccttgtctaggcaggtgatgcccaccatgctccctgcagcgcacatcatctataattatcatcgattgcctatggttgataagtcgcgaaaaaattaaacgaaacaataaggggtggagataggagtaagacaattagaaatatgttagctagtcctgcgtctaagtatccattgaaaactacacctcaaaacatataagataaaggtaaaattatgttgcgctagccgagttctagactcgagaaatttttgatttcatccttagaaagaaataagcacttcacaagtaaaacttttatatttaccagtgttttaaatagcggcttaagacatttagcggttagccttgtcaaacagctatagcgggctaaatagagctatagcggctaaattgtacgtgagagcaaatagctagaacccttcgcaaataactatagctgaagatagcggcagttatagcgggatatttaaaaccttgatatttatacttaaagagccaatgtttaaaaataaaactaaaataaaacccctcaaaatcaaatatttttctggcaacgtatgtaaagccaacagggaaacaatgggagtgcatggcatcagccggcgaggaaggagaaagcagcttgcggtggcgcgaagcgaacctggaatgggcttggcgttgtaggcgtaggcgttccagctcttggtgcagtcctggcacagcaccgagccggtcaccgtgaacttggccgcgccgtagttgtgccacgcatcggcgcgcgtcgccgccgccgccgccgccgcgacggccaccagcgcgagcaacgtcctcctccacgccatctcacgtacgcctgcctcggtctggatcgactggagggatgatgataagtgtggttagatgactgcttgtgagannnnnnnnnnnnnnnnnnnntgcaaatgcaggtgtgcttcttttatataaaatcgtggtgcacgacgtgaacccgacttgcgcaaatgtttttttttgttttgttttttgttttctgagttgttgacgacgatggccatgggcggaagacgtgcgcgccatgcgtctctctctagtctccccccctgtgtcggtaagctagctaggtagcctggtttgatggcacgacgagttacttggtccgtcgtggaggccacacacggccgcccaggccccagggtgacaagatgcccgtcaggagaaaatagagcttgaggctacaagatgctcatagacaaaatgaaatgacggagaaaagcagaaaacaaactctgtttctcatgcagtcaggtttattgatttgcattttgtgttttgctcatgtagctacaataagtcatctagcagtttcagggattccgcaaaacccatcagggaacaggtaatagtcatttgatcatgatgaattgaatagcatgtcggtgatggcatgttttccttcagcatgaaagcaccaactcaaacaatcgctacaagtttacaaccattttgtcattattcatagaacattaaggccccgtttggcacagctccagctcccaactccaacttacttagagctagagttgtgccaaacagtctagatcctccgtttttgggagcggagttgggagagctgctccataaaattgtactacgggggtggagctgggtttttgctgctccacagctccactccaccccaaaagacccactaccctttaattctttagtgtatttacataaaaatgccattgaactacccctactcacctcctctcctcccgttctaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcaccccttgtttcaaagagaggaggacgggttattcatatttaatttgatggtcagaggcgaattgaaagctaagcagtggtaattaagacccccggaggaaaatagggatgtctcctacgttacccattatatgtagaagtatcaacgtaatttcatagagtcattcgatctgaatgctacatgaagaacataagccagatgacggaacgcggagacctaggatgtagaagatcataacatgagcaattcggcagatttggattcctttcctatatatccaatcatgtggtacttcatcatacgattcatataagatccatctgtctagagatcttcatatacatatagaaagtcgtatgctttggaagaagcttgtacagtttgggaaggggttttttgagagaaaagaagaatctacttcaaccgatatgcccttaggcacggccatacataacatagaaatcacatgtggaaagggtgggcaattagctagagcagcaagtgctgtagcgaaactgattgcaaaataaggtaaatcggccactttaagattaccatctggggaggtccgtttggtatcccaaaactgcttagcaacagtcggacaagtgggtaatgttggggtgaaccaaaaaagtttgggtagagctgggtctaagtgttggctaggtaaacaccccgtagtaagaggggtagttatgaaccctgtggaccacccccatgggggcggtgaaggggaagcccccattggtagaaaaaaatccacaaccccttgggttatcctgcgcttggaagaagaactaggaaaaggaaaaaatatagtgatagttttattcttcgtcgccgtaagtaaatacgtaactaggaatatggaaaattgcatctttggaatttgcaataataggatgggcgaacgacgggaattgaacccgcgcatggtggattcacaatccactgccttgatccacttggctacatctgccccttatccagctaaaggattttctcttttttccattcatcattattctatttattctgacctccatacttcgatcgagatattggacatcgaatgccactctttaaaatggaaaaaaaggagtaatcagctgtgacaagaaaaaaaacgaatccttttgtagctcatcatttattggcaaaaatagaaaatgtcaatatgaaggaggagaaagaaacaatagtaacgtggtcccgggcatctagcattctatccacaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaagaaatacccaatatcttgcaagatattgggtatttctagcttttctttcttcaatatgttagcagaaaagccttatctattaagagatggaacttcaagagcagctaggtctagagggaagttgtgagcattacgttcgtgcattacttccataccaagattagcacggttgatgatatcagcccaagtattaattggctatcaactacatattggttgaaattgaatccgtttagattgaaagccatagtactaatacctaaagcaatgaaccaaatccctactacaggccaagcagccaagaagaagtgtaaagatcgagagttgttaaaactagcatattggaagattaatcggccaaaataaccatgagcggccacaataatataagtctcttcctcttgaccaaatctgtaaccctcattagcagattcgttttcagtggtttccccgatcaaactagaggttaccaaggaaccatgcatagcactaaatagggaaccgccgaatacaccagctacacctaacatgtgaaatagatgcataaggatgttatgatctgcctggaatacaatcataaagttgaaagtaccagatattcctaaaggcataccatcaaagaaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccgccattgtataaccactcatcaacagatgcagcttcccaaattgggtaaaagtgcaatccaatcgccgtagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgttctctctcctcccccatctttctcccgagtcccaatagttgtggcgggcggtggtgggcggcatcggcggcggcaggcggcgtcggccatagcggcggaggaggaagagggatcgggggcaatggcgtcggttgctgcggtggagggcgcggcggcggcgctccggtcagtgctatcccgcggcggcggcagcaggcacacgacggtagtagggcgacgggacgacacgcgggcggttggcagcgagctagcgggcagcggccgtcgggcagtgggcggcgcgcgctgtgacgatgcgcgggaggcgtccggccggcggcgggcggggcacgcggcgacgacacgcgggaggcggccggccggcgacgggcggcgcgcgcggtgatgacgcgccaccggcggcgggaggcgccctgggattgggctgccgcgggtaggtttcctttttttttcaactttttttgcatttttttttgcaatttttttcagatctagagctgaaaactagccaaacacttctcaacgagtctcggagctagctcccactggagtaggagtttggagccctaccaaacgggtcctaaacagccagtatgttaaaaattgagataaccgccaacatcaggtatcaaagggaacctctctgatcttggttaaacttcaaaattgggcaaaaaaaaatgaaaacaattgatgcattcctctcaacaaggcacaaacttgtctacacagatatcgcatccaaaacaaacctgaggtaagattgagaaacagaaagggcaccacatgattaataattaagataatacataatctcagcaacaaattaatgacatcgcatcctctttggtttaatatccatactaaactcatttatatagctaaactactatcatgcaatagcttttctttcaaagacagaggccacgggccaccggaaaaatcggaaaagttcagataacacatgaccgaatctccgacagcacattctttgtaacatcattactcccagaaattcactttgcacagcaatgttatcgacattgaaacccctgataccaaccaaaagggtgaaactcccactgtctccttttatttagtgcttctgataaatgcgcacataactatgcaaccatgtttcgagtgaaatcgaccaatatgccatttaataataactctagcaagtaaaatctaccataactatgcacagactttccagccagcaacttgtaccagtactttgagatttgagtaaaatctatgcatactattccaagaacaaaagacatactttaagaactatcactccatattcagcatttgcaaaactagcatgcagaattacacggtcaggcaccaaaaatagagacatgttggaatctgatttgcagatctaaaggttctgtaagataatctaagatacaaataaagatcagacacaaaacatatgtactttaaagacccatcaacattacattcgcatagaacgaatatcccaacttagacgcaaacatcaaatcatgacattcattaagaacatgtccaattaacaagttaacatcaataaaatagaacagcaagctgattcccggtactattggataaaaaagaatgtgtaattgagctgattcccgatactattggataaaaagaatgcgcaattgtgttaaaccatgtcctgtcattatgaccctaacaaagtttcccttacccctggctcaaaattacaactaagattacaacagcctcaattgaatcactatgcggaatgttacaagttacaacaagaagcaagctcataactaaattcaattagctaaacatctgcaggagctgacaccctatttggcagatatgtgataccactagatgacgagatcatagctgatataaaaattcaagtgttaataagggaaaatacaggcaagctcacattgaagagatgatggtggattagctggaatatctgacacaaattgctcaaaatttatagcattagaacaatccacattactcagtggaaggagtataccaaatactattgcttaaaaagaataagtataatcgtgttcaaccgtcactcagtcgttattccctagcaaaatttcgtttgccccctggctcatggtactactagaattacaacagatccaattgaatcactcatctgaaatcccaaaaatccatttgggcaatcaaatctatctgtgcctcagcgaatacgcacttaagatctagatcttaaaagcagaatgcaaacaaaaccttatgagctcgacttggctccatccaaagcaaccgcggccgtcgccgactcttgagaggcagcggcggcggcggcggcctcctcctcgagcttcttcttgttgcgctcgagcgcctcgccgacctccttgggcatgtacttctcgtcgtgcttggcgagcacctcggtggcgctgaagaagcactcgcagtcccgggccttgtccgagaccttcctccccgcggtgtctcggcggaggtcgtcggtgaacggcttgaggaagccctcgacgacgacggagtggccctcgcggaagaggtcgggtagcgcgccctcgtagcggacgaggacgtcggtgatgaggtcggtgacgacgaactcgatctcggaggaggaggcggaggggtgggcgacggagccctcgaggacgagccccccgaggcggacgcgggacttggaccggtcggtggcgtagcgcgcgagcgcgtcggtcggggtgaggtagaagacgagctggtcctggaacgtggcgagcacggtgaccacgaacccggccgcgcacccgaaggtgagcgcgtacgtccacagccgcctgctctgcagctgccgcgcccgcgccccgatgtccgtcgcccgcggccgcgccggcccgcgccgcgccgcggaggagaagaaccgcgcgggccgccggaggaaggaagccaccggcgttcccccaacctctccggcggcggcggcggcggcgcgtgggattgggacggggctgggcgtgtggaggagggcggggaggaggcggcgggaggagaggaggcgcgaggacgccatgggtgggggatctggaaggtgcgggaagcggagcggaattggggaaagaggcgaggcgagggcgaggcgtgcgcctggtttggcggcggatcggcttgctgcccacgccacggccgcacgccggagcaagtggggggaggtcaaaccgtcaaagtgggctggctcttccgggctgcggcgtctctcagggtgggcccaacccaataagcgttgaccagggtctggtttgaactgcagtaatctgaacgaaattcgattgaaatgtttcagttccggtatagtttgactaagaccttgtttagttgggaaaaaatttaggtttggttgtcacattggatatacggacacacatttaaagtattaaacgtagtttaataacaaaacaaattatagattctggcaaaaaactgtgagacgaatttatcaatcctaattaatctatcattagcaaatatttacggtagcaccacattgtttatcaatcctaattaatctatcattagtaaatatttacggtagcaccacattgtcaaaccatatcgtaattaggcttaaaagattcgtctcacaattttacacgtgatctgtgtaattgttttttccttacatttaatactttatgcatgtatccaaatattcgatgtgatagtgtaaaattttttgttttaggaactaaacggggcctaatattctcgtcttgttctaaaaaatgaaaaaaggtgcctacggtggctatcgcctacctgagttacaacgaaacaggcatcaaacacagcccacggagaaacgactaaaaggcaaattggcgacttctttttgaagagaaaagagcgtgagattgtgccttttcaattgaatatgacgggaggaaaaagagaggggcaaattggcaactgaaatgaatcaattggaacaaagactgaaatgaatcaattgaaacaacgaatggccaatattcagaaacaggctataaatgggaaacacgtcgtgacattgtgaacctaggatgtatgtgacgattgatgagagtccaagtgtagtgtaacaagcggttgataacacatagcacatgaagaagctgaacatttcttcagccaagatgtaaagagtttttagtaatcagtaataattcagtaccccgtggtgtgcctgacactacagtggggtagttaacttatgctatatctgatgaaattgtccacaaagtggcatttcagtccaatacactgtgacgaatgatctcatgaggcaaaatagaccaaattcagcattggagatcgactgccaacattgctgatcattcaggaagcgagtagagttacaactcaggttcttcaggtgagcatgtgcctttgcaaggggcatcagtgcaccggcaaacgggttgtcccgaaagctcccatccattgaacccacgttccagcaccatgatgttctttgttcctgattcttccttggtctcagatagatagtcggagaacatcttggcacacgatggacctcgcacctgcagcgtgatttgatctcactgtgtaagaaatatgcacttttgcatgttatctcaaataagaatatcaggcgggagagcacaacgatatgcttgattattatataataatgagctaaaaagagattagaaaacttgccctttccatctgctattaataaatgtgctgttacaatataataaaaaacatgagctaacgcaatcagcaatgacgacagcgttctagatgcaaaaatcgaacatggtaccaactcagtggatgtggacaagtataagttaacaaagaacactctctattattgataatattagaagataatgcaatgcttcaaaagtattaactggggatttccaaaatctttactatagaaagcatcaaaatcagagtttgaaagactatctgcttgaaccagaaataggtagcctttcatttattttagataatggatatcaatccggcctctacatccctaaaggacgtgaagcacatcaaacagaaattgaccccagaaaggtaagtctaagtcattactgatagacgctgttcaagtttaggtgaaaaccagtgatgttccgcatgtatggattgcagtggtactgtgttattccatttgcagtggatggaaatagggaaacccttagagcaagaaaatgttaaacctgaatgacaggtccacgtataagttcctgtatcaccaatatcggaaattttgtctcgacaggactacaatttgctaggacatttttcaggcaaattaactccaacgtgaagggaataactcctgatatcatatctcaaaaagcatcctggtttagattcaagccaccaagtggatattaagaatcctaaattcctagtgttcaattgaaacaagaccattcagcaggacccgaaatcttagtccaacctttagctacaaacgttgccagagaactaggacagatcatgccatccaaacaggtaatctaagttgcagacaacaggcacttagcctgatgccttttatggtgtatatctcaattctttaagctccattcaacaatgaataaagcagtacacatctcatgacatctacccagatcagtactaaagagtaaagaagctaacaaattcatacttcatcgggtagtgacaacaatagcacgatggcgaaggttcaatgataatatagctaggagactaagataagctttcgatttttcctatcagaaaccacgcaatcgagtaacctaaaatacgaaccacacgatgtcctggtaaatatcagtaaatcaaacaacgttgttgcaaggtgattggtgccatgtgcctgcatcctgtaggagatcgggtacagtaatcgcaaatttgcaaagtgcctggcatgagatgtatgggggatcggaccaaccttgctgagggcgcagtggaagacgacggtgtccttgtcgccggtggcacgcgcgagctccggcagccgcgccgcgaagctgcggctggagaagtggtgcgaccccccgatgtgcgcctggtagctcctctcctcgtccctgcaatcccccaccacacatagaaaaaaacgaactatctcatcaacatcagccaccaaatcagcgcggcggagggtcggagagagacgaagagcggaagcgagcgcgcggcacctgacgtcgatgatggcgacgcgggggttgctgcgcgccatggccaggagcttcgccgccgacacgtacgacacgctccgcgccatcctccccgcctccgccttcctttcccctctcctccgagagaaaggcgtactgatgaggaatctgcacatcgagtggaggaccctttcctccttcggagacgaagctatttttgcaacttgctcctcacaattcagaaatccctgtctaaactattttttgcaacttgcgccttgaaattcccatacctaacctaggctacgcctttcacaaatttcaaaatggaaaagatctcgtcaataaagaaatttgatattttaagaaagaaaatatttagattttagaaatataaaatttataaaatacattataaaatatatagattttggaaatataaaatttataaaatacattttaaaatagtcatttctagggtagaaaagattcacaattctgggaacaccgttagaagggaaatacccgatttattattttagtcaaatcccacggttaaggttccaaattaggtaagcccaagtcaaaacctatgggcaaagtttaaaattgggttgaaattttaaattggagaattggcaggggccgcgcgaacgcgtaccccctctaccacaaattatgacgtccactctcccgcttggggagatggtaagccaacgcgcccaccaagtgcaatgtgggccattggcctaggccacggctcttcttgatcggccgtcgaccccgtccaggtaagtatgttgcaacgagggcaggggtgcccattatatactgctcctcccctcccccacctcctcgaatctccgaggtggtactaaacttataacagcgagacacaacgcccctccgcgggtgcggcgcggacagccggacaccaatctattcctgggcccatttctacggcccattggaaagcccacgagatccaaaggcccaaatctttttcgctcctgcgcgccaagcttttcaggcgaaattttcatggcgccattgcgtccaaaatttccccttctctccgatccccaatccccacgacggcgatggaggaggccggcgacgaggagggagagcaggggcttcgcctcgggggagtgggggacggcgccgacggcgaggaggaggtggctcgaggagtggtggcgccgcaggtgctcgagctgagctcgtccagctcgggcgaggaggggggctcttgggaggaggaggagagccagggatctgtcgaggtgacgagaggcgggggtggagatcgcgaggctagggtttccgagagccgggacagcgcggaggtgaacggcggcgaggcggagagccagtcccttcccggctgccccatttgcatgaacgcgtggaccgcggatggcgcgcatcgcgtaaggtgaggagattttttttttgtttttactaaattcgtggaattgcgccatatgcttctatgttttgattgttctcatgagtgcatatcttaagttgctaactgtgtgatgctgtatatctagttgcattccttgtgggcatgtctatggcagatcttgcttagagagatggttactgcagtgtcggaagaaacctgcgacagtatgttgttcaatgaatctagttctgaattatatatacaacctgtaatgttatttggagaactcctttgaatgaccccatgtttatgttttcagtgtccccaatgtggtaggaggtttaaactaaataacattatcaacctctatgcaccagagatttctgttccaaataatgatcttgaaaaggttagctttgcctcgtttcctttctttggaggtatttctgcccatgggctgaaacgtgtttgatttatgcagcaagtattgtcattgagggagaaaaatgaatctcttgagaagcaagtaagctactccttgtacagtattttgtacatgcttatacatgctttaacagaacattattttgtacgatgtggtgtgtaccttcgaaccgtttcagttcaatgtaataactactgactattttcatttccgcgaggaaaatgtaaatgttttgttgttggtttataggacactgttagctactgccatgaccctttcctataactattttatgcagctaaaatcgccacaagttccatgtatcttttctaacttaagctttcttaacattttgattcagaatcaagaattggtccaggagataaatgagcacaaggtacttacccaatttcttttgttatggtatcactttttttagaaggtgaatgatattttgactgcaaaccttgcatctaatttacataggaaaagaaatgcgacaagcatttttgtgtatagataatgtttgccaagcgtattcaacatttctttttttagcaaaggtctcccttgtatgtttccttaatccttatttaaatcaaagttgttagattaaatatcttttttttttttcattggcctttccagtgtcaggaaataaagttttctttccatggagcctcatgttttttcctttatgtttccttgtatgcagaggcagattatactgcagcaaaatttcataaatgaatcaagcttaaagagaaaggtagcttttcttaaatttttagtgattaaccatgattacacaagccttgatgttaacattctttacaacaaattgtgaagaaaatggcagatcaatcatcacatggaacaacagatgcagattcagtagcatctcttacagcagatgatggtcatagcagtccttgcagttttgttctccaggtttctctctagtctctatattttatgtttatctgggttccagcttctattattatattatacttgatcaatcaaactctagatctatttgctactccatttccatttggttgtgcctaatttagctatggtcatgtagtatgagcaggaatacttacgatgcatataacttgcttgtcatgccaacttcagcaatacggatgtttgagcagttcacaatcacctacagactacagaaagaaaaactggccagatttaatttattgctctattggacttataatttttcagtccaatactattccctggcttcctttcatgtattgcatacctcaataagcaagaaatattcacaagcgtgacaagacaatggttaaaaacctatacacgtgttgcaggaaaattgaccttttactcaatcttaggttaccctatcatttctggctatccatgcctttttctatcgaacagtttacggtcaaatagttgtaatctagattttgagtgggagctattgtaggtatgctcagggatggtataattattaaataggtattgagattttatcctccctgaatgttccattcacttttctttaatcaaagaactgcgttttgaaatggtaattatgttttgtagaacgagtttttccttgatggagctcgagtcatgggcatagatgcatcgagccagattatactcacttctggcagggcacctggaattggtgctgaacatgtcctcacaaaggtacatgttctaaacttgatgctttccctaatgattttatgtaacctatccttcttctgattatatttggtcgtttattcatattgtgtacctttaattcttaattttgacagctcagcatgtctagacagggattgcagaaaatccaccttccatctgatactaaagctatcagggatatctgtatactgcctgggggtcatgttgtttttgcatcactaggcaagaagttgtcacttttaaggtctatcttgaacatgttcaaattatttttttcacaacacatttactcagaagtttgatttttgttcttgtgttttatttcccagcatgacaactgaaagtgtcgtccttcattatgatctaccggtgattctttgaccttgcagtttcacaacattcgaaactattttttgttacctacttgttgattcgaaagtgctcaccaaaagttattcattcacaattttttgtggctaactccatctcccactttatttcatgaaagcacattctagatattatatatgcattttcttctcctggaggtgctattttggttgtcatgtcataaccctgaagctctttaaatatggaaatgcagcacgtttttcatgccaatttacattttaatctttacgagatcaccaagtttgcaatctttataatttgaagagtatatgcatattctttaaaaaaaagcatcatgatactttttttttctgacagagatgcatgtaaattttctttgccttgatctaaagctgttgagtgaaaaaaaatttgaatcttgacctgttattttggatttcattatcttgcaggctcctggctggtcctgttcaggcgatcaaaatagtccgaatcacatatatgctggactacaggttgagttttcagtatttcgtgcagttcttccttaaccattgtgtgctcttcgaagggttgactagaaatctctattgatgtttcacagaatggcatgctgttgacctttgatattcgccaaactgttgcaccgttgcattccatgatgggtctatctacacaccctgttcatacgatccactctgttgtagatggcggtggttccaggaaggtcatttctgcatcttccataggaccctgcatctgggatgttgacgggagcagaaacaggtatgaaacagttttaaaacttacaacaaagttcatagttctttgtggtttccaatgttcatttttgctagtgtttctgatcaggccagatttgctaaatggaatggaaaaccacggagtctgcatctctcttgcgtgcaatcctccatcaagtgatctcctagtggcttccttccggccaaaagttgagctgtccgacgacggcacatctcaagccggcaaatcacagtcaccgacaccctctgcatcagggaagctaggctgccatgcactcataaggaggacgagcaacacgtccttcgccagagaccaaatctgcagaggcaatgtgagtggattgcgaatgtccaaatccgcaatcatacccttcaccggaagaagcaatcagcaacatctcttcgcctatggcgacgagtcgctgcgcggagtccggacatggcggctgccttcactccagacgtttgctgatctcaggccacaccggcaaccgatccttgatctgaggtttgcagagagctcgtcgacaggggaaaggtaccttggatgcttgagcgaggacaggctgcaggttttcagagtaaggtagcccgtagcaacaacatcagagacagtcatttgacttcagttcattgtctctgtctgttagcagctgttccctttgctgctgtgttatactatagtataacacatcagcactttggttaggtttgttgtacaagcacaagcaagtcttgcaatctttctctgtacagtactgatctctagagcagatgtctagtgcataacatcatgtgtgatttgttttgggtgataaaaccatgtattaattttgtactagtatcatgagtggttgaatctgccacaaaaatcaaaggtacagttgggtagtgatatgtcataccattgatgctcagggcactgatattttgtccagttcttatcaaatcataatcacctcatctgtcactgtattgtaccatcacaaattcatgtttgctctttgtgtaccttggcaagttcggtggactcagcattctcaaagtctatactcattcctctaccaacacaacaaactagtcaaagagggttgatagcatagtacaactagaacttcaattctgcaaaatagacaaataataatctgtgatactgcatcgcttcaaagttgataaaacacttacggggctcaattaagctcatgatataactaatgaagaataaagaatttgatcaacttatgagacagtaaaacactttcctcaaccaatacaaactagtggcagaaaggattgttataggcaacaacatactctgtagctcaacaagagcctcaaactatacactaccgacaaacaatttgtgacaatgcattgcttcgaagttgataaacacttaaacaatgcagcatgacacaacttttttttttagataaaggtattttttttacccggcctctatatccaaccggatgtatacagtccatttaaattgggaatttggcccttcaaaaaacccaatatgaaatttgctcatatagaaattttaactcaggatcttatggtgctacttaagtcactgcaaccacattatgatacaactgacgcattgcatacgataatgattttaatcaacttatgcacgcctcaactaccaaattgcagctgtgcagcatgcagttcacactaattcgatcacacttcacatgaatccaacgaagcaatgagccaatgagcaataatcttgacgctgttcatcagcactcggggtagaaggtgtgatccctggagtaatcctggcagtagtagtagaccatggcgttgcgctgcgcccacgccatggcggcctcctgctgcgggctgagcgccgcggagccgccgccggacgacgccggcacggggctgcacgccggcggcgcggcggtggcgcagccgccgaccttgaggtcggcgaagcgggagacgaagggctggtagcggtagtcggcgcggtagcggccgccgtcggtggcccagtcggaggcgtcccagatggatccgtacgcccacatctcccgctccgggaacgtcccctccaccttcttctcgtacctcctgatcggcacgtcgtccaccaagaacctgaccactcgccaccgtcggcagcagcttgcttagtttaattaattactacctcgcactaatttaatttgatttgtcggttaaaaatcacactcactagtccagtactacaattactgccctatgaaatgacatatatatatatataatgataaatactgattatagaaaaactatgggaaaaaactcggagaacaaacaaaaaaattatatgtcatttcatagcatgacctgcgctatgaaatgatatatataatgatattcattttgatcgatgcaattaattaggatctcgatgaaacggaggaattttaaataaattatgtaagatgcttaacatgagtactcgtatttatggctaattattcttttaatgataggcggcgtatcaatctatagtaggacgtcttaagatatgctggtctagtctttcggagatgcttatagggatagggtataccgaatatgtgtgtgcgttcataagtgtggatgtgagcgtttgtactgtatttctaaatcacgtaaaaaccctgtaaaattcgttacgttcgaaacaagctctaatttactgattgagcacacggtttttcaacgatcgccgcatgagttacatgcaaacttacatgagactttgaatgcttacaagatttggtcggggttccagaggatggcgtagtggtggaagccggcggtggggtcgaaccagaggtggaagcgcatctcgcggccgacgatgttgccgtcgccggagccgcgcacgtagacgttcgtctgcagcgtgtacggctcccccggcaccgtccccagcagctccatgtcgatctcgtcgtggtgccccgggtactgctccgtgttcgacagctgcatccatacaacacaaaaacataactttttcagcgaaattctactgcacatttcactgaaatttgcatgacaaaagttgatcaatacgtagaaggccgtgttgacgccggcggtgtagcccggctgcaccctgatcgacgccccgaagtagccgttccggtacgaccgtgtcgacttgaacccgctccctatcagcatcgaatcgaccgatcagttcaacccaaaagccgaaaagtatttacaagtcaactaccagtttcactcaaaggcttaagatgaacagagagtacagacatacctgagctacggtccatccacagggtgagagacttctgatcctgggacagggtctggtgctgtgggccccacagggtgctgtacccttcatagaaggccatcgacctgaacatcttgcttgggtagtagccaggagaaggctgagcttctgatggatgcagtagcagcagcagcagcagcagaatcagaagaggaatgcatgctgatcctgggatgttaccactaccaggccttgccattttgtcagttatagtgatgtgaatgaatgatgggctactagtttctcttcttctttgtgatgaatctctcacttgttggagtgagtcatttataggatgatgtgtggctactaatgcatgcatgggatgggaccaagtgatggcaggttgatggatggaaggaagttaattgcatgaatcttaggtagagacaaaaactgggagatttggatgaaactgaacactgctggcataaaggctgaacaggatgttgcccccctaaagagggtttgtgtgatacggcacacaaattttggatgttgacgcctcacgaaaacaggaaacctgagaaagtgaatttgcaaattctcaccatgaaactgcatacctttggttactggcagcattaacaaagttgatttcccatgctgcctttcttccgatggtaactaagtttgcagcctcactttcggttactacacatcagcagcaacgaatatcatatatatgcttataatgcacctgaaactttttccctttaccttctttggtgaattactccacgaaatgttccttcctccattactctgttttggtattttggctccaattgggagaaattattggaattttttctcatggatcagacaaaaggtaccatcacgtacacactatcttaactttttttcagaaacttaattcactgttcacataattcatcttcccaatcatatgataattctattaattcacacatatataattcatcttcccaatcatatgacataccgacacacgtttcattgacaaactgaagggaagaacagttgagtagctgcccaaccaatggattaggcctaaatgatgagcttttcctttaatagtggacagtggtccacatcttcagttaattgccgaactagtatcatggtaaacttccacaggatatgatctctgccagtagtacagtaaaaaccatactatacacatgcaggaaatggttaagacatgcacattcttgaacgctgaactgaactgatcaagcatggatatgcagttttgcatagtttctcgttggcacatcgtcttcatagtcacaagcagcacaggtggatcaatcattagattcagagctccacataagcgccggtgctggatactacgattgatcagagggtgttgtactgtgcataacgtccttggagcatctgaatgtgactgatcagcttcgtgtctcttgcatctttgtgctgcccttaactccaaacagccccggacgcaactggtgttcagttggctgttcagaattggaagattgattctgcaacctgcaccgcaccaacaagagggtaagtacacaaatccaaggttgaattctttaggttgtcttcaaatggtcactaactcactactaccaactctaaatacgcattgtgtcagtgataattagtaaaagaaaaattcaggaatgtgtaaagcctgaaagcatgacaaaagatagcaggttaagagaatctagctccctgtagacccacacgattgaatgcgcacaacattccaaacgagaacagatgctccttagaaattaaggactatatgtcatgaaatcgcagaggacccttcaattgttcacatgatcagggtactggatacagcactgctgaaggttcttatattaactataaactatgctatctgccttcctgacaagaggctcaaactgaatgcatttttctctcatgataaactttacattttatctatggtacctacacttatccttgaggccttaaacttgtggagatgaaaacaggtgaagtctgcaatcagtgcaattgcaggtacttcagagttgcttgagaattcattcctcaatctctcttcagtcacatcaaaatccagtgtaattgtccacttcgaaaaatccattgtagctgtgtgcaacagttaggtaatcaagctacagtttacaggcatctattcgtactcaggggctggagggctggggcccttgaccctccatggcgcatttaaaaggaaatctcccctagcttcactgaccgacaccaatgaagaaatgcagttacatggaaaacataagaatatttctgaaaaaaaaatggcatttccaatttcaaaccttaggtccctgcagctttcagtttcagcagataagtttaactgttatccctgtctgatgcctggatatatctgaatgcgttcaaatttgggatagcaagtgtcaatttaattagcaagaaatgggcgcacccaaagttgatttggtggatacccacacaccttcgaccaactgagctaagtcaattgactcagttcttatcttacgtctgctcaagtctgtaacaactttcttgcgcttgaccattacatatagatagaagcaaactgtggtctgaatgtctgaaaggtgcacagttcatcacttcaggctgaaggttgatgaggcacctcttcagttttctcataagtcgatgagacaccttaaggttgacaataacgatgcgcattacccactcgatcatacatagcagtgtaaattatatttgtttgctcacttctgctgatccctattttgccatgattttagcctcactctggaaatctggtgaagacttggagcatcgatcgtttacaaacctttgtcaaagtctcttgcttatgatatgtgagaacaataggaaagcttgattgaaagatgtgattgccagtcactgtgctaggttggtgttagtcaaaatggtagcatgtggcattgtgcgctccctgtcagcaatgacatgttgctacaagtctaggtgagcaagtgttatagattattagtatgttaaatcaatatgctagtctaacaagatttagcagcattagctccagtgccaactaccaatttcctcagtattcaactggaattcgcttgaactggaattcgcttccaaaataccggtgaatcattagtattcgactgatgtgaagaattcgtccaaaaagttgtcgagaattcaaaggcacagcagggtaatatatgatcataaaatgctaaaacctcttaactagagaataaatattccacaagcttatcagatatctaaaccaacgcagaggaggtactgaaaactaaaaaaaaaaggagcaactaacgtgtactaccaaactagattggaagtggtttaaactaattcagagttcataatctgatctcaaaggaaagcgagatcattgacgtgctatacactatttggacatacaaagttacaatccaatgtgttgtagttgaaatgcttgcgagatattgttgcgtagcagcatgccaacatcaaggcatttcatcgaacagagaggaggcgcttacctccaagcgaggaggtggcgacgtcgccggtgtgggatcagccgtgcagtacagctccctcagggtgtcgatgagggggcggaacccgtcgcggagaggcacgacggagacggcgcggaaccgctcggcggctcccttcgcgaacgcgcgcatcgccacgcggcacacctccccctccagggcctcctccgcggcgcgcgcggcccccgcgtgcgccgcgaagaagcgcgcgagctcgtcggcggggcagccgaccagcacgcgcgccgcgcggtcgaatagcacgacgggcacgacgcggtcgtgggtggccacggaggcgcgcaggcggtagacgcgcgcgggcaccgggcctccgccgccgccgcggccggtgcaggcggcgcatgcgtcggcgtggtccgggagcgcccgctcgcagcgcgggcaggagaggtagcagaagtcggacatgtcggccgccacgacggtgcagtacggcggcgtccacgtcgccgccggcgccgccgcctcgccgttgctgcagccgacgagagccatgacctcccacggcccaataaggcccaaggccaatacgccaagctacaacggagtactacgttaggccatcccaacctttcagttagtgtcttgacaagagaatttagcgaggagaggcgtaaaaaagatgaataaccatttctcatgcaagaaattatctctacacaagaaccaagaataaaataagaagatagttgaatgaaagaagatagtagtagaagagagatgattagataggaatttaatttaaaaacaccatctattgaatatatattctatatagtttatatgacatgacaagtataataattatttgatagtttcagagttagggatggcctaagccacgacaactcttaactcaaagatcactagtttgtatcaccctaataaatatgttacatgcaacccagaaaccatcaattagtttttatatgtatagaaactatatatatctaaaagatgatctcttcaaattaaataatcatccaataacattttttctatctccttttatctatatatctcattcatttttggtttttacttagagatggtttcttgcatgagaactggtttattcatctgtttactttgtcttgttaactctcttgccacatcaattttttttcttatgtaaaaatatatttaataccgtggataccagatgatatggaggatcaggataacctcatcactttggactggagggagtacttagataccaattttggcgtattgggcttggtccttgttgggccgtgggatgtatggctcgtgtcggctgcagcaacgccgacctttcttctcacggcccaaatccaaatccggcaatccccaacacctacgagtaatctccaccgtccattcgagatcggacagccataaaacgcacgtgctctcgcttcggtggagctctggatctgacgcgtcctcttcttcctcctcctcgagacctcggcacctcgcacgccacgcttctcctcctcttcctatcccaatccactcggcgacccccctcgccgtcgccgcgctgcgccggcgagcgccacgggagcagcagccctcgccgctccgcggctagctagctcgtctcctcgtccgcctcgcgcctgctggagatccgccccccgacccccgtggtaagccctggacctggggttggttttcgtctgtccctaatctgccgctgatgtgcgagccgaaatcaaatctatcgacgaggtttcgtgcggttagtgtgggatcgatcgatttgctcggtagtatctgtaaatccgctcgctgttactggtttggtcgctcgctcgtcaggtagggtttcgttcgctgctctcgcaaattggtcgtggactcgtggttcagcgcgcgtgcatgtttgtaggatgggagcgtaggttgtggagtagtcgaagcagtaggatgggagcataggttgtggaatagtcgaagcagtaggaatatgggagcataggtagtatggttgttgaacttgaatcctatggtaaagatatgatgatttgttgtagattgggcggttgtgttggggggactaggagggaaatcttgtgtatgagcaattgagcaaatggctcgatggtccttgtttgtagtaatcaaggatggaggaaggtggggcattcggagagtcgtttgccctactgttggaattcgggcctgtgcttaggaaaggatggttgctgttgtttgggctcatggagctggaattcagcctgtggttttgttgtggacaggaaggaaggaagaagggagggttgtaacagcctaacaggttgtgggagtcttggaggtgctggttttgtggtgtggtgttcgcagtttggttggagcttggagatttagaaggaaggtttgacgatgagcagccgcagcccgccaccaaaggaccgcaggattcgtactgagcgtacctcataccgtgatgcgccatacaggagagacagccgccgtggtcctagcaggtttgagttgtcttgtttaaataaataaagaaaatgagtatctggcaccgtatatcctaatgttgccgcttgctatcaacctctcttgatcatgttggcaggataaccataattgtcatttctgtttggatgtatatattctctgtttttcttccacaataattacttatgcatgtagtatttgtatagcctcttgatctaaggccatgaatccatgacctatgttgctccagtatgtaatatggatagggcgacactacatgtggtcaacccattgctgtcctctaggctaaggcaacagttagtaaataaaaatctttaaaggagaagttggtttgtcttcatgtcttttgtctatatctatactctatatacaa

SEQ ID NO: 58310 - DNA, 43732 bp, Oryza sativa
ccatctcccccttcctctcccctctcccctctccactgcgccgccattcccgtgccgctgcgccgccgttcccgtgccgctgcgccgccgttcccgtgccgctgcgccgccgttcccgtgccgctgcgccgccgttcccgtgccgctgcgccgccgttcccgtgccgccgcgccgctgtttccgcgccgccgtgccgttgctccggtgccaccgtgccgccgcttctgtgccgccgtatgccaccgtcgccaccgccgtcgtcgccgctgctgccgtcggtgagccgccctccttccccctcgcgcccaccgccgccaccgctcgggtaggagggagagccgagagagagagagagccgagagaaagagaggaagaagaaaagaaaccaagggagggagaagccgaggaagagagaaaggagccgggagggagagaagaaagggaaaaagaaagagaggagagaaagaaaagaaaaggaaaagagagaaaaagagaaaaagaaaagggagaagagaaaagaaaagaaaaaggaaagggagaaaaagaaaaaggaaataaataggaaattagagggagtttggggaagtttagaaaatttaaaataattagaatttaattatagattaattatagtcgtagaattacaaaatttaatataaattatggattattcttagtaatttctataagaaatcaattcgcggtagtaatttagatgtaattaataactaaacaaatagatgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaatgaaataattatacccgcaaagtagtttaaatcgaaattgggtttgccgtagtttgcagatagtaaagttaataaaaaggaatcgactttcgcattcgactttcatttggatttatttggatttttatttgaattctaatcgaattcaaatcaatttttgcacgtaactatagagcccgagggagttgcggatccaagcgaaggccaagacccgcaagactttaagcaaggcaagtcatcactattcgttgaacatgttgatcctaattgcgaaattgtttgtttacaaataaaattgcatgcaatgatgaacgtcctacttgtgattatgccatgccttgattattgtttacccttaaaatccttgtacccatgattacgtatgagtccctagtcaattatgacaactgcttagaaatgctattctaaaatcatgcatactcatatttatcaaatgctatatgcttgggcaattacctttgggaaggtaattgagatgcggcatgtgaagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgagacatgtattatacttggctagactctaaattctttaacgtgtgtgggatgggatgttgcatgatgatttttatgctgatggagccacttcctgagaggcgggaaggtggacatcctcagaaaaccatgacgaatcaatggcgggaagctatccttgggatcacaatggatggtggacagaaccgtcgttgtttaaatacaaactctggtactaaaatttgatcggtcaatgctaggtcttaggcttgtgaaaagaattacaaaacttgctttgcgcaaaagaactatggccatcctttgaactcccctttcatatgcattgttgctgtggtggcttgctgagtacggttggtactcatccttgcaaatataaaatttatcagatgcgggagatgaagcctcggaggatccctatgcctattatcaggagagagatgaagacgatggcgtccagtaggtcttagtacgttcgttgcctgtggcaatggcatgccgctgcctgaattccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgattacacgattgattcctgttataaaaacgggggtccacactcagtatactctgatgaacaactcagaagagagggtcaccaggaggaactagcaaaagatttactatattgtttcgataaaagagaaacaaccaaactaaaaaaaagaaagttttcagtgaatagcacaaagttgtattgtaataaataaatatagttttgacatatatggagcttgttcattttcttcgctcttctttctcttgcatatgcctctccgaggcaccccatactattggccgataaaaaaaaaactcaaaatcagtcactatcatcccaatgaagctcaatgagacttgataaaccaatagttatattatcacctaatagcaggggtaatgtccactcttatcgaagctgtgcttctgaataagcatcagtccttttgtggggaaaccatgaaacacaaaatcaatccgcatgtagcctatttccaaggttcagtaaggcacagtagtagagttgtggactttgtgggttgcataactccgtccactacggttcaaatcctagagcctaaatttatgcatgtgaggtgtgcttcaaatagcaaattttcataggaattctgtgatgtacatggaattttcctagcatccttccgtcgaaggttttcaaggaattctcatgtatatttgcatcctccatctatagtaaaaagaaataaaatccatattctagttgcctgtctaatttcgtttgaaaaaggttaaaggcttacagttagcacagagcttttaacccaaaaacgaactaagatgctcgcatatatatacctgaaatcatcatcattttttgtggtaaaagcacctgaatcgtcaccaagcttgtgataggatgatgagtcgaacgtgattgatcgttccttcacaaaaaacacaaacatacatatcactatatcagttataagtatttacagtccgctgagaagagatgccatgccacgcagatggcgaaatccccactcaaacagtaacaatgatcgaggcgctcacctgaaaccgcgcacagatcgcgaaggctagggcgagggcgagttggggatcagcttgatgtgtggcgcggtcgtcgatcaacttggcgagggcgaacacggcgagggaatcggcagcggaggcggtcgagagctggcggcgagggcgtgctagggctccgtcgtcggggttgccgtcgctcggaggttgcggggaatacatagcttccgcctcagcgcgcaaggaacggcgaacggcgggcggcgggcggcgcgaggaggcgtccggcggcggcggaaggcgagccgatcgaagcgagcaacggcgaggggtttaggagctgagggacgatgcgtcgccgtcggatgttctgattgtgtttaaattacggatgtgtagctttaggattcggacagtaagtaccaaaggaaattgggtctttttaacgacaaaattctagatgatcgtggattatgctttccttcttgataataactttatgcaacttcatgacgccaaacgcgttgctacagaaaattgtactatgaatctatattggttaagcttcttgatgacatgccctcaggcacgagcgtatttaaacgatgttaatgagttgtagttatgcgcttgtttggtttagagctaattttgtcatttaccttatcaatattttggtaaatacccaaaccttggaaaattttgccgctactaaggtactactatcaatttgtaactgtgtgatcaaaattagcttccatctaaacaagcactatatattagctccaatgggaagtatcgagccctaacagttgggtgctaatagttttcctccagttttctaaatagggcaataacactataatcctcttcaatagctttcacttgtgcgcttggaatagttggatcatatgacaaaactgaactaatacgagtatagaagttaaaaaaggctcaagtttttatttgactactttctaaagacgaggatgaaaataatcgtttcttagtttaatatgaaaaatagggcataggaagatctgactctatgggagcccaaaaaagaagttaatttagattatctaggatattgtaatcaacatagcaaaatagttttatagttgtcgatatttcagtcaggagagccttccacgtttgatttctcatgcaaaaggcataaagctggatgcatggtgtcgttccttagcaaaactgcttcgcgctataatgcactgccgtctatacatatacagcaggatgtcacaccaacaaaaactacaaaactgaagggtacacatgatcataatcatgtccatcttttgagttttgatgttgatgaacattttattacttcctaactcagttgcacagtccagcctagccaatcttctgcctggcccatctgcaggcttgtcaatgaagtatatagctgctgagacacgacaccaactcctttgttgccagcatattcgaccctgcaacgaaaaatccattgcatagtatgatggaacttggaagaacaaactttctctgacttcggaaattttaccaagacaagtccatcttagtaggagatccaacaaaaaaggttagccacgacttactagccactagtgaataatatacacctttcaattgtttttatatggctttagtggttcctttattcaagcaacatggggtgaagaattggctaggtttcggcccattaggtagttcatatggcttaattggtgatttatttgaggaacaatacataatacgggtgtaaggaaaggaaacaatttaaattttgacttttgactacacatacagcaaacggctgaaatttcaaggaagcaatgttctaaaagtcagcactgggtgccacctaggagcctggtagccgccacaattaggaattagatggtgtattagactgttgaatttcttggatggtgttctgttgctattttagtgttatattgtctaattttcatgtaatatgcttgctaatttcttgaaacaatgcaaggaaggataagagtatcaccttttcccttgataggtaatactacccacaggagacactacgacagcagttcctgtgcagaaaacctcatcagcttcaagcagctcgtctactgacacaagtcgctcctcgaccttcaagaaacaaaaaaacattaatagaagatttcccaaaaaattgagaatagatgtaacaattttcagtaacagattgagaacagtgttttgctgcttctaattggatcgacatcgctaggaaaaataggttctatcttcttcaatgtagccgtagctcatatgaacctaaccatgaatataacccttggtagattgaaatatagataacccattgttaatattcacagcgaacaagaaggatgatatggacaaatagaaacatggacttggatacctagcaaatacacaaggatcaatgttgaatacctaatgctgttgtcaaagatatcaaatcacaggctactaatttgagctacactgaaagtaaaacatcttgcttgttagttcatgggattgatgattaatttacctggaaacccttgctcagagcaacatcaatgatacttttccttgtgatgcctggcaatattgttccttttactgctggagttgaaatgacattgccctggtgcaaaagccaagaaaaataataagggtgtgtttagatggggaactaaacgggccctaaatagatctcaagtcaaaagcagcatgtataagatattccttcaatttgttgactatccttatgcaaaaataagcaataaatgttttgtctgcaatggaaatacaaagtccaccataaactaaaacaaatacaacaatagtttgccattcaggatacgacacagacaacctggctgaacctaataggtgtagaacaaccaattgttagtacgatattatcctatagaatagtcatggcactgtattgctagcgaaccaatacctatgaccatgtgttgtagatatgcctgtggttttcatttaggtaacaattcatagaggtttatgcatggtagaaggtactccctccgttccaaaatataacaacttttagccttcaggatttgtcccaaaatataacaacttatctaccaacattctcttcccaaccaatcacaaccctccaccattcacttttcccacctacctccactactcatccaatcacaaccctccaccactcgctttacctactttcttaataaccgtgtccaaccctaaaacttcttatattctgggacggagggagtagcagttttgagtttgtatgttatgaaattagatcccttgacacattatctccatcatttatagaagtacactaacccacagggtatgcatttacttatggatgttgctagcaactaacacataaaacacatctatattttttgggtactaccatgctatctgttacagattttcaaaagttttgagccagaagcctgttcaatctaagagtatcaaatatctacttcaaagagcgtatgactcatttcatttatttgaaacctctttaatctatatagacataaggacatacatctatcagtaaagaaaacaaagctgatcgttaatacttaatagagtaggttacaaatcttagcatcggttaatttactgtggtagctttcagaactaaaaaggctaatattaactggacctacaggagaaagtgttcgaatcaaactaacaggtattattgacagcataaacacaccttgacaacaaaaatattacatgaagaaacttcttcaagatactttttgtgaacagcatccaagtagagaacatcagaatagcccttttcttttgcaatcttttgtgccatcaagacctatgcaaagacagtatataaattaaagccagtgaaaataataacagaattcaacatagaagatagcagaaaataataatgataagatagcagggagatataagtcgtcatacaaaatagcatttcatttgaagtatatctgatggttcaattatttttcatttcacagcttcataatggcctgtatgttcttaagagaattgcactgacaactctcctttcaaccacatgttcacatcaatagaatgactgttccgtagtttaatatttgcagatctgaactaaaaacattacatcaaaaacatcagaaagagaaatatcaggtagcgaagttgcagaaatagccatgacaataacttccgcatcaaagctgtaagtaatgggtttcaaacttgactgtagaattaccgaggcataatttcctatggtcttcacacttccagttccaccaggggttgcacgatgaaacttatcttcaactatcaaatttattggagctaaaccttcctgaagatatgagtgaataaattaaattaaaaaaaatccatgatacatgagctgtttagaaattctacattcaaccatcagttatcaacaaccaacaaaagtggaaaaaaaatcataaattcataagtcaagttgctgcgaaatatatattcagaaacacggtgtcaagtagaacgcagattataacagtatctaccatagcttttttttttatttatggcaacaacgctgcggctaaaagagggagcagaattaaagaaaaaaacacaaaccttaaagtagttccccacaggggagacaaatataatgaacgtatactcaggagcaggtgcaagaccaagaacagcaccactacccataagtagcggtctaatatataaagaacctttaccggtaggaggcacctggaattaaaaattatttaacaaatgattaaatcaagagtatgaacagcggcctagcccactatgaaatgatttactttttacagtaaacccacccatctcttgtttgctaaaacagtctgctttactgcatccacaaactgctcaacactaggcgcaggcatgcacattctttctgcacctgttctcattctcagtgcattttcctccgggcgaaataataagatagagtcactgttgttctatatgcttttagaccttcaaacaatccctgtaaataattataatcttttaggacgaaaagtatttaaaaaggctcaattttccttatcttcagttaccacaatgtactcaggatatatgaagcaaggagatctacctccaatacaaacctatccgtaattaaggactccagaagatgggttcagcgctataggtccaaatggaatcatttcaccctcagaaaaattcccgtcctgtccgcattttgtgatatacatgtagtcggtctgcacgattccaaaaccaaggttctcccaatcaaaatcagctacctcagatgccttcctgaaaatatgcaagagttgccatcagaattattcctgaaatgaccaacacatcgtcacaatttgacaggcaggtcccctgcctggagggatacagttcaacgaatcatgcagcttatggtaagaatcacacacgtgtagtcacttgctagagaagcctcgcatcttctcacgcctcgagcctttagtggaagcgacgacatcgaataaagtcgattctgaatctgcagcagcgagaaaacaccagtatcaaatacagtattttaataaaaaacgaacataaaaaaaaacagcatggacttcatcaatttaatctccacaagcacttcacaaatcccacctacaacaacatataatccaaatcctaaatctccagttcgaccgtacacgccaatctagccaccatgatccacgaaatctacagcacaaacgcatccaggagaccgtgcaaaccaaataccggcctagtcgcgcgcgtacctgaatagagggcggcgacggcggcggtgagaggggcaaccggctacgccgggcgccggcgagcagggtggccgcgaggagcgcgccacgcgttgctgcaccgtactccatttgctgctctctcgtgagctcccccgctctctcgccggggtatagggtttctgcggctactgcggcggcggcggcgcgggagaggcagcggagacggagacgacgatgatggccaaatcggacgggaatggcacgggggccaaatggggaagcggctttactcacagaaccttctagccattgtagccgatgtgagaccgactggtggggcccatgctgtgtgggccccacttggcagtggctgggctcgggatcccgcgggtgtgcacgggggtgtctggaattctggatgaggagcgcccggtaatcgagcaaccaaaatatagttttttatccacatggttttctggcaggtggggcccgcgcaccttcacactcaatggtgttcgtggctgccgccgtgcggtactgcggtgggtattgaaaagggcaaaaaaaaaagtggtggctcgaagaataggccgacttggctttggctagctctctttcgccacgtcggaaggcaattttattttgttttttcttggtaggatttctttctctttttttaaaggtttactcctctattacaaaatatagatatttttagcataatagtttattccaaaatagaactatttttccgtttgcttctcttatcaaccaatcacaaccattttcgatttaattatcatattcgcttcatcttcacaattaatcataacttttctctaatcatttctatcaactttcttaatacttgtatccattttagaaatggcaacaatttatgacagatgtggtagtggttctgctcttattgacctgttacctcactctcaacatcgttatatattcaattttagcggcataactgttaaagtcacataaaaaatatatatatatatatatatatataagaacataatatgatacgaaagacaatcagacaaatattataatttgatagtaaaaaataatgcattgggggtgttcaatctttgctaccagctgcaattgccaccgtgagttaatactgaataccctcattgcatgactactaatgttgtggttgtcctcctttgtctaatgtgtgatatcgatctatgtgcaagttgacacaaacatcacaatgtgtaatgctctatcaaccaaacaggtataagagaagcgtatgctaattaccggaagaatacttgctttgtctgtagacataagttgaagtattgtggagcacgattgcttaaattctaaaacattcaaccgcagaaaaatgacattgctagcttgcaacatatgtttttttccacagcagctttggattgatttattttcagctagggtgcccattcagctatttgatgctctctttttcgcgaacgcgtaaaaaaattgtatgtcaatatattagaagaagcatagatttttaaaatacacgacacaaacggccgaaggacattgtcagggaacaggagaaaaacggattttcttgggttttcttgccacatgctctatcaacatatgttcttttgcacagcagtgtttggattgaattgtttttagctattggattaaattgttttcagctatttgatgctctccttttcacgaaagaaaaaaggattatacgtcaatatattagaagaagcagagtttttttttaaaaatacacgacgcaacggtcgaatgccattgtcagggggaacaggagaaaaaaaaaggcttttctccaggggcatcgcgcaaaagaacaaatttgatgctctcctactctatcacaatataaggcaatcttcttgccttctttttatttattttttcaaactcacataatcatgtctcttctggtatccgatagagatctctctctagtccaagtcaagtgttgtccttttattttttttttaaatcattgtcctttaaaattttagctacttattaatcagcatgcacagacctagatcagtcccggctccctggtattggatccgaccgatcgagtgatgtgctctcatccatccatagccatattatccctgcaattgtttattttcattgccaaatgaaccttaagtgataaaacttttttttgtttgtgtcaatcgcattgtttattggttaattctctgaaagtgataaaagggcattttatttgtgtaacctaatgaaatactagtttttgacatgcatattgtgtttctcgtgactgcaagaatatgaacatgtcactagtttaaggtgtgtttgaaagatagagaataaaaaagaataaaaggatatgcaaaacaaggtgtgtcattagcgtatgattaatcgagtattaatcattttaaacctaaaaatatattaattttatttttaaaataacttttctataattatttaaaaaacgcacacaccgcttagtagtttagaaagcgtgcgcacgataaaggaggatatttttttccgaatatgcttgaaacaaccaaggattgttgacatgtgtcgacgggtgatacccgtagaccggatataaagggtattggggtacgttggtacaaggatctacgtagtacgacatcgaacaatcaaaagacaagaattatactggttcaggccccttggtaggtaatagccataatccagttgatatgtgattatatggtggaaaacacaggttacaaagggaacgatggaacttgttggattcggcgagatcatagtcgagtggattcgactagctctcgatgacttggctcctcgcagacttcggctttgtaggctgtgtgggttgtgttggctctgagattcgatgatctatgccctccctaggggggtcccttttatatcatagatctggaggtctccaagtaggactcggagatatcagacccaatacgatacgtcgacgacccagttctgtccgagaaggactcttcccatctgtagatttcgtgaaaggtttccttaggatatgtagaaaacatccgcgtgtgtgtgggtatgccatgtcgatatgtaacgtatattgaagggtagagggtatgcctgacccgtaaccctgacagtagcccccgacttctgcttaaaatgaactcgtgcaaccatttatgacttcgggtgtcgagaacgttgtcattcttggcgcgaggaccgcggagatagaacgtagtcgagcatgccgtttgaagcccaacggtcacgagtgaattttgaactgaagtccagaaaactaccgcgcgtaacgggcccagagatttccggcggggatctctctccgttccttggaattcgcaccgttggtagtgtgcttatttaaaggaattttgggagctcattttgaagtctgccaaccttgttgaacacacaccacctgccagcgctccttgccttctccgccgccgcaagaaaccctagttcgccaactcaggcttgttttccggcgatcttggaacaacaatggatctcggtaagtcgtcttccaccagcgcgacgttgaagaacctttaggaggacggcgcccttcccggccgtggagacatggagagagaagtaggaggtactgatcctcagcccctcttaggtcgcatggttgtgatcgaagattacgttctctgcggttttcttcctccaccttccgagtttcttctcctggtgttgaatttctatggtctttctcttctccatttgaatcctaattccatcgcctttcttagtatctttgttcatctctgtgaggcctacattggggtagagccttttctcgatctcttccgtttctactatgaactgcgttggatggaatccaatagggtgtctggttgcgtcgggttccgacttcgtgatggcatgaagtcgcgttatatccccttccagtgtccttcttcccgcagtaagtggcggaacaggtggttctatcttgagatcaaggactcgaaccctgtcttcgttgttcccgaggatcaaccggacaagattccggcctggaccgccaagccccctttgagcccctctcttcagtcgtttatcgacatcatcgatgatctccgagaacagggcttgtcgggatatgaagtcgctgcagacttcgtcggtaggcggatccagccgctccaggctcgggcccatccagcctataactatttcgggtcggatgacgcgacccgggtttctcctcggggtatctttctcgtattcatcttggcgtgcttgtagtcgcgttcctcttgacttatcaaaagttggtttccgtttaacaggtctaagcagcgaagctatggagcggcgcgtcggtcaagtgatgatcagcggtccgaccacggctagcgacatccccgtgcccctttgtgaaaagggggcggcggaacgcgatgaagccatcaacgtaagtgtatttgataagcatctcgtattctcctttcgaaatcaccttatgacctgattaagcgtaggcccttcctttgactgacatcatcgggccgctcgcggaccatcaggtggcgacatctctaaaggagaaggttgtcaaggaggcatctgatgcggccaccactagcggtggcaaagtcccgaccaaggcgaggaaattctcgtctgtactcggacattgccgcaaggcagcgacccccctcggtatcatcttgtcgtcagatcgtgcagcaaggagggtttcttcttactctgtattgattgtctttcaggcttcagacgcgtcccctccacctccacgacgacagcgcattgtaacgatcggcgagaagtaagtaaatagattcttggattctcgtgcttttcgttcaaatggtgtttgattcgtggttgtccgtagggaggcgcgggcgaaggctgcacgggccaagtccgggggagcttctagcgcatcacctgccacggcctcgacagatgtcgtgcccatgaccgggagccgggaggcgacgcctagtggccccatcaacaatcccgctgcgggtcgtggtctgccagcggccgttctcacctgggaggagctccaagtcgagatggggcgtcttctcgaagctggtgctcgcggcatcggcagcgagatctcggaggcgaggtcggaagcggcgacggcgaatgcgcgtgctgagagattggtgcgcgagctagctgaagcccgtgaggacctcacgaagatgagggagttggtggccggcaacgagcatcaacggaaggggctcgaggactgaatgtcggaactcgggaacaatctctccgagatccatggctcgttgcgggtcacctacactggcctccatcagctcgccgaggagtgcggcgtcaagtccacgatcccggcgaatcccgacgagtttttgctgacttcctctcttgcggaactggcgacggcgatggggaaaatcccctccaagcatgcggccaggatcgcggaggagacgtcgaacggcatctacaccggagcgtgtcacgtcctcgcgtgtgtaagattgtcgcgtcctgaactcgatctgcgcgagatcttggatcagggggcggcaagcgacacgcgtaaggaggtgatggaagaagtcagtgatctgggggagtctgttctgcccctttttgaagagtaggacttcttgtatttgttatatattgtgtaaatcttgaactctggccgccttcgttcgtgcgattaccacccttgtccaattttgtatgttgatctcgggagtttttgtccattatagagatgttgatgatgaggatgtccagcagcgcgggcagcctgagtcactggcgatgattccggtactcgattttgaaccacatgtttcgtctgacaatgtggatcaaactcttgatgcgaaggccgggatggcaacggccacctcaagtgagtagccttttcacctcttagtgacctcttgattaggttatttatgttgtaaaggaggtatccaacttgtcttagtggtcatcacatttagcagatctcgagggtgcccttgcaaatcaagatcgtcgtatccaatactggaagacgaaatttgaagtggcggaacttgagagaaccatgctggccgtgaagaaagagcaggttgtggagacgctccgaggtcgcgaggtgtggttcaactcttacttgaggagttgctgtgcctccatggccagagtatgcagggaacttcgagtagtccgcgatgatcccgaggagtcggcggctgggtacatctcttggctaaacggggcctgtgcccaacttgatggcatcggcaagcatatcgacgaggccttgaagcaagagtgtcgtcgagtgagccgatacgccggagtgcacatgctggcttgcctacgagatcaccgcccgcgcttggacctcgagtttctccgccatggttttgctcgttctcggagaactccggcggagatagaccatctggcgaggtcgatgtcgccgctggccgagaagatcttccagtctatggactagcgttggccttcttggtagtactcatgccctgtcacagatatcttagggaaagatgtaatgtagtggaaaatttatgtaaaaactgtaagaattattttgtgaataaagaaatattccttaaacaaatgtatcttactctagatgtcgtgtgtaagagtgtgttctcagttaatgactttggtcagccgtttgagtcgtacactctccctagcccccagccttgtcgtcggaggaattttctcggaggataaggctcttggaccattgacctgccttggttgaataagctctgatcctagcccccagccgtgagtttggaaaattgatttccgatttcacggcttggttaatacgcacggtgagaactcttacacgaccagatcttacatggtcttttgtctctacaggatctgacaaggccttatcggctctgggcatccccagccgaagatcccttaggttcctcggaggccttgtcgagacggcgtaaagggacataaggacaggtttcaacgctaggtgtcatcagagtaagggatcatcgggtgaaaacactttgattgtgatatgggacctagaaataggctttattgatactataagggtacttacaggtacagtggtattgactcatacatagaatttacgtagttggtcaatgttccaagaatttgctaattcgcgaccatcaccgtctgcgattttgaatgcgcctggccgcaagacttgtgtgattgtgtaaggtccttcccattttggtgagagtttgttttgccctgcttgggtttgaactcgtcggaggacatagtcgccgatcgaaagtatgcgtgctcggatgcgcttctcgtgataacggcggagggactgttgatagctggctgctcggacggcaactcgctcatgatgctcctcgagaagatttacatcgatgtctcactgttcctcctggttctcgttggaatacttctgtactcgtgtactctgatgtcgtagctcgccggggagcatggcctcggagccgtacacgaggaagaagggtgtttccttattggacgttgtcggtgtggtgcgtacggcccatagtactgatgggagttcttcaacccactttttgtcttgtgacatgagcctgtcgtagacgcgggttttcatcccttgtagtactatgtcgtttgccctttcgacttattcgttgctttgagggtgagagaccgaggcgaaacatattttgactcccaacccgatgcagtaatcttggaagtcggtgctgatgaattgggagccgttgtcggttatgatgcggtgcagtagtccgtatctgcagaatatccctctgatgaatttgatggcgttgtcggccttgatttcccccgtgggcactgcttctatccatttggtgaatttgtcgatcgccacgaataggaatctgtagccgccctgtcctcgtgggaatggcccaagtatatctagcccccagcacgagaacggccaagtcagagggatagtctggagcgcttgcgcgggtagctttgtgtgtttactgtggaattgacaggcttcacatcgctggaccatgtcgaatgcatctttaagggcggttggccagaaaaagacttgtcgaaaagctttgccgaccaatgtccgaccggcggcgtgtgacccacatatgccttcatgtatgtcgaggaggaggtgtctgtcgtcgtcagtagagacgcatttgagaagtaccccgtttagcgcttttttgtataaatcgttaccgaccatacagtagatctttgctttacgggttattttctcggcctctgtatcgtcctcgggcaactcctcgctgctgatgaatttgattaatgggatgcgccagtcgtctgtggtttcgatgtcagcaacggcgcgttctgcctcggtgacctccgagctgatgtcgggggtgttcgggctaacttcgccgctaacttctttcaccgatggcttcgtcaggatatcgagaaaggtgccgggttcgagtggttctcgtctggctcgacgttgtccttgcgatagacgtgtcggacctcgatcccatcgaacctcttctctagcttcctgacttctacgagatacttggataactcggggttagagcatttatagtctttgtgcacctggttcgcgactagctcggagtcccctttgacgattagtcgcttggcgccaagtgcggctgcagctcgtatcctggcgagtagtccttcgtattctgcagtgttattggtcgccctgaagttgaggtggattgcgtgcttgaattgatctccggaaggagacgtcaagataaatcctgcccctgctccttggctgttgagtgcgccatcgaacgccattgtccatgtttcgttgtcgccttggttgtctgatttgttgtccggcatagtccaatcggcaacgaagtcggcgagtacctgggatttgatggctattcgcggcagaaagtggacatcaaattggcttagctcgactacccatttcgcaatgcggccgacaacgtctttgtttctcacaacttctccaagggggaaggaggatacaactgtgactctgtgagcttgaaagtagtggcgcagcttccttgatgtcatgatgactgcgtaaagcattttttggatatgtgggtatcttgtctttgcgtcatggagagcttcgctgatgtaataaactggtcgctgtactttctctctctcgacaacaatgacagtgctaacggaatatggcgtggcggcaatatagaggaataattcttcattaggttggggagcaacaagtacaggggggtttgataggtagcgcttgagtgcaataaatgcctctttggctttctgtgtccatataaatttgtcttgtttcttcaatagagcgaaggttgtgctcgttctcccatcctagcgacgaatctgcttagtgcttccatgcatccagttagcttttgtacctccttgagtctcgtgggcgacttcatgttctcgattgctttgatcttctcgggatttgcctctattcctctgccagagacaaggaatccgagtagcttgcccgacggtactccgaacgtgcacttctcaggattgagcatgaggcgatatcgtcggaggttgtcgaacatttcccgcagatcgtcaatcaatgagtcgcttgtcttggttttgacaacgatgttgtcaacgtaagcctcaacattgttgccaagctggttgctaagtgcgccctggaccgtgcgctggaaagtattcccgacggttatcagtccgaacggcatcttaacatagcaaaataccccgaacggcatgatgaatgctgtcttctcttcgtcctctattgccatgctgatttggtggtagccaaagtaagcgtcgaggaagctcaatagcttgcaaccggctgttgaatccaccaattgatctattcgagggagaggaaagtgatccttgggacacgccttgttgaggtcggtgaagtcgacacacattctccattttccattggccttccgcaccatgactggattggctagccactctggatgaagtacttctctgatgaagccagctttgagaagtttgtcgagctcttctcgtatggcttgtttccggtctggtgcaaatctccgcagtctttgctttactgacttggcatcgggtcgcaccattagtttgtgctcaatcacctccctagggacccccggcatgtcggacggttgccaaacgaacatgcaggcattatcgcggaggaaggtgatgagcgcgagttcctatttctcgtttagtgtcgccccgatcttgacagtcttgtcgggattggcactggagagtggaacgatcttgatggcgccgtccggcttcggcgtcttatttgtcttgctcactttcttgggtggctcagttgtggcgggtgggctgggcgtttgctcgactatgtcgaggctccgcttgtcgcactgcactgccagctttgtgttcccctgaatagtgattgttcccttcggtcccggcatcttgagcacttgatacgcgtagtgagatatggccatgaacttcgcaagtgcagttctcccgatgatggcgttgtaagctgtatcaaattcaacgacatcgaaggtgatctgctctgttcggaagttgttggcttggccgaaagtcacaggcaacgtaatcttgccaaaaggtctggatgatgattggggagtaattccatggaagggttgatcagttggtgtcaactcactttgcggaattcccattgcgtctagagtactagcgaaaagaagattgatcgagctgccaccgtcgatgagaactcgcgctactttgatgttccgaataatgggttcgaccacgatcggatatcgtcctgggataacggcggtcttggggtggtcttctttcgagaactctattttctgcttagaccacttcatcttgggtgcagccccccgccatgtcgaacagacttcacgttccactttcttgtattctcacttggaggagtacgttgtggagccgccgaaaatgtgtgagatgtggaggtcggagtctggatacgcataatccgattcgtgaggagccgtctcttcgttcttctcgacaatgcgtactcgcttgcctttttcaaacgccatgtgcttctcgagcgactttttgaaaacaaggcaatcttccagagaatgtctgtccgtcttgtgtatggggcaccaagatttctttgtgtcgctgccttgtgggtctgggcgcttgggagggttcgcgtattctgctgcgaggacttccgcttgagctttccttttcccatttttgcgatttttcttcttgcttgactcagatgcgtctgtggctgatttcttctctcccccggtcttcggcttgtcgttcttgcgtcttagcgcatcgtccacatgggcacatcgctcaacgatctcgaataacctccgagtggttgtgatgcgtcttgtcgccaattcctgggtagtgtagcgatctctgacaccggatttgaaggcgcggattacagaagcgtcggtgatttcaggaattgtgtttctgcattcgttgaagcgtcgaacatattccctcaatgattcacctgagttctgtgtcaacgcgtgtaggttgtcttcgatcgcgtggcgcttgtacgttccttggaaattggcaacgaattgttgccacaggtctgcccacgaagagattgagtagggaggaagatgcatcagccatgaacgtgcagaacccttcaacgcggttgataaatagttcgctagcgcgttgtcgtctgctccggcagcatagagtactgtggagtagacttgaaggaattcttctgggttggtgctcccatcatacttttcaattgctccgggtcggaatctctcaggccatcggacatcacgtagggaacgaccgaaagccctgcacccagcgttgggggcggtgggttgtcagcggtcgtgtgtccttcgtggatgtctgtctgacgatgaggaggacgcagatgatgatgatgacgatgggtcacttggttccggcgtacgattacgagtatgacggcctggatctcgggaatcctatcgttgtctctcgctgttgtctcggcgccgatctccattattgtcgtcgttacggcggcggccatgaccagtattgtctggcccccgtcattcgcgatcgttgcgattgcggtggttgtcgtgatcccggtcctcgtttgagcggtctcctcgatttccgttatcatggcgccgtgaagagacatgacgccgagagcgatttacattgtctcgtgtgcgtcgtgcttctcggcggccgttgatttgatctcggagatcgccagcgccgcgaggtggaggagtggctcgttgaggtgattccctccgttccggatcttcaccattggcgtcgctagttggcggctgatcttggtgcgctgcggtagcgacttcttcaaacgcgttgctaaggttggtcaccgattcccgtagtcgttctgtcaacgctcgaggtcatcattcagaacgggatcgtaaggagtttcccttagtaaggcttgaacggccctgatgtgttgggctggagtagtcgattgattcgccgcttctgcgttggcttgcgttgacgtgccaacgtcatcgatagccaatacctcctgcggcacgctcattgtcgatgacccatagtcttcgagaagatgtaagaccggtggttcatgaggatcgatatcgattacctcaacgaatcgatctgaggctggagtcgctccttgttccttgccgttatccctgacggggacgtatgactcaggagacggagctttcatggcgccgaggaagactttgtagctcgagaggttgtgattctttgtcttgtgaataggacaatagacatcccgagttggagaagtacgctgaattccacgttctttgcatgcgcgaatttcagcatggacgttgaggaaaacccagcaatcttgcagggtgtgtttcttggttttgtggataggacaccaagaccttgtggcttcggaagtcatctttgccggctcgtggttcatgtcagaagggcaaggtttggccgtatcagaatccttcccgagcttggatgtcgtcgatgatccgttctccgtttcgacaggtggatttttcgacatgaagtcgccttggtttgtagccactgcgttctcgtttccggtcattggaggaccggttgagatcagcgtcgtggtgtaaaacgggaagacgatttcgccgacttgagtccataccagcattgttgaagcagggagcgcttggctgaggctggtgttgacgttgttgtcgacgaagctggatgacatagtagtagaaccttgagtaccaaatccccctacctggcgcgccactgtcgacgggtgatacccgtagaccggatataaagggtattggggtacgttggtacaaggatctacgtagtacgacatcgaacaatcaaaatacaagaattatactggttcaggccccttggtaggtaatagccctaatccagttgatatgggattatatggtggaaaacacaggttacaaagggaacgatggaacttgtcggatccggcgagatcgtagtcgagtggattcgactagctctcgatgacttggctcctcgcagacttcggctttgtaggctgtgtgcgttgtgttggctctgagattcgatgatctatgccctccccgggggggtcccttttatatcacagatctggaggtctccaagtaggactcggagatatcagacccaatacgatacgtcgacgacctagttctgtccgagaaggactcttcccatcagtagatttcgtgaaaggtttccttaggatatgtagaaaacatccgcgtgcgcgtgggtatgccatgtcgatatgtaacgtatatcgaagggtagagggtatgcctgacccataaccctgacaacatgtcctttgttttagactagggcagtgttttgccacttaggacaagtgactttgagtcctagttaattagtgtctactaggtgtcattgtcaatctgtgtttgcacaacttctgctaaatatgttggtttttatgatgtgtagaacttgagatatcttatatcttgttgtatgcattgcatgtcactagttaaactcagttttaccaagaagaagcttcattctctagtgcatattgctggcttgatttagttgtgtcgacgttgttcaggtggtctcaactctcaacctttttcttggtttatgctttccatgccctgaacagtaagtagtaacataaatcatcagccaccaattaactgaaaaaagctttgttgttcactcgaaaaaaatatggcaaaaagggatcagccacgtgcccaggaagtgagtgttgccccgtcattgtcgccagaaagcgaagaaaagcaaagcaaatctaatcgtttctcttcactccaaaaatagcaaagcaaacacatccgtctctctctctctctctctctcccctactactatctcctcctgcccttccaatttatgttacaaacaaatcgttggttcctcttttttcttcagtttgtttcagtgcaactcagttcttggaaagaaaggttggatttttactctgaacaaagcgaaaggtaaaaccatctcttttgtaatgcagcaatttatgtatattttggcgtcctttcagttattttgtttgatcaggtgtggcaatgggcggcagcggaacgctgatctccatttaccctgaggatctcactttcctatgtaagttcagaggacttcttgagattatctaatgttgttaacatttacggatggttagccttaacccacttgtgtgggttcttcactccattaaattctcgtgtgtagttgagctggataagcggtgctattgcaatctcaaggtggtgaacaacagcgagcatcatgctgcattcaaggtccatggccttccatttcatgaccaatattttctaaaacttggcgagaaggcttgatgaaagtttgtttcatgtcaagacgacattaccgaggaagtattttgtccggccgaacacgagcattgtccagccatgggattcttgcacaataacaagtaaatagtaccttcgccgcataataagttaatctaatacgagatgtgacatatcccagtacttgtccaaattcatagtactagtatatatcacatcttgtattagattaatttattctgggacggagggaatacatgttcctaatttggccattttatggtatgccaagccatggctctcttcaggctccttgtttggtcttgatatttggatatctgcattgttcttgggtgatgtagttacgctccaggcacataaatagtgcccaccaaatatgcaatgcaaggataaattcttgatccagagcaccaagctagtagctaccagtactgacatggatgagattccccccaatactgtgagcataaaatgcaaatagatgatttgcaagctttattagtgatgcattattgttacaatgacatgactactgacccaccaactatatgccatttttgtatcggtccagttcaacaaggaagtcgataaggtgattgaggaaatgaagcttaaggttgtttatacagttcccagtggaagttttgatgattctagtattacatcttgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacggaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccacgacctttgcagtcaaccatcatagccttctcaaagataatgatccgagtgcttcaaacatttcatgccaagatctgccgagtagcgaagacaaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcgacgcccaaagaggcattctagccgactgctttttagccataataaaaagaatccgagtggttaacactctaaaaggttcacgaatgaacacacttgacgggcatccgaatagaaaattctaagattacccaccaaaaattataaaaattatggtaatgaataagtctaatagcctaggctatgactatttaccataatgagaacaggcatataacataccaaagaaacgactatggtaaaaaacaagtcattccaagttaacccagacagcttttgtagcctaaaaaagcttacaaaaacagcataacacctttctgtcgggcaccttttaatttgcattgcaataattccaaagaattatatgaccacgtaaaaaggattttatcagcattgggcaacactattatgcgcatagattgccaaagcaaaaaatgcctaagtccctaaggagcacaatgggccacgctgtcaaaaatactgggctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccattccactcgaatccaccttcaaaaagttcatcaaaatccttcccgtgatccgccgcctcaatccctcacctctccctagccatccctcgaatcaaatcagcgcattcgggtaaaatcgatggcggaagagaaagaaagctttgaaggccaatgggcgccatccgacgtgacggaggagaacctgaaggagatggtggcgcacggcgttcttcctgccaaggagatcatcgggtggcggccagcgtgcggtgaggcttttccgtcccccgatacacacgaggttgtggtcttctctcatttcttctatggcggcttcgctcttccgacctcgaaatttttccgcgggatattaagcttctatggaatcagcttgcatcacctaaacccgaattccatagtccacatcgccaatttcgtccatgtttgtgaagccttcttgggaattaaaccccacttcgctctgtttcgccgaatcttctttctcaaaccccaaccgaacaagagtaagccatgtgtagtcggaggggccggatttcagctgagaggaactctgagccagaagtacttctcaatgcccatcaagacttcaaacaaagggtggcatgcgaactggttttatattcagaatcctgagcccgctcttcctgagtactcttgtcttcctccggtgtaccaagatacctggaactctcttcctattggggatgaagcagcccaagccttggaattgatggatcgcatgctaaaactcaaagaacaaggcttacaaggagagcagattactcggcacttcatcaaatgccgattggcaccaattaaagaaagatcccgtacggcattcgagtttgacggcaagcatgatcctaatcgtgaagaaccagactctctggattttaaaatcatgaaggagagaatgtataaaatcttctcaaatgctattgtcgtcagctactcacatcagctgccagttgtgccatataatgcattcaattcgcctccgcaggtatgtatctgaaaccttcaacccatgaccaaaacataatcttgtcttcatgttgagttaactaaccatggaggcatctcattcaggaatatgtattgatgaaatctgaccccccaattactcagcgccggtctcctcgccagcacaccgttaagggaggtggagggccgacaatcagatcggactcgcaacctcaaacctccaatccgactgggcaaacaggttctcgcaagagaaagctgatgcttaacgatgacgaaggcgacgacggcaacaaatctgggaacaaaagcctacccaataaactcccaaagcataccactcccaggaaaaaactggctggccgtccaacgccaaagatcagaacatcttccaggcataaacctcttggtaccatttcgctccggtatgcttctctcatgaaaataatactgaatattgaaaggacactttgcaggaaaccatccgacatagatccaactggaaaagatcctgatccggttgtgacagagccaagttcatccaaggattctgagccgactgccgagaaccagccgactggcgctcatacttcaggtgatacagccgatccgagtgaccagcctccgactggagaccagtcggcagcaactgaaactacaacaacccaagagcccccgactggaaaccagtcggacgtaggtccagaccaagaaattcccgaagttgaagcgcagacgacgacttctcaaggaccagaggctggtaacgacgctatgattgggtcttcaaataaagaacaagaatcgcctcacgctcagctaggaacatcctcgggtaactcatcttctcaagtgatgccgatttgaataactccagcttattcgtctaatatcttggaaatacatcaggaccaccaggcgatgacgaagaagaaatccctcgcataaaggcggctgacgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcctctgggtgactgcctttgatgactttgttttctctttagcagaactaaaccatgaaccatcatgcagagaatccatcttcgcaatgaggccaagacagcaactttagaaaagctggttcctcatttgggaactcttgaagcagtcagggaccagctacacgaggccaaggagcttgccaaaaagacagagaaggaattaagggaccgaattgcccagctccaggattcaaacttcgagctgagtggttcatcaaaaggtaatcttctagatctgtcccattaatttatgttgtcataactgtatcctcaaacatttggatttcaaacagcgcaagccaccaggatggctcagatggagaaacaaattgaagtcttgaaaagagacaaagtagaattggctgcgcaaagggactcggccttgaaggaggttgaaggtaccgccagctgacaatctgaacttctctctttttaaggcagtagattttgatcataaacgtgttttgtagaccgcaaaatcaaatctcaagctcaatttgacgtcctggttggtaagatcaaaaagcttgaaggagcaagagatgaagtcgctaatgtcgctacaccacttgtccaagctatgttcctcaataacagtggtccgagtgcactcgacgcaaccgaaatcttcgacaagctgagagttgctccagatgtatatttcaagaatatcaagaaagctggaagtatgggagctagcatggcattggcgatgaccaaatccttgtacccaaggattgaaattgacgccattgatggctttgcagacgggacaagcgaagaagctgctcttgatcttatcagcaatgctcaaaacgcggctgacaagattgcaagtgacgttgtagagcaattccgcaataccgaccttcagccgagtagtaataactctgatgatgaaaaaactgattctgactgagtatgaatgtaacaaatggaggttcaacttgtacaatactggtgtatttatgctgtgtttgataattctagccaagtctttgatttcttaaaagcttttatcaagctttgttgagcctagaacccaaagaagctattaaaaactttcagtcctcgcagacgaagtagaaaaaccaaacaaggcaatgatagaccaagtaagcaaattaaattgataaaaaatcacactccattattatgatgatagcccccgactgacaacgtcaagaagaaaacttgatgttgacagtcaagatagggaagtacaatgataagtttaagcgtagaaacgacgaagatgttcaatgttccaagagttgtcaacgagtgtaccgtcttcgcgcttgagtcgataggaacctggtcgggtgacgtcagagatgataaatggcccttcccatagaggagataacttgtgccgatctcgtgtagtttgaattttcctcaaaaccaggtcgccgactagaaaggcacgggatcgaacattgcgattatgataacgtcgcagcccttgtaagtatcgagccgactgaatcaaagctgcttcgcggacttcttctaatcggtgcaagtcatccactcggtcctcttcgtagcgttcttcacggtaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgctttaatcccttgaagtatcatgccattggctcgctccacctgtccattgctcatgggatgtgccactgaggcatagcaaatcttgattccaaagtcttcacaaaagtctttaaaaactccgccggtgaattgtctgccattgtcagtgatgatccgattgggcactccaaatctatgcacaatgttgatgaagaagtctcgagcgttatctgctgtgattgtgacaaccggtttagcttcaatccacttggagaatttgtcaatggccacaaaaaggtgcgtgtaaccgccgactgcctttttaaacgggccaaccatgtcgagcccccaaaccgcaaacggccaagacagtgggatggtctgcaactcttgagctggtagatgaatttgtctggcgaaaaattggcaaccttcgcacgtgcgcacaattttgtcggcgtcggacactgcggtgggccagaaaaaaccctgccggtaagctttgccgacaatggtgcgtgcggcagcatggtttccgcatatcccagaatgtatgtctttcagcaattgcctcccttcctctaaagatacgcagcgttgcagaatccctgaagggcttttcttgtacaactcagcttcatgcataacgtaaagtttgctccgccttgaaatccgctcggcttcatctttgtcttgtgggagttcttgagaagtcaaaaatcgtatgaggggctctcgccaatcggcttcaaccagagctacgtcatgagtgcccgcaatttgagtagtatccttgtgaggtacggtcggcgtataaaggtgttcgacgaaaacatcagagggcgccacctcgcgcttggatccaaagttggcaagtctgtcggcggcttcattgttgtgtcgaagaacgtgactaagctcgagtccatcgaacttgtcttccaatttgcgtacctcttgtcgatatgccatcatattgtcgtcaaggcaggaccactctttcataacctggttgacaaccagctgtgaatcgcctcgaactattagacgctttattcctagggaaattgcaatccgcagtccatgaaggagcgcctcatactcggcgacgttgtgggatgccgaaaaatgtatccaaagcacatagcttaatctttctccagttggggaaatcaagaccactcctgctccagtgcccgaaagtcgttttgatccgtcaaaatgcatggtccagtgctccatcttctccgcgggggtatcctcctggcactcggtccattcggcgacaaaatcagctaacgcttgggacttaattgaaattcggggcttgaatgatatgtccaaagacatcaactccaaagcccacttagcaatccgcccgtttgcttcgcggttatgcagtatatcaccgagtgaaaatgatgtgaccaccgttaccgagtgactttgaaagtagtgagatagcttcctggtagtaattagaataccatataacagcttctgaacctgagggtacctcgttttggagtcggctaggacttcgctgacaaagtaaatcggtcgttggactttctggacatggccttcttcctcgcgctcaacgaccaagactgtgctcacaacctgggaggcggctgctatatacaacaacaacggctcctgcgggtgtggtgaggctaagaccggtggctcggtgaggagtttcttgaaatcttcgaaggccttctgtgcatcgggtccccactggaagtcgtctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaattttctccgggttggcttggatgcccctatgagacaccataaaaccaagcagcttccctgacggtactccgaaggtgcacttttcagggtttaatttcatcctgaaagcgcggatgctcgcgaaggtttcttctagatccgagatcaaatcatccttttgcttggtcttgacaactacatcatccacataggcttcaacgttgcggccgatctgcgttgagaagcatctctggatcatacgttgataagttgctcctgcgttttttagtccaaacggcatggtgacatagcagtatgctccaaagggcgtgatgaatgaagtcttcaagcagtcggattccttcagtcggatctgatgataccccaagtagcagtccaaaaaactgagaagctcacagccggcggtcgagtcgactacctggtcaatgcgaggcaacccaaaaggatctttagggcaagatatgttgaggtcagtataatcaacacacatgcgccattgccccgttttcttccgaactagaaccgggtttgccagccagtcgggatgaaggacttctttaatgaagcctgctgctaacagcttggttaattcctccttgatcgcgtcttttctgtcttgtgcgaatcggcggagtcgttgtttgataggcttggcatcttctttgacatataaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagaaggatctaagggaatctttttagtcttggcttcgctttctccactttttgaaatcttggtagcgggcacttctccttcgctcgccgtggctgcagccagtcggatatcctctcgggctgacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcgtcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccgccgtcgatgagggttctgcgaagcttgacattacggaccactgggtctagtaccagggggtaccgccccgggtggaccactcggtcaggatgatccgagcggtcaaacttgattgcaatttctgaccatcgaagatactggggcgtgtcgggctgaacagcattgatctcccgttcagtcaacttttgcttccttttagactcataagccagggggccgccgaagatatggttgagctccttgcggtggtcttgaaatcctgccggggtgtcgccgtcgtccttcttcctcgacgtactttgttcttcgtcggagttcttccgtgtagtcttggtgtattgctccgcaaactgcctgtagacgaaacaatctttggccacgtggttggagttaggatggtgcgggcattgggagttcatgatcttgtcgaacgtgttgacgcgcgaatgctgtcgagaagagtgagtggcggttgcaacaagttcctcaggcttacgcttgcggtccttatgattgttacttccacctcctcccttagccggcgtacccttgtttggcttccaactgggacctgactgctttgatgcggtgacggcgtcttcggccttggcgtactcgttggctttttcgaacataagcttgactgtcttgggaggcttacgcccgaacttgccgaccaattcttcgtggcgaatccctttggtgaatgcggcgatgataacgtcgtcggtgatgtcggagatcttgttacgttgttcggaaaatcgtcggatgtaatctcgaagggattctccagatttctgaataacgttgtagaggtcgtattgtgtgccgggatgctcgaaggtgccttgaaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagatggtaagccacgattctgggttagtggtaccgtcatacttctctattccagtcggcttgaagccggctggccaatccactcgacgcaggtcgtcggtgaaggctgctactccgtcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggtgagtgaacggaccgctcgtcgtgacccctgctcctgcgattggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgatgagatcacgcgctcggcgccctacttccaaagctcgctgccgtcgatcctcagcctccttcgcggtccgctcacactcctgctgctcacgccgtagccgttcttgttcttgtgcttgatgctcctcctccagtcggcgacgttcagtctcgcgacgtgcttcggtctcccgggcttggcgttgctcctccgtctcgttatcagccatgaagacgccgaagtagagaggggtgtagttgtcatctaggcttccgtcgaagtcgtcgagatccgggtcgttgtagcgagagctaaactcgtcgtactccacgatgtcggtggggcgcgagtcgacggtgggagaactgtagtagccatccagctgatccgtcgaaaccgtgccgagtggtaagaggatgacgccgacttccctgaagctaggcgaagtcggtgttgaagccgacttccgcctaggcctacgggatggagacgctgtcgtgatggagacggccgccaaatcgtcggggagcttcatcaggatcggtgggtaagccccatcatcttgatctggtgacgttggagaaggtgcgatctcacccgagtggtttgaagccaactcgattgagatggtcttgaagtaactttcagccgcgtttgggagtccaaacggggctgaaatccggttctctcccgactggtctgacaccgagtcaaggagagagatcttgccgttgttgttggtgacgaagtcgaggctgccgaaccgaaacgtctgcccgggtgggaagacgaggtcgtcgatgccgaagacggaacccattgcactgatcggcgaaaagcttgacgcagcccctacctggcgtgccaactgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacagaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacacatctttaggaagcatgagcttcaaattggggtctgacgatctcacggtgagaatactatgctggaatcttgtgtaatgttgagcaaacttctgtgcaaggggactcacgttttgcactacaactatatgcagatgttgaggaatgcaagcattgaagaggtaatgcgattgatcctaaaggcatttatcattttattgggaaactacacctagataatagtatgacaataaatctctcatgaattctgacaagaaattatcatgccatttcgggcattaccatgataatgcttttctagtgagaggagtaatgattcatctaaaattactccataagagttcttttattttattcacaccgttttctggcaggtggggcccgcgcaccttcgcactctctgttgttcgtggttgccgccgtgccgctggtatcgaaaggggaaaaaagaagtggtggcttgaagaataggctaacttagctttggctttggctagctcgctttcgccacgtcggatggcaattcttttttgtttttttcttggatatgatttatttctctctctgttttttttttgttttaggatttctaagtactgcttcctctattccaaaatgtagctatttatagcacagtagcttgtcctaaaatgaaactattttttttcatctacctccttcaaccaatcacaaccatttttcatttatttatttcatcaactttctattcttaaccaatcacaaccttcctttaatcatttctatcaactttcttgatacacatgcccatcttaaaaatgcctacaatttaggatagagatgtgctagtggttcttttgttattgacacgtcacctcactcttggcgttgtcatatggtcaatttcagcgacatatctgttgaagtcacaaaaatatatactccctctattccaaaatataaaggattttggatagatgtgatgcattttagtactatgaatctggtcaagaaggaatataagaacttttagtgttggacacgattattaaaaaagtaggtagaagtgagtggtagagggttgtgattggatgagtagtggaggtaggtgtgaaaagtgaatggttaagggttgtgattagttgggaagagaatgttggtggagaagttgttatattttgggacaaatcccgagggctaaaagttgttatattttgggacgaagggattatattttaggacggtgaggtatataagaagatgatgtgatacataggacaatcaaacaaatattataaattgatattaaaacataatgcattgggggtgttcagtctttcctgcaagctgcaattgccaccgtgaactactagcgaatacccccattgactaacgttgtggctgattgtctgtcctcatttgtctaacgtgtgatatcagtctatgtgtaatgctcttgacacaaacatcacaacgtttgcaatgctctatcagtagacacaaatagtcaaataggtataagagaagcgtatgctaattatgggaagaatgcttgatgtgtctatagacataagttgaagtatcctggagcacgattgcttgatttctaaaacaatattttcaacaaccacaggtgctagcttgcaacatatggattttcccacaacggcgtttggattgaattgtttttagctataggattgaattgttttcagctagggtgcccattatgttttcagctatttgatgatctccttttcatgaacgtgcaaaaggattacacgtcaatacattagaagaagcatatttttttaaaaaaaaagaaaatacacgtcacaatggctgaaggccattgtcaaggaacaaaaggaaaaaaaaggcttttcttggctcttcttgcattatgctctatcaatatacttgcaacatatgttcttttccacgacaacgtttggattgaatgcttttaggtattggtttgaattgttttcagctatttgatgctcttcttttcacgaacgtacaaaaggattgtacgtcaatatattagaagcagagtttttcaaaaatatgcatgacgcaacaactggatgccattgtcaagaggaacgggagaaaaaaaaggcttttctccagggacattgcgcaaaagaataaatttgatgctctcatgttctatcaatatataaggcaatcttcttgttttcttttcaaattttttttccaaactcaaactcgtgtctccactgctatccaatagaggtctttctctagtgctagccaagtgttgtccattaaaatttcaactacttaatcagcacgcacagacctatatcagtccctagtattggttccaaccgatcgagtgatgtgctctcatccattcattgccagattgtccgtgcaattgtttattttcattgtcaaatatatgaaacttaagtgataaaaatgttttttttgtttgtgtcaatcgcattgtttcttggttaattctctaaaagtgataaaagttttttttttttgaaagtgcaacctaatgaaatactagattttgacatgcatcttgtgtttctcgtgactgcaagaatatcaacctgtcactagagaaggagaatagagaagattaaaaagatatgcaaaatgaggtgtaccattagcgtatgataaattgagtattaatcattttaaacctgaaaaatggattaatatgatttttaaaacaactttcctatagattttttcttaaaaaacacaccgtttagcagtttggaaagcgtacacatgataaacgaggatattttcttttcaatgtgcttgaaacgaccaaggattgttgacatgtcctttgttttagactgggcagtgttttgccactaaggacaagtggctttgagtactaaagttaactagatgatgttagatattgtgaaatggttaaatgatttgggttgaaatattatgaaaatgatttgagaatgatgatttagtatgtgtatgtttagttttagaatgaaataaattgtagatataattagtatatgcttacatgttgagccttgtgtgtttagtgtgttgatgtgatatgcttgcatgttagattttaggagtgctaataaatactatgcttgtatgttgagctttaggtatttaatgggtattagctttatagaaagaataagggattagtgtctactaggtgtcattgtcaatctgtcattgcacaacttctgctaaatatgctagtttttataatgtgtagaacttgagatatcttgttctatgcattgcatatcactagttaaactcagttttaccaagaagaagcatcgttctctagtgcatattgctggcttgatttagttgtctcgacgttgttcaggtggtctcaacctttttcttggtttattagtcatgccctaaacaataaacagtaacatagatcatcagccaccaattaattaaaaacagctttgttgttcactcgaaaaaatataggggaaaggaaactgccacgtgcccaagaagtgagtgttgccccgtcattgtcgccagaaagccaagaaaagaaaagcaaacacatttgtttctctctctttctcttcactccaaaaatagcaaagcaaacacattcgtttctctctttctcttccctgctactcgctcctcctgtcctaccaatttatcctcgaaagaaatcgttgattcctcttttttcttcaatttgtttacgtgcaattcagttcttggaaataaaaggttggatttttactctgaacaaagcgaaaggtaaaaccatctcttttgtaatgcagcaatttatgtatattttggcatcctttcagttaatttgtttgattaggtgtggcaatgggtgccagcggaaggctgatctccatttacccagaggatctcactttcctatgtaagttcataggactttttaaaaatatctaaagttattaacatttacaaatggttagccttaactccgttaaattttcctgtgtagttgagctagataagccatgctattgcaatctcaaggtggtgaacaacagcgagcatcatgttgcatttaaggtccatggccttccatttcatgaccaatattttctgaaacttggcaagaaggtttgatgaaatttttttttcaggtcaagacgacatcaccgaggaagtattttgtccggccgaacgcgagcatcatccagccatgggattcttgcacaataacaagtaaatacatgtttccagtttggctattttatggcgtgccaagccatggctctctttaggctcattatttggtcttgatgtttggatatatatatctgcattgttgttcggtgatgtagttacgctccaggcgcagaaagagtacccaccagatatgcaatgcaaggataaattcttgatccagagcaccaaggtagctgccagtactgacatggacgagatcccccctaacacggtgagcatacaatgcaaatatagatgatttgcaagctttattagtaatgtattattgttacaatgacattgactactgatgcaccaactatattccatgcatttttgtggttcagttcaacaaggaagtcgataaggtgattgaggaaatgaagcttaaggttgtttatacagttcccagtggaagttctgacgactctggtattacatctttaggcagcaggagcttcaaattggggtctgacgatctcacggtgagaatactatgctgaaaacttgtgtcacgctgatcaaacttctgtgcaaggggactcatgttttgcactgcaactatatgcagatgctgaagaatgcaagcattgaaaaggtaatgcaattgatcctaaaggcagtaccattttattgggaaactacaccaaaataatatgacagtaaatatctctctaatgaattctgacaagaaattatcatgattcatggcttcctaatatcatcttatgcatggatactctgctgcctctacatgtgtataatgcttttctagtgagaaaagtaatgatcatctgaaatttctccataagagttcaaatgcaagacacgcttgtgaagtgatattgagatgctggcattgattagaaagttcatgtctgagaattaggaagataatgaagcaacgatatagatggttgaaatgatcataaagtagtttcctttatcttgactgacatattccaaataagcaatttggataaattttttgtttcctaaatctggataaagagtttgccttattaaatgtgccttgtcttatggcaattctctacaattttaaccaagcttgtctgagcaaagaaacatcttttgtgatatgttctgttatcctttttgtttcttacttagttccttgttttcttctatccagatacagacaatacaacgcctaaaagacgaacgagacaccaccctgcagcaaaatcagcaaatgcaacgtgaattggtcagccttttttttttcttttttgcacttcattttgttttgtgatcatcactttatttcattgtagcttttatgtttctcaatattgacacctgaactgtgaaccttatactgctcttgctcatttgttatcatttgaattcgcgatgaaaaatgtttagcatggagaaaaaacaattggttttgattaaatatatatgtctgactttgagaaaaatgcaaaagaaattattggtccttggtggataacaatttttatatttctacaattgtgatcgatcaacttttcattcataatgcaactttagtttgctcaacatttatttctttaatgggtcgctgaaacaaatgtgtcaagggaaacaaaagcaaatcaataaacgtttcctactattttacagttgaaactgaataattgtaggaatgcagatgtgaaaaaaatcccattgctccaagcatttcatggatgtaaaatatccttgttagcagtaaagaattcaagatgaatcgtttgtgtaccccctttctcccttatattgtattttctatttattatttgcattatatatatttttttcaggatgtgatcaggaggcgtagaagccgcaaaagcgatgcgggtttctccttaacgtttgctgcttttgctgggctcataggtgtcctgattgggctcttgatgagcctcatcttccctcgcccacaggctgctgcttaataaaatgccaatttcacaaccaagtgatacatgttcagcttaatgcccaacaatgtggccattatcgatcaaacaatcatagctaggttaataatcgagtcagctgctctggggaggaaaaatatatggaaaattctactttagtctcaattattcttttgttctttgcattgtagttaatatgcgtcacatcagaaaagggtcacaatgtttcatcaacccaactcccccttcctttttttattaaaaaaattgtattttcccttcttatgtaatctttttgtacaatttagtttgacataaacatatatcagggagaagctgtatgcattcaccgattggatataaggtcatgctcagtgaaggacaacttcatgagctctcctcatgtccctatatgttcgattcgataaactaggataggtttgtacgtgttcgatatgataaactggtcctctcatgaaaaaatattctctagaagagtggtaagagggctgcctgggccaccatcgttagcacggaccggcgatcatttgccacgtcaaaaaaaagatctcttggaacccaaggatgagggttataaatctgtaatgctcctatagtttcttctgtacataatcagccgttgccaagatttgagttttaaaacttatttaaagttgatttgaaagtttttatccgaagtttatttttcagcaatggcacttaaatagttaagaataaatatataaaaatttgattgacaaattattaatttagccaaatattaacaatgcgccaaatgacatattagcaacaacaataataataaaatacttttgtaaatatgaaaaaaataaatgtaaaatttaaaaaaagttcccctcatccc

SEQ ID NO: 58311 - DNA, 54125 bp, Oryza sativa
gctgtgccgcacgaacgccaccgagtccctcacgtcatccttcgccgccgcgcacgacaccggcggcgactgcagcttcttgctcggcgacggcgccacgacggcgtcggccacgccgtacgacctgcagctcagcgaccgcacccacgccgtcgccattggcacgacggcgaacgcacacacgcccaggacacggacctcgccggcgacgtcgtcggcagcggcggcggttgagctcggcgtggacggattggtggtgatggccgcgagctctggcttagctctgggcgttattatgggggagggtggatttatttgcttcctaccctgtgctgggtcactgtgccactggcattgcactgcttgcctccaagctccctcccctatcacacccacacactcccaacctcacccccaatgacaggtgggtcccaccactgaagctacattgtgggacccagtggcagtgagtgggcatttttgcaataaggtttgtactgcagctttgggttgggtactcttttgagctgtggtgtggtgtactgaatgagagagatttgatttgggataaatcttttcgaaatttgttttcatttgggctcatgatttggggggaatgggcccatttttcttttttttgagtgaagtgtggcaatgatcatttggatttggatgcctttaggacctgtttagatcccctagtaaaatttttcatcctgtcatattgaatgtttggatacatatgtaaagtattaaatataaaaaaaataactaattgcacagattgcgtgtaaattgcgaaacaaatcttttaagcctaattgctcaatgattggacaatgtgatactatagtaaatatttgctaatgacggattaattaggcttaataaattcatctcacggtttacaggcgaattctataatttgttttgttattagactacgtttaatatttcaaatgtatgtctgtaaattcgatgtgacacgccaaaactttttacctctagatctaaacacagtcttagtccaagaatttcttctcagtacactctctttctactggttttctttcttttcctttttgtttccttcttttgtatctttctatttttcttttgtgtttttcagagctccttttttgtgatgaagctgtgtgtgtgtttgtgtggtcggtgtctttcaccttttttctgtgtgtggatgtggagtccagtttctcccttggttgcaggcacgcgtttgatctgtctgttcgttcgttcgtggtgcttctgatttctcgtcagaatttgcaaaaaagatgcatctctttttgttatctgtctctttttttcttgccatgctagtgaccaccactttttgttatttatttcacaactattaattttgtaggagcaagaagaggacatgaactctttttatgtttttttcaacgaaaaactttgaattgaagaggtacatatcacctaaatgctcatcatttgcatttacagcgcgtccaaaattcagcttcgaacagctcgtcaattgaaagtagttaaagtttcagttcgaatacgcctgcatttttccggggtttctttattaacttctaccgtgtaatcatttctgcatatgcggctcattaaaattgtcagcaacgcggcaatatgattaatttgacggttagcatgtgttagcgctgaccagcaaaataaaaattcccccaaaatcgcacacctattttgttttttcctccgaatattcgcattattcacgttacaaacaatatgttcaacacgcatgattaattaattggttaactaatcgggtcagattttctgagattacgtacacaaagattcgatctctctgaatcgaattaatttccctattgcccagcatgcagctgcgacatcccattcgtcaacaaccacttggccaactgatcaaatcgtgtactaataatagtttattaattttcctatttttctctgaattaattgtgtgttaaagagttgacgtagttgacaaatggaggtctcgaactgcatgtgtaacatgacactgaattaccagtccacattactaagcttattagttaacttctataccttgcaattaacaagtgcctggagtctctgaaccgacgacaacctaattgcatcgccaatataatgtacttctactcaacatataacatgcaattgcatacatgttttcagatttgcgacccgatcatctctgctgcttatgcatagaaaactgacgagatgtttctgcagctaaccaacgcgttaattagtagtttaagctgaccctgataagatgcaacttaacttatgagacgcatttggacatggagcagttgccatcattccatggctctgcaactgctagtaccgagaaagctcatttcaagggaagacattgctgcatggatgcatgatcaatatcgtcagaaaaactcactcactcactcacttcgactcgatcaatcgatcgaatcctcctccaatgcctcgccgcaaagatctcaccgaatcattgcggcatcaagaacaggagaaaatgcacgcagtgttctcagcacggttctatcatctcgaatcctcaatataattgtccgagttcagtaaagcttcagtacgattctactgcaatttgtttttagttgttgctaattcaattggttggtatctttgccattggagacatgttttaatgcagtgataggctctgaaagtggtcttccaacttatgccacacctaacatcgatcacttctttacaattccttcagaattcaggctcatcttgacacctcaaaaaaaaaaaaacactgaccaaaacatgtcggtctctgaacaccacaagctaaaagaacctgtcctcttgcagattggatggcatctctcttattactaatcttttgccctcttgtagactgattggctgatgtgcaagtcagatgatgatcacctgcatttgccaacgacgacctaatcaagagtttttcctagcagggcaagtattcttcagaaaagagaatgtgtgcaagtgttaacatcaggatgttgtggtctgaccaaacaaaccaatatatgtatacaagattgattccagccaatgtgctacacttgtacagcatcccagctgcctttgcttatgcttggtatccaagagaagtgtactgtgctagctagctagctgatgtacatgtaccagcatatctaatctaatctactgtttgatcagcttctttgtatacaatgcactggtcttattgtagtagagtactcctccgtttcgaaatgtttgacgccattgacttttttaaatatatttaaccgttcgtcttatttaaaaaatttaagtaattcttaattcttttcctatcatttgattcattgttaaatatatttttatgtaggcatataattttacatatttcacaaaattttttgaataagacgaacggtcaaacatgtgctaaaaagtcaacggtgtcaaacatttcgaaacggagggagtactaacactacaagacaattgtgtgtcaatgccttggggtagttggattggatggatggttctgcacttcagcttctccgtggatactgtagtttaacgaggtttgcttactgctccccagattatcacactctgattgtcgctttcagatatggataaccagaggtaaacagtcaggaaaagtaactaattgaagtagtactgtagtacataatggccgttgcttaaacagagaattggagcggttagcgaaagcgtcgatgtcaggtaagacaagaggcatccgtcatctatcggtaaacggggagcaagtgcatgcatatgcttcaactcctttcacggtaagtaaattagatatgggctggtaaaaacgaagcaaaagttggcatacacttgcatttcagaagcaggccaggttgcaaaaggccaacgagaaaggcaccaacttttgcattttttgacacacacagagagagattcgagagggaagagggagcaaatgctagagggcagcagatgggatgggaatattcaaaagatacacaagtaatataaaaaaagagagagaatggaaaaggaagagattgtgagatggcaacaaaagcagagcctggaaggaaagatcaaaagatgcgagcaaaggcagcagcagcagctgcagctatagtactactcttcagtcttcagaacagaaaagaaagcatcagaatttggaaccaactaccagcacagattgttaaagaggagtgtatcctacagtacagcatctgtacatgtaatgaaaaataaaatgtgctttatttttccgtgaacgcgtaaaaaaattacactaaaaaaaagttatagttacacaacgcaatcagctagaccggcttatgtcagagaaagagagaaaaggcaaaataaaaagctgaagcttagaaaactacagcggctaaatacaaactccaagcagcgggaaggggctgagctacgctatactctcaacaagtcccaaaaacagcaacgccagctaaagaccaaagatagccctccttgtgaatggactccagaaccaaaaatgtgctttagatttcgtgccactgtctcactgacccagccatgcagtggctgccgccattggagagcatcagaatacttcttcttctactacaaatagtggcagcaacagtagtaggagtacgtatggaaatggagaaggatatatgtaactggggattccgaggaggacgacgacggccgggcagtgggccggcggcggcctgaatttggaggcgacaggcgagctcctccggccggcacgcggattggtggggggatcgcctcggaattcgggccgagctggctttttttgttggtgttttggttggcccagctaccactcgtaataaagcttagtttgcaccttgcctgcacgcattgggctgcctaaagccttttctagtgctaatagtactgtctagtttggcttgatcagatcatcactcccagacatcatttctgatcaccactagtactctctgtacaaaaagtataaaaacctagtatcagattggataggataatccctagtgctttctaattcgtaatactacaaaatatctaatactatttttagtgggagagagtacgcattttgtgttgaagattaagattttcgtggcacgcttttcaaactgctgtttcgtgcgaaaactttttatatgaaagtcgctctaaaatatcatattaatctattttttaagtttataataattaaaactcaatcaatcttacattaaaaacacctcgttttacgtaaaaaaattaatatttatcttaagaaaagaacaccaccatactcttctctttttctttcttgcatctcatagaaaacgtcccatgtgaaatactagatctctcctcctttgctcataggtgaactgataacctattgttgcatttgtgctactgcaaaattcagcagcacgcgtgcatggtaacaccaaaaccgagttcatactacggacttgtcatctttttacatgcgagcagagagctggccaccaattctgtcactgatctgcctgccagcaaccaaaaaagcagctctcctttcgcctgcatatgctgtacaaaagccccccgtcagagattgcagctcatctaaaacatgcaatgttcagtgcacatcgtcgacagagcaagacagcaacaacctcacgttcttggacgaagctagctagctattgcaatgaacagatacaaacttttttcaggaaatcatgcggaggaacgccaaattttactcagagagatggagatatgatagtagtagtaatctgcttcaaaaattcaggtgattttcaagagagttcgatgctgctgctgctgctgggctaatgctgtccgtccactactagttgccggccatcctaatgtgtactggatcgcacattggaaggtgaaggattaacaacgtttttttggctaagctacctgttgctgtccaaattatcaggggaatcccatgcccaaaacccaaacaaaatatgccattccatatgccaatgcaatgcacacacacaccaacccaatctcaaggaagaacaagaacaagaacccggtgatgttgactcccacatctctgggccgcctcgccttccggcccaacatgtcctcccacccggcccatctaaaaaaccccatccggtgctttgaaaaagtcaacgcgaggtgggccccgccggacagcacgagtacaggccggaggcagctgagcctgacgcggtgacggacacgtggggaccacccgcccggcccagcccagccgctgccatgtggggcccacaggggatggatggaagccgcgcggaagcgttaggcacaagggggggggggggggggggggttcgcataaaggcgaaggcgaagaggccaactcggcgcccggattcggacgccgcgtggggggaggaggaggaagacggcgaccctcgccgcgaataaacaattccaaatggtggccgccaccgcatccaccaccaccgcgaggacgacgaggagcatcaccacgcgtactctgcctcctaccacctagctaggagctaactaggtcgtcggtgctcgagatcgggggagggaggcgcgatgcgggccagggagatgcacccgctgtgctgcctcgtctccgactgcgcgttgggtgaaggcgccggagggggaggtggtaagggggaaggaggagactgctcgccgacgaagccgccggtgggggaaaagaagaaggtggtgccggtggcgggggtgctgtacaagtggaccaacatcgggaaggggtggcggccgcggtggttcgcgatccggggcggcgtcctggcctactccaagatccgccgccgcgtcgccgccgagccgcctcccgaggccgccgccgccgccgcagccaacggcgtcaggctcatcggcgtgccccgcggcggcgtcggggaccagcccatcggattcgtccctctcaaggtgacgcgcctcctctcgcattttgtttttgtgttccgtctatttcgatcgatctcgagcccctactgcttacgatcgacgaaattaaatcgctcgttcaattcaattcaaccgcacgcatttcatcacctgatctgtttaccggtagtagagcaccaatttctccagccaaattttagttgcgcatttgcttccgcgaatcaaatatctcccacgagtttggtgcgccggtttccgcgcacagatcggaacagtccagtccaaccgatgctgcatctcgcaaagcccgacgcggcgtggccgcgccacgagccgtacgttcgccaagatctacggccgagatcgctagcaagcaacagcagcagcatcacatccacactggtagtagtagcatagtacaatggctgctgctgctgctgcctaacgcttgtcggataaagagatgccttgcttggatcggagctggagcagctgggagctggcatttctcaagcgcaagcaaagctcactcactgtgaaagagcagtcttcgcatcgacttttagcgagctacagtggcgatctttgtcatggcgtgctcaggggaaggagaggattagggcacgggaacgaccggatcaccagctggactttgttcagaaaggattgatggcatggcgcctccacttggatggcattgcatgtccgtgagttgttgggaatgtaaggtggtacggaccacactgtctatagccatttatatggcctgggagcttttcccccctcttcctcttggctcctgcttcagtcagcgggctttatgttcgcttgtcttttaggcatctgtttttttttacagtgctcagttatgggttttttacaatgcaggagactgtcgagatttaagtgtactgctataggtttgtaaaaaatctatttctgggatagtggattgccagcacagacgaatactagatgtgcatttgatgaagagattgcattttggtgtactgttgctactctggttgctgattctgtaattcttttgaattgtttgtagatctcatcatttagcgaaagtaaatcggatgataaacggttctacatcattaccccaaccaagacgcttcagctgaggactggctctgctaaggaccgtgtggcttggattgaagcacttgtttctgcgaggagtgaatattctcttaacgggggtgtaccgtgtgaccagaatgagggatcattttccactgaaaagcttaggaatcgcttgcatgctgaaggtgttggagaggcaactattaaagactgtgaacagatcattcactcagaattttcacagtatcacactcagatgaagcaacggtgtgaagactatttaaacttcattggcagtcttccaagggaacttgaggtaattcgttcttagagctcatttagtgatttatataagcaactcattaagttcccatttctgatagtaattctgaatatattccaatttaatgggatttatataggttgttaggacttttgaatctagcctgaaagtcaagtaataaattgattgtatgttatctggtggtctgaaactgtctgctgattgtattatgttcttttaggtagttaattcgggagatgcatctgctattgagaagccacagtcggagttgttcaaacatgactgttccagctctggaaaatgtagtggtacttgattttattttagttgtcctgttttcttttgactgttttgattagcattatatcagatgctccatgtgcatgaaatggtgttggttgcactttccaagcatatttatattgctttacttgtctatatctggtcctggtacatcattgcactttatgttattctccttggattaatctgaaaatgaaaggatggaaacagcttgaaataaaccacttcctttagttctgtgttgccgcattttgcccacaactacatgctcctttttgtgttcttgtttcacgagaggtttgaaacatggctattttctgatatttttatttttattatatcagagtacagcaacactgaatcttctgatgatgctggcaaacaagaggtagggcagttgtcagatgaggatgagtttcatttctatgatacaaggcaaagtttcagtgacactgctgcaagtcctgacttgaaaatgagatgttcaaatagtgggagtggagctcacaagtttggtgaattactagctatcgacaagacgaatgaatacttattgtcatcttcaaaacgccgttcagagttacccgtaccaatagaaaaggagaaaggtgttagcctttggtcaatgatcaaagataatgttggcaaggatcttacaagagtctgtcttcctgtttactttaatgaaccattgtcttctcttcaaaagtgctttgaagatttggagtattccaatttactggatcgtgcatatgaatatggttcaagggtatgcttatttctataacttccacctttattgtgaaataaactgctagatattatatcattctgtatatcacaattgaggagcataaactttgtcgtactaaaaaacccacgaaattgctgtatcagtattttggtgcagttaattaacctcaatttattcaactgtgttgagttgatactcatatcttaatttgcatatacatcagggaaacgggctgatgagaattctttatgttgctgcatttgctgtctctggatatgcttccacggattctcgcccctgcaaacctttcaatccattgttgggggaaacatacgaagctgattatcctgaaaaagggatccgtttcttctctgaaaaggtcagtttggcatccagcccattcatgttcaggttagaatttgttgccatttagtctagcactgtcaaattcttctgtaaataattgggagatacgcaatgtgaagtttgaaagcataaaagtggcagacactgttctgatgccaggcacattaatattcttctctacatttcacacaacatatgagttaatttgttagtttattcttgtcaccaggttagtcatcatccgatggtcatggcatgccattgtgaagggaaaggttggaaattttggggtgacagcaatctaaagagcaaattttgggggcagtccattcaactcgatcctagcggtgtgctaactctacagtttgatgatggagaaactttccagtggagtaaggtacaaattcttcactggaggcaaaactcttatgcatattttctctccattttttccattatgtttgtgcatgcttggtctagagatctggagaaggtgttggatatccttttgtcaataaacacctatcatttatttattttgccatggcaggttacgacaacaattaataaccttatcattggccgagtctattgccatcaccatggcacgatgaacataagtggaaacaggcaatattcatgtaagctgactttcaaagagcaatccttcctcgatcgtaatcctcgccaggtatgatgaacaattttccatccaggttcttgtttctttcatcttcctgtagaggttactaaaatgtatggtcgtatgaaaggttcaaggacttgttacggatgctaatgggaccaaagttgcattcttgatgggaaagtgggacgagagcatgtcttgcatcattggtgatgatgcttctaaagtgaactcccgtaatgcaaatcagagtacgggtgccactttattgtgggagaaaaatgtgcctccagccaatcccactcgatataacctgtcatcatttgcaatcactttgaacgagttgacaccaggtcttaaggtatgcgcaaagcatataattcgcctattgttagttttttgtagtgcaaagcctaacgtactatttgatgatttgttaaggagaagcttccaccaacggattcaagactcaggccagatcagcggcatctagagaatggggagtacgaaaaggctaactctgaaaaattgcgcctggagacgaggcagaggatggtaagtattcttgttctaaaaatttccttaattttttttatcacagtttttaaattcttacctgcttcactgtactcgtacatcgaactacactgaattttatggtcttttatcactgcacttttatatatgtccaccatctgatgggagtgaatcactgccccggagaatcttgattctcgttacaaagtgcagccagaacacctatttccttcatggaaaaatgcagttattatctgctctaactgcagcggttatctcttcctctacaggcaaggaagatgcaggagagtggttggaagccaagatggttccaaagggacacagaggatggaacattccgttatgtcggaggttactgggaggcaagggagcagaggaaatgggttggttgcaatgacatattcggcaataatgtgtccactctttgcaccagcgcaagtatatagagaaacttctgtttagtagtcgttgacaccccattaattattgaagacggtacatagttgatcggctgctcccgttgctaccatgcaaacaagagctaacatgctctcctcttgtcatatagaaacactgggacatttatgtggatactgggatacttaactgtgaggcctgctagctaacaatgttgttattactctcagtgatatccattttttcaatctttgtactgttccacagagatactgagttatatacttggttcctaattgtaattgatcatgtaagcttctatgctcatggtcatggataatggacgttcatctttcttttttgacctctgtgccaagccaggcgagtaatcttgtcctgtatagaaatgccaaattaatatattcaatttcctgttacgatttacgaatatcaaaatgctcagattaattaagatgctaatacattgatatttacgggtttttttcttcatgcttaatatagacgggatcgtgtgtcggggatggatccaacatcaagctagaggggtttatcttccttatccagccatccctacccttcttcctcctcttcttattacacaaatcgatataacagaatatgtaataactctttgctccctcttaggaaaatcttaagtaaattaaaggacttatgcaatactaatctacttcgtatagcacatctcacaacactagtccaaactattaatatgttttaaaacttataaatatttttataaattacactatattttatatattattgtcgtgatctctggacacggacaaagttggaggatagacgggaaagtacgaattctcgtctatcctgagagtgagctcaaaagacaaatgccaaaagtgagtaaaagtatttttctctactgatatgctccttgttaaaggatcttggttggtttaaatagtgctcagccgtgtactcaagatttacaagtttgccattgcaggattatatgaagttatcatattacccttaggggcatattggtacatttcagtcgtctcgacatctagtgccagctggtgagagcaattgaggtggtccccataacacttccctaaaatatattatttgttcgatggtactttcccttaactttgattgcccgagttgaacacccgtgcttggactcgaacaagctctcccaccttttggctcctcgtcacttcatttgctttagccaatgaacctgctcaaatacaatgtcactagtgatgttaggtcaagccaagcaaacttactcgaacacattttccttggaacaagcgctcttaggcaaatgcaaattcctggtcagaagctgatgcagatgggaattttattcgagcaaatagtcgctcgaatccaatttcctcgctacccatgttttcggccgagcatggggatggtgttcagccccgctacaacaattataatattaattagacatttatttatttgtttgtattagaaatttaggtggttttcatgttcctaggaatatttgtctctatattagtgtccggtcgtattctatctttatttctattcgagataacttttatttgttttcgtatctgagctatccgtatttgttttttatatccgataaaaatacgaaaacaaatatgagatatgcgtattattcgtcctcatccgctccattttcatcagtatccaatgtgccctcgctgctaccgttgcttagctagttcatctaggctgctttcgtttgtgacggttgggaacattcccctccggcacgaaaaacaaagcagttcattagcgcatgattaattaagtattagttaaaaaacttgaaaatggattaatttgatttttaaatcatcttttctataattttttttaaaaaaatagacagactgtttatttgtttaaaaaatatgtacgcagaaaacgaaagaggggagcaggaactctaagggccgttttggtttgataccaaaaacacaccctaccaatttattggcaaattgaatagtatgtgtgttattttggattgaagccaaatatttggtagttcccttatactatttggtcattttctagaagtttcttcactgtactatgagaatttgactttatattggtagcaatccaaatggtagccaaataattttaccctaccaatattttggtagtgccaaattttgcctagactttggcactaccaataaattggtagggtagagaaccaaacaagccctaagaaacggaatcagccctaatcaatcatatcttcctttctcgtggggcctctaatcatcttcctttgggatagtggttgagcagcggttatcatgtagtcgagtcaggttaggccaaatcacacgtcgacctttgcgtacgtgttgggcctcacctgtgatggactgggccatgctcagctttcatttgggccgcctcgatcggctactttggtttagctgagccggtcaagtgggttcggggttttcttctccgaacccttaaatttttgggtttgttggaaccatgccaccctaattttgtaaaatttgagatatgccacccgtatctcaatgacatgtaggacccacatgagtcaatgacatgtgggtcagggtgacatatcacaaattttataaaatttatgtggcatggttcaaattttctctaaatttttctcttctttcgttggcagcatgcagatgagctgccgatccagccaccttggaggcttccagacagttcgatcgagccgcccttaattagctcatgaacctctcgtaacaatatttattaatgccactaaaactgatcgatatatgatctctttgccttttgcttgctttaattccaagtgcctcgtgatcttcgtgatacttacaagaagatcgatgaggtgtgatcttccacttcgcttcccgtgttcctcgtaatgcatggtatgaggcgtggtatatttataaatgaaaaataatttataaataaaatttttatatacgtgttctagctatctaaaagtacaggctgaaaaataaacttcgttgaaaaaaaaactaaaatcaactataaatttaaagttaaaaatttaaattttaactgatgaggccggaggatcgagaggatgatgatgagtactggagagagcactacgtccatcgatcgagatcgcttgcttgccattgcatggcgtcgtcgccggtcgatcgaacaaatggaccaatcaaacataaagagcagcagctaacactgttccatatcaaaggaaatcatgacccactgattcaatcaatttatgtggagtatacagtacacacacatttctcatatgaacaaaaacttttttgtgtttaatttattgatcagattgagaggtgcgcccgcacctcgcatatgcaggaatttcctcctgccctgcacactatcagtataaaagacgtataaacatatacatcagtaatacactttgtggcaaattatacattgccgtataaatctcccccttccctacgtacgtatatatcttccttctacatacaccccacgtacgtacacattaattaactccacgtagttattacgtagttggttaattaattaattatacgtgcgatgagaatacacccaaattatacccggcgaaatacgtcgaatacaatacacgaagaagaagaagaagaagaagaagaagaagaagaagaagaagaagaaaaattcaaaatacaagaaaagaaaaaaccaaagttattacaaggacgacgtacatacacgacgcgtgcagctaactggtagctagcttgcgtatgtcatgctgacgcatcgatcggtcactattagtggccgacggcgatggtctcctcgtcggcgagctcgatgccggcgtcggcgaggcgcttctccttgtagacgtaccccctggcggcgacggtgaagaggacgaggttgatggcgctgatgacggcgagcagccagtagaagtagtcgagcctgccgtcgtcgaggttgtcggcgagccagccgccgccgcgggcgccatggccggtgaccttgtggacgatggtgacgagcagcgtgctgaagaagaagccgatggcgcaggtgctgaggaagaggcccgtgctcatggtcttcatccccttggggcactcgcggaggaagaagtcgagctggcccatgtaggtgaacgcctcgccggcgccgacgaggaggaactgcggcatgaggaggaacaccgtgggcgcggcggcggcggcggaggcggaggcggtggcgcggtggcgctcgacggccgcggcgacggccatgccggcgatggagagggagaggcccacgaagacgcgctggagcggggtgaggccgtgcgggttggccgtggcgcggcgcgcgacggggacgacgaggcggtcgtagaaggggacggtgaggaggatggaggcgatgaggaagacggtgagggagcccgccgggatgaggaagccgccggcgaggcggcggtccatgagctcggcctgcgcgacggcgaaggtggtcatctgggcgtggatggtccagaacatgatggtggtcgcccagatggggagcatccgcaccacctgcttcacctcctccacgtccgtcctcgtgcacagcctccacttgctcgccgtcgccggcgactccgccgccgacctgtcgatgatcgccgcatggtccaggaacctgcacccatattacaaaccaaacacgtcaatgattattaccttggtggttctaacggtcaaaaataagtaattttcttgtggtgtttcttggcagccaaagtaagatatattcttatcggtccaaaccgacaaagttataaagttcgtaatatttttaatttgcttagtggtccgactaacaaaaaaatattctcttatggttagcagccaacaaatatgaatatccctagacggccgatagaataatgaattttggcggttttcatgttatacttgatggtttttgaccaccaaaaaattacggattattgtagtgctacttcagatcatcaggtgacatcaactagattatagattattctcatcttgtcatgttatttttccaaaggcagaaatggatgaatcaaatattaaaaacctaaaaaatgcatttaaattttgagatgagttagaattgtgttagctaagataaaccacacaatgtttattcatggatgcggattcttcgacttaagttacttaattttgagtcgctgacatataaatttactttgctacagtctcatacattagtgatctaacagtttttttttcttttgcgggaagatctaatagtcactggacttaagtaagaggaaggtatagtaggcgcgtgcaaacaagggagcagccatgcgcacgtagcagcgcggtagctaccgccactgcaagatccaagtctttgtagcggccggtgtgtcgtacgtacgttgcatcacgcagacgcaaagagctagatgagggtttttttttgcgggaagagctagatgagttgagataggcaagagggagaagttccaagcagctgatcaatcacacgcacacgggcgtgcgtgcgtatgcagcgccgcgtcgcatgtgatatttgtcacgcgagatgctgccgcgacccgtgaccaaggcaggttcagggctctgctagtttccactggagaaaggaggaatttgttgggagaatagctgaagctatcggtcactgggtcgcggcacatgcaaatgcatcttcgtgtttgtacatgtactggctaataagccactgtgttatgtacgcatgggatgtcactatgtggaggaggaggtgctacctcgcccagtgctcatcttcacttagcaactcctactctgctttggttttgattctgtgtgactcgtccatcgtatcatgctagaatcaatcttgcctctaccgactttgttaatgttcagggtcaaagggcctttgctttctgcacgtactccactttaatttacttatgggcatgtgtatgtcgactctagctatatacctggcagatggctgcgaccatacgtcgttgggactgggctacttattaggcttcctaaaaataacttgatttgacctaccttaatggtttagatatctagtagtgctggtccaagtatatacacacctacaggcttgcgagaccgtatatctatctgtctatatatgacagtgagtggctggagtggtttcagctgtcaaaatgaagatgattttcttaagaggggtgtggttgcaaatgtcacagcaacgggccaaacagtgcgtgcctccaatcatgaactccctgaatatactcgctccatctcgtaacatagcaatctaatacatgatgaaatatattctaatactataaatctgaacacattcgtagtaatagtatatgtctcgttctctactcctagctactactaagttgttatgggatggaggtagaatatatattatgaatttaatttaatttcattcattttcctacaacctggcttgctatatatgctaaattaaaactgactactagtagcactattactagatttgtgtcaatgcgtggcccacatgaatgatgcatatgcatcttgatcctatatataactcgttcaaattaatttcatcaaaattcatctgaacttaccggctagttttgtgttggggtaataatgtaaaaaaactttatctgaatactaaagatgcagagtgggtggtgaacttaccggcactccttgctgtgtggcatcctctgcttgcccttgacgtcatggccggcggcggcggcgtcgtcgacgtcgtagagcatgtctgggtcggacggcagcggcagcgacctcttgctccaggcggcggcggtgacggcggcgacctgggtgagggggctccccaccagcttcttgaacctgtacctcctggtcccggagaggaacacggcgaggccggcgaggatgccggcggcgcagatgccgtacccccaccggcgtccgacgttgtcctgcacgtacaccagcacggtgacggcgagcagcgcgccgaggctgacgaagaagtagaaccagttgaagaagcgcatcatcttcttcctctcgccgtcgacgtcggactcgtcgaactggtcggagccgaagccggagacgctggacttgagcccccccgtgcccagcgccgtcaggtagagccccaggtagagcaccccgagctgcgtcccgtccgccgccacgcactccgcgctcgcccccttcgggtcgccgcacgccggcggccgcagccccggcgccgccgtggagatcgtgagtatcatcacgccggtggcctggacggcctcgaagatggcgatggtgaggtagcggccgaggtaggtgtcggcgacgaagccgccgaggaggcagagcatgaaggaggtgccgatgaagttggtgaccgtgttggcggcggcggcattgccgaggtgcatcgtcccggtcatgtacggcaccaggttgacggcgatgcccagcgtcgtcatccgctcgaacagctccgccccgaggatcatcgccgcgcagccccacccgccggtggccgccctccccgccggcctccccttgtagtcccacgcgtccgtcagcgccttcccctccgccgccgtctccggcaacaccatcgccatatcaacaacaacaagctcgagctcgagacagagagagtaagacggcggcggcggtggtggtggtggtggccggcggcgatggatgctgtgatgaagccaccgtgtccgagtggtggccttatataggcggagaggggggtggtgcatcgggattcgtgcactggggggtaattataggtgtgattgattaattaagggagtaattaattaagagaaatagtatcaagtggtgttatgtgggggaatcagtatctcctccaattttctaattctttctcccatgactctggcactcgttaatttaatcgctctcgagcaattattgagtacgactcgttaattggtaggattagtggaggatcaaatgctggattaggatttactacttctccaggattttcttgactaattacaacacatgtgtgtgtttggtcagaaagttgagatgatggcagtttcccacaatggacggttacaacgttaatctcaactaccacagtttacacacttggaaaatttggagaatacttgtggacaaactggattttgcagtcaagagacgttctgaaactaggagcagatacaattttgatggaacacaagtgatcttgactactgtgtatcaagatatataattttttgactgaaactttttatgtgcagggaacagtgtgtggtatgatcaatgtgtgctgcccattctctgaggctgtgatgtttagtaattagtagtagcatcttgcaaaaaaggtgaagtgtttgtagggaaaagagatgcgtgtgaatctgaaagatactactaacccgcttggagaaaaatattcactacatcagattctgatttgtcgtgtaactaggagcctcacaattaggttctcatgcatttcagcttttagatcattaattttgttttgatcatcctcgtaagtacattagttcagttaaaaccactgcccgatcgatatatatttgaaactggaagggcccaaaatatgacaaaaattcagattcagatgaacagattaattagtcggtagcaacaacaatttgaacctgcatctttctacctcgcattgaacgtatagtggtactacgacgagtgtacggccggagtatattgagaagtattttcttgagatgaagacacgaacagaaattcagactcagacgatgcccttgtttagttccaaactttttctttaaatttacagttttttcatcacatcaaaactttcctacgcacacaaacttctaacttttccatcatatcatttcaatttcaaccaaacttctaattttagcgcgaattatacacacccatcaatgtcgatttctctgagggacagcatcagctaggcatgcagcaagctatagctctctcatacagcgacatgcgttgacgttagcagctttgttgtgaagctgtgtatgatcagctcaatcgactccaccgtggatgactctgaacctgcctctccttatctctttcctgctccctgcctgtgatgtgccgacctagctagtacagtagtactagctgtttggctcttgagctgttttacagctctctcctttagttgtcttactaatatagagttaagggggcatgattaaatttaagcaattgattaagaggtaagttttggctccatgtaaatatatagctaattaacgaggaaaccagctaagctaatcaaaatacctttctatatctaattaataacactttggattaggatcctccgacgtaaagttagaggaacatgatcgctgacatatggatcccaccatcgacggatccacatatcagtgaccatgtcatttggaaagttttgtcagaggatttttctcctaacacctcatatgtttcatgactcggaagttcaatgtgtgtatgaaccaaatctcatacggtgtgatatgaaagttctatgagacaaatttgataaaaataaacgtgtgctagaacacacccacatgtacacgtacgagtgtggtgcgtacatccaacttgtactcgaaaaaaaaagtctacatcattatttgcatttttcactcttaaattattgaatgaaagtcttcttttggaaatggacaaagaatgtcaacttcctagagtaaaaaagatggaattaattgtattataattcctatcctttcaaatctaatttatttcaaatctatcagtatgaaaattggtgtcaagtatagaagcaataggattgtctcttacccccttcaaggtaagattcatgacagtcgtccctcgtcagatcaaaataaatcaacagtccattagtcctcatacaatgtgatctacctaaaaaaatccttagtttgtggctaacttccccaaaactaagataaaggataattcgtaaaaacatttagtcatgaattgtccatttctacattttttttacaaacaaacatctgcatgtccatttctacaatttttactagttagttcagaagtaaactaaactgtcttggataagatctgtcaccctctttgattcaaaggagcaaagctccaagtcagctgcttgtgctgaattttcatgcatggctccacacagtctctctcagattctttgcagattccactcaatattgtctcacatgcatatagatgtaaacatgattttactctacaatttggaggggcctagctcagaatacagacaccagagcagatcatgttggaggactttatatgctggtcgatatgctcgatcaggtgcaggctatccagacaggcagcctgccagagtgtctgtggatcacctcactgattgagcttgcattttgccgctagctgcctatgacccatactgccttaattacacttacattgataaaaacgtatgagcacgtgtgagaatttcacagcaatgacgtgcagtgcatgtagtactaactctgtcccgtaataagtttatttttaagcttccttcttcatttgttcccaaaaaaattcatttctaaagtaatcattacatcaaagtttgtgaaattgtagaatgattatactgggagtatataaagtgaacaatacttacattgggattcgataaaatagtggtattataattttttttgtatttatatgtgtatgataagtaaaaaataaacttattttaagacggaggtagtatatcagtggcgaagccaccacccatcgaccgatcaggctcgtcaatagaattttgatgttaatatatagtgattgaaaataactttttcataccaaattaatacttaacatagttttatctgggccctaaaaattttctgaatttgccactgatttaaacgagtggtagccaaaattagttgctagctgaaactatataagctgctaatcaactactctagctactgatcacatgcttgaatagaaggtagatccaggaacatttcacaggtccccacaataataatatcatgtaactgctacctataggacgatacttctgcctactgaaccgtgaacttttgagcttaatcgatgatgaggagttttaatttacagaaggaaaattcataggtccccacaataatatcatgtttgttggaaaaattcacctttttctcggtagtcatcaattccaactatcagtttcattggtatacatggcgttgacgacaaaacaaggagttgacactgtacattttgacgacagatcagcatcacttgaaaaatgcacttaaattcagatgtaagtcgtcccaacataaaaatattttctaccactccttcccattgctgcgtgcctgaccgattctgccgatgattcttcaacaggacaaaattttaagttctgaaaacgtcacacattcacattattactgaatatttttgtgcttgtatatacaaatatatacaataatacgaatacatattcgagtacgtaattctcaacacctcttcgagatccgtcagggtgctcgcagattcgagtttctctcccagggtaaatgcatcttcgagttctctagggctgtttgcgacttcgagtttaaatttttctgtcggaatttatgttgacattttcgagctccgtcagcttgattgaccactatttaattcgtttacatgttcgagtttctctctcagggtgctcgcattgtcgagttccagccccccggattgtatcaaatgtttattatatattaagcaattggcaaattgtaaggtagaactgacaatacatctggccaatgtgatgcaaattgcaaaattttaaaaattaatgtaatgcaaattggtgttgtctcatatagcctcatgcaaattggagtagtttgctgactgccgagagttcaataattgcgtgcgtaaaggtgtccattctctcaatttactccaacatccccatgtatataactatatggaaggtggattttcattcctcggggatattgatttccttgttttatgcatgtcacacaaaaagacataaaaaaaatgaaaaaaatgataacatagatcaattaatgtgtgatatattactttacaaacatgtaaattcaaatttaacttatatagataaaaataaaaacaacaaatttgactataaatagtatgtactatttgcactaaaatttgttattttcatttctaattgtgtaggttgaatttgaatttgcatatttgaggaataacgtgtctcatattgatctatcatttttttatgaatatttaaatgacatgcaaaaatgaggaaaacccccttaagagatgaaaagagtttcccagttcttgtgtcagtgttcaatccaagtaatgctttatttttcttcccgaaaaagaaactaatataagaaccacgtcatttttcttcagccataaagaagtattactgtattagtaatagtgtaaaacctatactaagacaaaccgatggaatcagtcactgtctaatccttgtatgatcataccacagcaattgtcagcagcctgaatttttctaacagcagaaaccaatgcatgcatattgtcctgcaatacagacaacacaagaaaccaagtgccaatagaatccatggccagcagttgagcacttggaagttggaataacgagggtatactagaatatacgagtatcataagctacatgacatgtcatcaatggagatggctactttacttgtggtcagagaatatacagtccacacattaaccctagctagttaagctagatgatgacctagctaactgtctttttgaatcagcaatttggacggcttatatattcgccctctccttgacttaatttgctgcatcataagatgtgatgcgtatgtctgattatctgtctcgttcaagttggggtttaatttaattacttgcccggctttctgcaatcgaaaaggctatctaatgcaaccgttcatcgacaaaaccatttctggtaattcatgtccgtatgcggcagctggattatatgagcaattaatcaacgcaaaccctagataatagattctacgtatataaaatcatacagaaactgaactgattattcctattaaaatccctgcgttaatttaaatagacctgattaattagctattgtagtacatatatgcacatggtccagtgaaaattatccacgtcttgttgtgttctatacttgattctcttgtctatatatgtttggtttgcgaaaacgaaaattcagacatttcaaaaacagttccagagaaagagacttgtatggacacgaacatgcagagaggtgttatctgcatatatatatatatatatatatatatatatatatatatatatatatatatatatgcatgcagctgggaataatccatcacaccgtgcaatcattcacacacactgtttacactacttgaaaatctattttcgcagacggacggcaaacttcaccctggtttgtatttttgtaggcggctatttgactctaagggctatatccgtctgcgaaaataaatacccaaagtaggtgaaaatgctttttctattagtgttatctgcctgcctggatattcaggattccccgtcctgttgatgagtatgcatatgcgtgtttggttgtacatgtacttgcatttgcatatgaactcaaagaaagaaataacagtgaagaagtttgtgacagcgatttgccgtgaagctagccccgtcgactgaatatcccctacgaggtgtagagttaagctttcatcccttgcacgaaattggtcaagaaagttttggaactggagataagttatcatgcaactaggctaataattgagctagaaaaatgtggcagaacttatttggccagctagtcttcatgttatgtggtctaaacaactgtttgctttataatcgtgagggcttggccaacctcatactatttacctaactagtcctaattatcaacagttacttgctagtagccatagttatcaattagccccaaaaggcccaaccacaaatccagttttgagttaaccgttaatttcgacgctagctattcccgtaccaaataccaaccaacaataggtttggaaatggaactagaatgatatgccaaaataaatattgtttaagctacctaatcgatgatattaattttaaggattatattgagatatagccttgtagattcgagattcttaaagacagcttgtgagaatttgtaaaaggtggattttctaggttcgggcttctaattcattattttcttaatcctatagctacaaattttcaaaatctaagtaaaaatctagattatttatgagagtattctaaaatagctacaactgttaaaagctccccaaacctaacgatagaaacatataaatttactaggatattgttcgcgtgttgaaacggaattttaatttataaaaattagcattaacctattattacataaatttattactgatatatggaccctctggtcttacgttatccttttttgcttctcacaaggagagttgatggtgggggtggttgacatgtgaactctctcccattccaaaaagttagggaggtggtggtagggacggtggcggattcaccactcaccaccactactattaattttttttaaaaaaaatgagtatagattaataagaggacccataaatcttttgcatatttgtgaaaagaaacaaagaagcatagattaggagacggatcacatatatacacacttcaggataaatcgtgcaatctcacgacaaatgtttcaagcaacttttgctctttttctgaaaagggtgaaacctacaaatatccatgaattccaaccttagcatctagtgcttggatatttgtatccctgatatttcttaatcgctttttcttcagagcaaaccagttactgatggtttcaagcagtttcggataggagcctaggagggtgacacctcgccatcatcaatcagagaagaaagctagctagttgctcatcctaaagtggactgcgatatatattatgctgcagcaatgtggctagctagctaccttcatcatccatctatccaattaatttcaacacagagagcactttttatctattaggtgtcaggacaatgaatcatgcacaacatattcaactccattcctattcgatgagttccgatgaaacagcatgatagattctcctccaaatgaggacagcgcaaaaataggacagctggaccaatccattcagtcagtggtctccaatgtccacgcagatgtgctaaaaatcagggaaattgcagtccatttctctgaacttttgaagtgatgatattataatttcacaactgaagctggcagtaacttaaccctacctgcagtgtgttggcagtttgcatgcaagatcaacctatctcctcacaaatatcagtacagcaatctccatgtagatgcatgacagaatgagaatctgagttcatgagctggggaagattaatcattcagaggctaatctccatttgaaccccacttagggagcaggaatccggcaaactgtactactgcttctgcatgcgtctcagcagttgcttgctaattaattatccacaaccaaattgtcccagatttccagctgctggtatttctgaaacaggttttagatctctgtgttcgtcatttcttgattcaggaaaaaaaaagatcaagggcctccaaaaatgattcagattaattatgaccaaagatgaattacgtcaatgttttccagtttactgcaccccaagcagattcagagagccaaacgcaagaagaaatatatactctgggttacgtggtcgagtaccagatattcaatattcatcatggctcttccaaactcgatatcgcaaaatcgccattagaatacgattaacttccttttctcccactttgttttgtaatcgagatcgaatgcgagagagattagaaatatgattggagcctacctgagccagaaactggtactactagtctctgctgccacaatcaaaattttcaattcattaaatttattatcaccacctaattcctagcttgtgtgtgtatataattctagttcattattcaggtctcactctaacaatcattttcataattccgaccagacttaattagcatatatatgcagaggcttaccatgtcatggtacacgaaccagatagataattacgtgtgttcatgcccatctgatctgaccacatgatgagttgtcttgcttataaatttgccaaatctgaaatataaataaattggactgcaattcagcaaattaaagaggattaaactcaacaggtagaagttgttcacgtccgggcacatagtatgtatacttgtttagtagacaaatctctaggtcaaagcacaattattgagcaaaaaaatagttgagagaagttgctcgcaatctctatccgcggcaagattcctcccctctcttttgggtatctccaagagccagttagacccgggcagaatatttatttatttgtcgatgtgtatattcctcacatgataagtgatcaggtggtgtgtttgcttcagtactctctcttgacgccatatttgcatattgtttagggtgcataatgcaggtgagagattagagattggactgtcaataatcagggtgattaagctgcatatcattgatgggagccataggggattcattgctgtcttctctttctttcatcttatcttacagattaatgagtttttagttgttgtttttacagaatttacagggtgtcttattcggaaaaaaaaagaagagagagaacttacagggttttttagcagcaaaaatataatagatggaaatggattctaattcctcgagggatgtaccctcatatgcaatttttctctcgaatgaaatgtaaactgttgtgaaaaaatctatttttattatgtacaaaggacatacatcacttaaaaaaccaagttcaaaatcgacctacacataaaaaaataaaaagaaaaatttagtgtccatatgcaatcaagaacgatttagtattcctaaggcggagccagaatctaaatataaaatatattgaccaataaaatgaatcacaacaaaataaataatagtttcgtgtttttgacttttttgaaatgtatatgtaaaagtcaaaaggcatcatgtattgaaaaaacataggaagcatttttggatttaggatccatttgaatcgaagaatttatggtggagttcataggattgaaatcctataagattttttttcttatttgactatttgattcaaaggattggagttttccaaatcctatacaatttctatggaatagctcattgtatttaggttttggaggagatttagcaaaaggttcgatctcttggaaaaaaaattctataactatatctttctcatccgattcatacgtttttcatgcggtctaatcaaacgattattcgtgcgtattctctgctttacatttagtcagaatcgtgtgtttttttatttctccaacccgtccatcgtgcgcccctccaacgtcgccggcgccggcggccgatcctgcatgtctcctccgcccgtgccgtgcccgcgcgcgtgcgccttgctcggcctcgctatccatctgggcgcgcgcgtctcctgccacttcacgcaacgggtggatggttttggagttttggccggcgcgaccaccaccaccaccactcctcgtcgcgcgcctcgcgccgcgcggcggcggcgacgacgagcctaaacaacaataaaaaaaaatcgcgtgtggcctcgcagctgcacacctgtagctctagtggagtaggccacgagagggagagagagagagaccgtgcgcgtgaggcaggcatccaagtcaacgtggtagagcgtacgaggcgtcgcgtcccggatgcgcggacgacgaccacctccctcccggtcggctttctgcaggggccaagcgccacaatctccgccgacttacaataaaatgcttttcttcttcttcttcttcttctccgatccatcgctgtccatctgtctgcaagaaacgcgaattcgtgaacaaactcctctctctgcagatcgatctagctaggaagctgcattatttgcaattaattaattacgctgttattgttgattggtttgatatgattccatggagggaggccgctgacgtcgtggatgatgatgatgcctgatcgagatggatggtccaggatggatcagtgatcagtagtgactagtgacatgcattttaattttttggggggcttaaacttggggacaggttgagctcactcgatcgatcgagacctgcgtgcttatatatattcagatacagatgcagcttttgacaaatatatacttcagtaaaattgatatgcagcgtttgtaaacgttgtgcgaaacacggcggtagaaatttggacacctttttgcaccaacttcttcaactgctcctcatttttttgcctgctatgatcgctttatatgcatgaaggattttaatttttttttagttctaaacgtcaactagagaaaatagagtatgctgctggacccctggacgcatgcatctcgtcgactatatttatagaagagaaaaaatatatatatgggactataataagaatcatcagactttatagtcagaaacaaaacgaatatgtatgtaatgtacttacgtatgtacaacacattggcacgcctagttcaacagctgcgtaggttaattgtatacgagttctagctgatcccgtcttaagttttcaaaaatatataattcgtccccgtttacttggatagtcggaggtatcttttcagcaggcgttgctagctgattggattgggagaaaccgacgagttttttttccttctgattgataagtgttatgacttcgcattgagctaattattcaagcatactattattttctccagctgaccaaacttctccatgatagaaaaatcaatcgatggtgttcatgctcaccgaaactaaggatgatctcttatgagattaggatatacagaagcattgatctcgtgactgaagaaaatttcagacaggcatcttgttcgcctcaacacgcttaatcttataaacccaacaagtttgtgtgtacttctcggcagcaaagttgggcccgatcacggaagcccatcaaaagcccatgctatgaagttaatagtgattccagatagacagcccatttacgctaggacacacgagtcgcattttattaaggagctatatggctattttataactgaaaaatactccttccatctcatactattatggaattttgggtgtgacacacgattcgaattttattatggaattttaggtgggtgtgacatattctaatattacgaatcaggacaggaatggatgaagtatcggttagcagtttgggaaacatacgcgtaaaaaaatgagaaagtgaaagttgggagagtggataaacaaacacagccgtagtggcatttaggaaatgttgggaccaagaaaaagattctttggtttgatcctaaattttatactcaaggctccttaagaacccaaactccaaaggaagggctcaaggagagaactcgatgagtctatctattctcttcttcttcttcctcctcccagctgtcccggtagctgtcatccagagaccagatgcaccggagagccttctcgtatatctcccgcctccgcgcctccatgggcggctcgccgacctgcgccgccacccagtccatgtactccacctgccgttcgtcgatcgtcgcggccaccaatggccggaacatggtgagctcagaggccgagacacaaaatcatatgcatgcgtaacttcgtacgtatacgtacccagtcaggcatgagggcgtgcgtgtgccgcttgggcttcccggcggcgtccatccgccggtagtcctcctccacggcggccgccatggcctcctcgcccggaagctcggcccgccccgacagcgcccgggcgacccacctcgactccagctcgaacgactggaacatgatggtctgcacagtacatatacatctcttgcctgaattgtcatggtgtttgtttgtctgaactctgaacaatcgacgaggacgtgtcgttgttataccttgactggcaggccgacgaaggagaggttcggcgcgtgcttcggggggaagacgtgcttgtacagaggcccgacgcggttgccgtcgacggtgaccccctccacgtccaggaacgggaaatggtaccgatacctgccaatgcaatcttcagtaaattcatcgaaatgcaaaccaaacgaatgtatgcagctcgaccaagtgtgatcctaccctgtgcagtaaagaaaggtatctgctgcgattgatgcagatccttcgctgaaacgcacttggccatcatcttggatgcaatccacctgattattgtatatatgatccacaattagcacattgattcagtacatgatgcctttgagcaggatttcgggatgtggattttcatccctcgagggacatcccctcgttatttgcatgttatctagatagttatcaaaaaatttgaaaaaaaattgacaacatagattaatacgaaatatatcactccacaaacatgtaagaccaaattcaacttttatactccctccgtttcaaaatgtttgacaccgttgactttttaacacatgtttgaccgttcgtcttattcaaaaaaattgtgaaatatgtaaaactatatgtgtacatgaaagtatatttaacaatgaatcaaataatatgaaaagaataaataattacttaaattttttgaataagacgaatgatcaaacacgtactaaaaagtcagcggtgttaaacattttgaaacggagggagtaagttgcaacaaaaataacaaattaaactgaaaatagttatcgcatgttcacaactatatttgttatttttgttataatttgtagaagttaaatttaaacttgcatgtttgtggagtgatatatttcatattaatctaggttgccaatttttttttatgtttttaattgactatttaggtgacatgcacgaaacgaggggatatcccctctaaggatgatttcactttcccatgatttcggggaacagtgattgagcaggagttaattaagaaagctttgaacctctgaatgcaaccaggtattctggaaggtatcaaccttcccaagccgatcttctgtgtacctagatgcaatgtgcacttccttggcaacatttgagatctctctagctatgtcaactccacttgctcctaatcctaccacaacaacaatctgcataaaaaaagtagacgatttttatctgaaactgtacggcagcagcaagaacacgtactgatactgtaaccgagacagcatcttgaacctgatcttgaaatggttcaggagtccgatagttgtggctgtgcatctgcttcccttgccaattgccaattcctgcaactcagggagtcagattttctaatctgaaatcgcgaatgcaatagatttttcaagtttagatcaaatcaaacttgaaaaaaatttcaatgctgaagattttcgctgctcctaactgaaattctggatgacactgggacaacacctcacctcggagcttgggcactagaggcacagtgcagtgcccgttgcacaccacgacggcgtcgaacaccttcttcttcttcttcttccacgccgccctcgccgggccatgccacggtccacctctccccgtggccggcgaggggccccacgcggaccacctcggcgcggagcctgacgcggccggcgacgccggactccacggcgaaggcatcgaggaaggcgagcacctcccggtggcccgggaacgtgcgtgggtcgccggcgaacaccctccccgccagcgcgaacccggagaagcccatgagctcgcgcggcaggttggtgcgcatcgacgcgtataggctgccgtggacggcggcggcgccgggggcggccgtgtcaaggcagggcgggtcagggtcggagcccgggtcgtaggcccaggtgcccccgacgcgcgccgaccgctcgaacaccgtcacggcgtggccctcgcggagcagctcgcgcgctgccaccaggcccgccgcgccggcgccgaccacggccaccgtccgcggcatcggggcttcgccgccggtgccgtggacggtgggggggagtgggtgggaccgtgtggtcagcggaagaagagacgttatgtcagattttttttttcaatgctgctgcttgcttccaaaaaaaactcacaggtcatacctctctggaaaaaactcaagtgtgttttggagtatttgtttttttaagtacaagggaaatctttacggtaagtccaaaaaagtagaattaagtgtgaataaaaacagtcgatgatgatcctcacaaaaattatatagctactgcggagccaaacaaacgaactaatagtgctccatttttgtttcactggaagtctggaactatggagagtctagtgaaagcccaatgatacgatcacggcatagggtgtcgtttactcctttcgtcccaaaatataaaagatcttatgtgaatgcgacacatcgtaggctatttgtccagattaatagctagtattatgatatatcacattcacctaaaatctcttatattttaggaaccaaaagctctaacgggaaggaaatctattataaggaagcttagaatcctggtaatattacgggaaggaaatcttgcagaggagatttattggcaagagaggagtggggaaaaattgatgctaacacagcgtattatcatggtgtggccaacggtaagaagagaaagagcataataagaagtttggaagatgaaggtagagtgattgatgaccagatggagttgaaagatcatataaaacaatattacaagtctctgtttggttctgagtcacctccaaaaatcttcccaagtcaggacatgtggactaagaggggcagattggatcaggatgataatgaatatttaactagacctttcaccatggaagaaatagagaaagcctttaagggcatgaagactaatacagcaccagggcccgatggccttccagtctgtttcttcaaggaattttagccacagttaaaagatcagtttaaagaaatgcttgattctttatttgaggagagtttggagttgtggagattaaactatggggtaataactctaatccccaagattaaagatgccaacaatatcaaagcatttagacccatttgtttgctcaatgtttgtttcaaacttttaacaaagatcttgaccctaaggacatttgtggcatccaaagtgattggggagaatcaaacaacctttatacctggtagatttattttagatggtgtggttattctacatgaggtgttgcatgagttaaaaaaatctcaccaatccggcattattttaaagctagattttgaaaaagcttatgataaagtacactgggacttcttgtttgatgtcttacaaaggaagtgtttctgtgacaaatggattggctggatgaaatcagtaacagaaaatgggaaagtagctgttaacatcaatggggagaatggggagtttttcaggacctataagggagtcagacaaggagatactttatctccactgttgttcaacttggtggcagatgccctttccgagatgttaaatagggccaaagaaaccggtcacttacaagggcttgtgcctcatttagtcacaggaggactaactcatctgcaatatgcagatgacacaatcctcttcatgtctacctcagatgagaatatagtaactgtgaaatttctgctttactgctttgaagagatgtcatgcctcaaaattaattaccagaaaagtgaagccattgttataggagctactgaggaggaggcccatagagtagctgatttattcaactgtagaaaaggatagctccccatttcatacctgggtgtgcctattagtaaggggagattgacagctaaagatttggcagtaccagtgactaagatcgagaaaaaactggcaacatggagatgtggttctttgtcttacggtggtaaatctatattaataaattcttgcctgagcagcattcctatgtacatgatggggttatacctgttgccagctcaaacacatcataagatggatgcaattagagctagatttttctgggaaggactagagggtaagaaaaaatatcacatgcttagatgggaggctttatgcagacctagagaggatgggggtcttggctttgtcaacacaaaaatgatgaatgaggctctgctatgcaaatggatttacaagttggagtctggaaataatagtccttgttgtgaactcttgagaaggaagtacttggcaaatggagggggcttcttccaatctaaggctgaagggagctcacaattttggagaggtttgcatgaagttaagaagtggatggatctaggaagcagctatgtggtgggatgtgggggaagcagtcaggttctgggacgatgtttggttaggagatgttccactaagaacacagtttccatacatacacagcatctgctctgagcctaacaatattgttaaaagaatgtacttagacggggagtggaaaattgactcgaggagggctttggaccaaaatgagttggaggagtgggtggagctgcaggagaaactggctcctattaagctacacttaggaaaagatgttatgatttggaaactaaatcagtcgggacagtttaccactaagtccttatatagggagatgatttttggggggattaaagacataaaactgcaggatctttggaagtctttcatccatttaaaaattaaaatttttatgtggctaatgctaaaggggagaatacaggcagccaaacaacttaagaagatgaattggtcagggagcccactgtgcaaactgtgtggagtggaggaagatgctgatcacataatttttagatgccctccagctcaatttctttggtgctgctacagagacgcctttcactgggatttgatccctacttctagaaatgaccttcttgatttaatctaaaaccaaaggggagttagaaatagatgtctttggtacctgtttgctgctggggcttgggcaatttggcttgtgcggaatgattgggtgtttaatgataagctgctgaataatgttgcctcactttctcaaaaagctctgtcgtttttgaaacagtagggacccttattgtcacaccccaatctgataccgccgtacaacggcacctaacaggagcgtgtcgtagggaaaacggcgcgaaccgcttcctacgaaaccgcgatctcggtaccagtcccaggacatagtgctggtacccacggtgacaaatatgaatcatagcaatctttaaaataaatagaggacttatttaccttaacttaggttgcagctcagacagcccgagaatacaaccgacgacacggacgaggcgaacaccaacaacagcagcagcggaaccaacggtctaatacccaacaccacaggcgacggctgggaaccaggacgaaaccctaatcttcacttcactttatcttctcttcagggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaaacactaagtgatttatttctttctaagttagggccgaaaagagacttgcgtctcgattcgactttaagagatgtttttcaacagctcatttggcaatgtaccgacctcccgggtcagatcattacttttcggctcccagagccattccacttgattaatcggctcccagagcctttttcattttctcggactcccagagtccagctacccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccagccagtggttcgcgacaaagcctttcccaagccgacccagggttacctcacgccacatagaaggatcaaatcctcacgtaagtataggccattttaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaatactgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccaataaccgcaactatacgcaaacaatcgaaaacctaaacaaaagaccaaaagaaagatcctgtttagacctattagtagtgccattaaataggatctcaattttacggaattactggaagtggaacggagtcaatcggagttacggattgggtgatatgaattttggaagtttaattggagtttctggagtaggagaaatggtttatggaatttatagaaataatattctcaagaatattattgacagtcactgtcatgcgggaccaaaggaaacggtttatggaattttggaataaggaattgatttatgggacaaaggaaaaaggatttattaaatccctggaaaaagaaaaggatggagggatgttaattggacttgggccgagcgaaggggcgcggcccgaagagatgcgcgggcgcggccgaggcgagcgggccggcgcgcggaagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcggtggaccgggagacctttgaccggtctccgcggggccgggcggctgaggtggcatccacgtggatgccacgtcggatggggaagggagaggaggccgggcaggctgatccgatggccggcgacgagcgacgtgaaccggcgaacggcggcgaggtggattgggggggttagcaccggaagagagaggaggccaaggggaatcgattcaacggagcggattagccgggggaaaaacgacggcggctggcggcggcgaccaatctcgccggcacgccgacgtggccgcgcgcgagaagagcgaagggcgcgcgggctcgggcttagccgaaccggtacgcgaccgcgatgcgcacgcggggacgcgggacccgatggtcaccggcggcgcacgcacggcagcgttaggcggcggcggaagcggcgacacggcgcggagacaaaggagaaggccgacggccttggggcagccagggggaggtcaaggggatccccgggagcgtggcggcgagaggaatcgacgcgagaggagctgacgacggcggatttcgacggcgatcgtcgacggcgagcaaagagggaaaacttcactggggcaacgggggttcgattcgttggagctggagcatctacgcgaggtcgcgagctcattccaccggtcgagagggcacgggcgacgccgagagaggccggcgacggcgagcgacgcccgggacagagcaagggcgcgcggcgagatgtgacgcacggcggcgggcgcggcgcggcgtgcgacaggggaaaagggggttcagtggggagctcaccgacgagagaaacggagtcggcggcgcggatggagtcgcggcgaggcggacgcgacggcggggcggcgcggcaccgagagggcgcggccggggaagaagagatggagaggcgcgaggatgggggcggcgcggagctcctcgtcgactcctcatgctcgcaagctccccgacacgcacgacggcagaggagggcgagaacgacgacgaacggcgaggcggcagtggtgtgatggaggagaggaagcgagaggtatgggagggggtgtgggttttataggtggcgatgtcggtttgagagaaccgaccttggggcggtcaaggagatgaggcgggtggcgcgagcggtcaagcggcgcagaggtggtgacgccggcggtggtcgggaaagggaaaaagaaggggaaaaaggggcttggtcccttgccataatgaggagagggagagtgaggaggaggaggagagggagagcagctgcttctcccactcttggacgggtgcggcgtggaacggcgggggccatggatgacgtcggcgatgacggcggcggtcggtttgtcatggagcgggggcaaggcggcagcacgtggcgtcggcgacgcaagggctgatggcggcggcgttcggccggtcggccactgagcgagcgagcgcgcgcgacgcgggggtgcggccggatttcgaacggcggcggcgggaaatcgacgccggtgggggagcttctacgggagagggagagaaacggagagagagagagggagcgaggatgagaagagagtgggcgatctctctctcgagcgcggcgcacgcgcaacgcacgtgtggagggaggggaggggaggaacggctgagagaggagatgggccgaggggagggggatcaggcccatccaaaattagaaggaggcaaaatagacttatgcagagagatgatttggaagggatttggatttggaatgaaatttcgaatatgattacttggactcggggaaacagggaggagtcaaggaatggattcaaggtggactcggtatttttggaatcgggacaagtgtttggcgaggattcaaaggaggcgattgaatttcggaatttgatttcggagacttaaattggaagaggaatttcgatgaggatgattttgatggcgacgagagggatcaaggacggatttaaactgagatccacggcacgacttagactcgcacacaaagaacgaaaatttttgcaattaggatttttccgaattagtttttaacgcctcacgaaaagcggagcgttacatatgttgagcgatatggctttgtagaaatgatgtggttttgaagaatccaaactcaactatttttgcaagttatttttcaggggaacacattggacaaggcaatggttgttgttggtcaaggatgaagagagcgacactctgaagaatggttatcgccagatagagaataatgtcatggagtttttctctaaaactggatggaacttgagaagttgattggggatgtgatgtggtatcattgtgggtcttaagtactttgtaaggatgtttggagctacttgtttttcagaattgtgtgagcataattaagtgtttatgttggttagttgtgtggaaatcctttttgtgaggtcgagtctatgtacttttttgtattttagctgtgtatatatccccattggatatatagagggcgggtttttaatccattataagacattttatctaggcttgtgagatagacacttcctctgttttatattataaatcgttttgacttttttttacgtttaaacaaacttataaaaaggtataataatatttccaacacaaaacaaacatattattaaaatatatttaatgcataaaattttatggaatatgcagtactttctccatattaaaatttaagcacttttaactactaatgcaggtaatagagggagtatgtcggcatagcaaatgacaacttagacgagacacgatgagtattaaagataaggggacgattggaccagccttctgaagagctagtagcatatacgtacggtaccatacatgcaccgtccatcgatgtcgatagagagttgaacacaaacaatgtactcatacaaatgatgcagctatcacatgcatgatgcaataataatataatgctaaagcttttgtagcaccggaaaactatttatccatcatcccgtgaacccatcatggtcgtattctaagtctaatctagctagctacactctacacagggatatactctcttcttccctaaatgtttgacaccgttgacttttttaaacatgtttaaccgttcgttttatttaaaaacttttgtgatatgtgtaaaactatatgtatacataaaagtatatttaacaataaatcaaatgatagaaaaagaattaataattacttaaatttttttgaataatacgaacggtcaaacatttttaaaaaagtcaacggcgtcaaacattttgagatggaggtagtatatgtgtactactagctatatgattatatgcacacaactgtacattaacctaacctgatgaccaggagatcgagattaatcatctagctagacgtacaaaccgaccgtggattaaactgctcattcgcgcctagggaatcgattccgctaattaattacggtgttcaaacagtaatctacactcattgtatacagatatcgcccatgtaaaaccaagtaatcctccatgttacaccgctgtcacacatcgtctttcctccatcacatcaggccaagcaggtcaagcaaaaaatcatggagacagccaaacaaaccacgggctgatggaaaagaaaggcagggtcggccagccatatttctgcatcggtctctgaaatctgaatactacatccatgtgtgttatccagtcactgagtcacggcttcttgtcgcatttggcccatctcccgaagaacatatatgttaatgtaccatttctacgtactcctactccattccgttggtggcgagtgagcgatctctatataaagccgagatcccccaactcggagagctcagctcatcacacttgcagttgcagtggtggtagactggtagtgcattctcagcttaatttgcttgagctagtagctgctcgtgagctgtgcaccaatggcgtcgtccagggcgtcggcttcctgtgccctcttcctcgccctcaacctcctcctcttcgccatcaccaccgcctgcccgtcctgcggcagcggcggcggcggcggccatggccattacggtggcggcggcagcagcggcggaggcggcggctacggaggaggcagcggcggctacggaggaggcggcagcagcggcggcggatacggcggcggcggggggtcgtcgacgagcgggtggtacgggaagtgcccgacggacgcgctgaagctgggggtgtgcgcgaacgtgctggacctgataaaggcgaaggcgggggtgccggcgacggagccgtgctgcccgctgctgaacgggctggtggacctggaggcggcggtgtgcctgtgcacggccatcaaggccaacgtgctgggcatcaacctcaacctccccatccacctcagcctcatcctcaacttctgcggcaagggcgtccccaccggcttcatgtgctcttaatctctcttttcatccacatttcgcattaattaattaccatgcattttacctattacaatcttctaatttgggagtcatttagttaataagctagtgtcgtcgttgttgcgtgccaaggttttaggttagttgtgtgttgattgctagctaatgtcctactagcattgagttgtaggtaccagtttgattgctttcctttgatgcgtatttgttcgctcgctgggtaattgtcaccagtttgtgtgtgttgaaatgtcttgttttagtttcactgtttcggattcaaatttaagatggaacctgaacaatccaggtttttgaaaattcccttgtctacatgaatggttcaattcactactacttcagttaaaaatgtcccgatggatgaacaatcgcacagacaaacatattctcttgcacaaacatcctgcaagagaataaaactatagcctgtgtttgtagatacgccaacatccgcctcgggcatcgtgctctgcacagtcagactcgtgcatgaatccaggccatggagtctctgcagcagcagcaagatttttctgctgggtgcagtgcaagttgatgttcacgggcgaggtttactggcgcttgggcctcaccaaggccgaggtgatcatgtgggcttgtagggagcaaacggaaagcccactctatctcttgggctgtggcacagatggcccattgggttgtccatgtattctaaacaggcccatttttaactactctatatatactgcaagtgcaatagtagtggctgacggtctagactctcgtacgttattatctgctatgatgtactgataatacaattcccgttggttaattagtagctatcagctcatttcattagaaagaaaatggatagagtttcttacataaacaacagatatattttacagggcaaatatcattgttgactcttgggtaactcaaaggacaagcccttgaaggaataattgatatacagtttgtgaacactgaatatgcatattgcatacacctcaataactcaatctctatccacaaactgtgatattcaattctacacaccaacatgaacaccaacgcccttaaatatacgtaagatacatatatacactgttaatcaaaccgaattacatccatccatcaacttaacattcatgaacatgaaaagaccaacaaattagtgcccttccaacaaactgaacatttacctgggaaagtaatgcgaccggccaaccaggggaccatgtatctttaatttcttggtcatcgtctaattttttgttttaatttacttgtttcaggcacgaacatatacataaaaacatcagtaatgtcggctcagatcaccggtcagtccgtgacgctggtactagcattagtactctttgcatcttaatttatataagtgggcgagtgattgacactctgctccatctccgtgtactttgatgatcagaaacaccaaccagaagttgcaatcgccgggacagatgctcccatgtcaaccttctgctttgcctgaatctgaatcaagtttgcccggaggctcacttcctgcacctgcagtccaaacacaatgtaagccatgaaacagaattatttgtcatcaactaatccaggagcttgagctttcgttgcaacaaaagaacaactagactagacaaaaacaaatagaattagggagtaggcagccaggcagcactagtgctggagaaatggagtatatgacaatcaatccaaatcttagtagtacagaagatactgatctcactagaccagattagactagactaaatctggttctggtgagagtgaggcatcagctaaaaacgaccatttaccaacctgcaagctagtgacaatccttgccagcttcatggcttcctgcaggccctccacctcctgctttatcgtcgtcgacagttcttccagcgtgctgctcgtcaccccagcctgaataataatgcaccaccaaaaaaaaaaatcaatcactcatgcaaggttcatataattgcatctaaactaacctttcctagtaacctcgcctcaaaatcgcctgtttgttatctttatcagccaaaaccaaattttaaattttaaaagttagtttaagtcgttgatttttctaaggttttttcattgtagtttatttttaatattggttttaaaccgttaagaacgcagatgtaaaatttttccattagattatttttagttgctcagtttatttttcgacagtttagtggttgatttatcaaaaagctgaattaattaagcgtgtaccgtggcgaagaacatgtcggcgttggcttcgatgtcgttcaccgtgcccacgcacgcgaacatggcttcgtgcaagctctccatgtcgccctgcaaatgtgagcaatttgttgatggttggttggttgatcaaagagtgtaaatatttctgtcagagacgacgaggggagtagtggagtatacttgggcgccgtcggctaaggggagcgcggtgcaggcggcggcgaggacggcgccgaggtcgtcgacggcgtcggcgtgcggcttggcgagggagtcccacgacgcgagcagcgagagctgcggccggagcagcctcgccagcttcagcttctgccgccgccgctgcgccacgatccgcttcgccgcctggatgttccggagctccgccacccgcagccacgtgtagaacagcttgttctgcatccatccatccatggcgcgccgtcagaacatgtacgggaagcgagctagcgtgcgtccatggcgatcggtgtcacggcctcacctcggcggcggcggtggcgcgggccatggccttctccatgcgggcgttggcgaagcgccactggagcaagcgcgcggcgagcatgcgcgcgcggtgcgccgccttcttcttttcgggctcctccttcctccgcgtcatcatgtccctgagcacggccgatcctctggtgctcccggcgttctccggcgacgacgacccccccgatgagctccgcctcggccgcctcgccggctcccacgggcccctcgccggggccgtacccagctcgtgcacggtgttctccttgctgctcagcgcccgccgcggcggcgccgccgccttcacggcaacggcgccgtcgtcgtcggcgctgtactgcttcttgccgccgccgccgaacgaggccgccttacggagggaccgcgcgaagttggtcgacaagaagagcggcgccgggcgcatcccatcgtagacgaacgcgccggcgccgccggcgcgcgacgccgtggtgctcgcgctccgcgccagcagccgcctcgacgccgtgagcggccgcgccgcgccgccgccgacgccattggactccataaattaaataaattaataaatataagttaataaatatcgcggcgattaagcttggccgatcagagcaagtacattgctggcaaaccctagattctaagttggggagaaccctgcagcactagctctcgatcgagctagtgctccggcttcaagaaacttgttgccgcctatacgttgcatcgtggagaggtagaagaagagtgttcttgagagggcacgtcgctctcttgacatgatggaagagctagattttattcttctatatacgcactagctaattgcaattaatcatgtacattagacatttgtacaacacatttcctgccaattgaatacgtccatgtgctacgatactttcagtgtagatacgtagagaaggatgccttaatttgtgacgtatttgatgggttcagatactaagattattgtttaagcatacacacccacaaaaaagggagagatttgtagagagagagatgctcctccaaacattttttaagaaaaaaaaatatatctggcccatcgttttgcttattcggggaataagcgaaacaacatatttgcaaacagaaaataatttgtgaataaaacttttatacacatgtttttatcaacctaaaagcgaaggccaaaaaataaacttcgatgaaaaaaaacccaaaatgaactccaaatttaaggtcgaaaaatcaaattttgtttgataagtataagcgaaaagatgagacccttagggttaaaatcacgcatcccttaccacgtactgcatctcttgtttaagcatacacgtgaaagaaaatgtccaatcattttctttttgtttaagcatacacgcgaaaaatgatttctttttcacgtagtctttttggatgcatgtggaattgtggaaagggagatgagagaaatgcgaggtagaaaatggtgtggggtttggtgggagaaagggagaggagagctcgatcgatggccattgttcatgcatggcgacctaaaaaggggggccaatttggccattatgcatgcttcatcctcgcacacgcaggagctggctgcttgtgatggtgtaatctgcggcggaagaaagggagagagagatgtcaacgttgggagagataaaatggcgtatttaggtgagatttgtgaaggtactggctacctatctaccgaaagaaacctgtatcggtccatatactactgatcctgagtcaaggtcacggccatctaataattcttcattttatttgatttttaaaactgacaggctcaccaccctaatggattaaatttaggccttgatgaaagttgtctccattagttcaaacccaaattaaataatgggcctaatcctcttgggccagatttgctgattagctaaacaacaaactatactgtttctttcttcagagcccaagaccggggttacagattgtttgctgaaaaacggtatgaccgtatgatcagtgcaaactttgctgaaaactgaacaagcaggggagactcctgccgatgaataagttgtccatgttccagattaggtcagaatattcatcacatgcatcatgttgaaggtgataataaggtcatttgattaattccaatccctacgcatagaagacatgcaacacatagtaggtaggagtatatgtaatgtattttgagtgattaattaattagtggcatgcaaacaaatattgggcctaacctctttggacaaactactgatgggccacatcctctgggccaaatttgctgaagtctttagaacagttgtgtgctattacagttcacggatgaccttaccttatgctggggctacaaataactgtttaaacagtatgatcactgctatttttttatgttggttgctaactacagtagattcttatatttggaacagaggctgtcaatattggataacccacggtgtacaactgacattttctagtacagtacctaatcctctctgaatctgaactctgaagaaacaactgtaacatatgtgactgattcatctaaagcgagaaggaaacggtaaaaaacagagatcttcgactaatttctaggactaataacagcatgcgcgttgtggttgcacccatatacgcattcttctttcttctaggttggttgaccttgtgctagatgacaacctgaatatgttgaagataatatctgaataatcctgctacttgtggcattaattaattgtggccttaagaagctacctagacttttttttgggagtactaagctttcctcctcaaatgtgcactacactactaacacctgaagcatatttcaggtcatatatcaccaaactaatcactgattaaaaccctcccgagattgtactctcattctgaatttctaatctatttccattgcgactctgaatttctggccggtgagttgagtgtggccgccacgcgatatgatattatctggcaggaagtcaatacgagtgacgtggacatgcataccacatgagtggctgacagatgggcccagctgagctgcccgaagactctgacgagcacacacacacgttcgtgacgttggttaaaattggtcaaaacaaagagagtatcgatccgtcgcggtcgccttgccctagacgtattactgcatctgcgaatcgatcgaccgtatgaatccgaagaaccgaagcaaacatatcatcgacgaaaaggtcaggtcagcaccactcagcaaaagtgcagcgaattaatcaacgtgtgcgaaaagtgcgtgtgcactggagtacctgataagtagtcgacaagtcgtgtcttcaccgcgtgaatcttccgttggaattaatgaatgggccttagcccactcgaagattaattctttggaaaatcacaaaagcccacctcatgggatggtatgcatgtggagtttagtaccaccttgcttattctaggagagggggacctccttaaaagggaggatgccctcctagttgcttgaagcatgtgtggtggagagaagaggggaaacacacgcgcgcgctcgctcgcttgcctcgcaggctccttttgcagttttgttttgttgcaaattcggattcgtttttgttttggaaacgttccgaaagatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacaaaaaaaatcaatctagggtttgcttcctacctctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagtttttatctgtaatgtcatgatttatttatggaatagattaaatcattatatgtctataatctcaacatcttcatcgcatcgtatcgtatcgtatcagtagtttttatggagtagttttattttttttaaccttgggtaatgtattgctagtacacactatacacacaggttttgcctgaaagtctgaatgtgcgagctactgagctggtcgtttctgaaggagtccgtcgtccatcgagatactcctcttaggagcagtaactttcatgctttatgtgacagcaaaggttggcatgactgattaaccaaaggtaatggtcgttgatggtgagctacagagctagtggtgtgtcctcttgttgtgccagtgactagtgttaacgatcgttaatatcctaaccgtgtgaatcgatcggtcgtatactactggtaatagtaatattgtggatttgtaatactccatccatcacattttatgtatagtttttattctgtgttcaacgtttaacttttcgtcttattttacttttttcttaattattagatgataaaaatatgaatagtattttatgtgtgacttattttctaaaaaaatattaatttcttaaataagacggacggtcaaatgttagacgcatagactgaaaactgcacttaaaatgagacgaggaagtaggagaagtgaaattctaaagttgagcggggtgaagctagatatatgaggggtgcccaggaacccgataaagctttatctcatctattttaccatgtgtgtatccctaaatataaatttatacaaccgaatcagtttaaacttgatctaaagtaaaataatttaagcaagtgtcacctcttttcatttcgttttagctgcgccccttacttgaatagtactccctccatcccaaaatatttgacgccgttgactttttaaaatatgtttgaccgtttgttttatttaaaaaatttaagtaattattaattcttttcatatcatttgattcattgttaaatagtttttttatgtatacatatagttttacatatttcacaaaagttattaaataagatgaacggtcaaacatgtttaaaaaaagttaatggcgtcaaatagggaatactagtatatttcgtttccttcacaggcaagtgagtccggccgcatttgaagtcaaagagtagtagtagaagagaagaggaggtctgaagggaagctgcagcctgcagtttcgtgaaaccccaaagtatcttcttgcctgcatctgcatctgcaacctggaacagtagtactcactctgcaagtgccaagtagcagtagcgatcatgggcgttggccggcccactgacgtacggtgcactagtagctttgagagttggaagagagtgaccgtggcgctggctacctctgaccacggccatggtcacggtgggttcaactggcaactgctgccaacgcgcatccgacgcagcacggctaatccgctactccaatatgatgccaatacgccgctgcgcctaaccgggcggtggattggtggctgcaatatattgcatggacgtacgactctacaagtcaatcgcggcgtgcgtgcccgcgcagcgcgtggttggtgtcgcgattcaattcaaacttgggtcagcccgttttggaagcagagatcacaaggggacaaaccgagcgagcgagcgagctagaccggcaaccgaagcaaaaccaaagctaagctagcgaccggcttattaaccggccgggtacgttggtgacgaccacgacgcttcaatcccctttttttccacttcgatacgacgaagattttttttaatgaacgtgcaaaaaaaattacacgactaacatagttttaattacacaatacaaatcggtcagactggcttatgccagggaaaagggagaaaagataaaataaaaaagctgaagcttagaaaactaccgtggctaaacataaactccaaacagcgggaaggggccgaaccacgctatacacccaacaagtctctaaaagcagcaacgtcagcttaaaaccacagatggccttccgagtggatggactccagaaccactaagactgaagagagcacaaagtcgaaaaccctacggtcccgttcctttcacagctcccaaaagaccacgagacatgacgaagattcaacactcgccgttgctataagtacgatcgagtctatgagtaaacaaaagatattttggattagctggaagctgtcgagcgagcgtggcgacacggccattctcttcctcctaggcaaaacgtcctcgtgtgccacgtactactgtagtgcgttgctactggtacgtgacaaagcacactagctacgtactgttggctcggccttatcgcgacgcccacgagaaacgaaagctgcatattcttggcacacttttcacccaacacttttttggcctttggacgctcatccggccggataaataccggacctcactctcacgactttatccagttttcttcattagtaagtagattattatcatgtaatctttttagttacagaggtatacaaaacgtggctgggttcgttcctagaggaaagattgtcacacatatcctaaactattaaatgatgtgtgttttaaaaaaaatacaccaatttttaaagttcaaattattaatattaattaattatatgttaatgactcatccatcatatcttttcaatattattcttttcacatctctctggttaaagctaaactgttttaaatttaactaaatttataaacaaatatagtaatatttataatattaaattagtatcatcaaatcaataattgaacatatttttataataaatttgtcttgggttgaaaatattagtacttttttctataaacttagtcaaacttaaatcaggctagctaccagttagctgcacgcgtcgggtatgtacgtcgtccttgtaataactttggttttttcttttcttgtattttgaatttttcttcttcttcttcttcttcttcttcttcttcttcttcttcttcttcgggtattgtattcgacgtatttcgccgggtataatttgggtgtattctcatcgcacgtataattaattaattaaccaactacgtaataactacgtggagttaattaatgtgtacgtacgtggggtgtatgtagaaggaagatatatacgtacgtagggaagggggagatttatacggcaatgtataatttgccacaaagtgtattactgatgtatatgtttatacgtcttttatactgatagtgtgcagggcaggaggaaattcctgcatatgcgaggtgcgggcgcacctctcaatctgatcaataaattaaacacaaaaaagtttttgttcatatgagaaatgtgtgtgtactggatactccacataaatggattgaatcagtgg

SEQ ID NO: 58312 - DNA, 38570 bp, Oryza sativa
cgagaggttttgaattggagcttcgtactcatttacctggagatcatgaactcgagggcgtcgatcgttgtcccgtactcatcctgcagatacacccgcaatcccctgcacattttcagatagacgcatgattatgaacacgacactgaacattgcacattgcagggcaacctttcggagttgcattttgccggcgtaagtcttttcatagtttcagtttttattttgccttttctcccttcccctagcataagccggtccggctaattgcgttgtgtaacaaaaactctttttcttctaatatattgatgcagggcaaccacactgactgactgaacattgaacagtgcagtgcagtctgcagctttgcagccacacgcaatgcaacgcacctgtcggccgcttggacggcgagcctcccgacgacgctccgaaccttgttggactgcggcgtctcgctcccgtcggcggagacggggagccccacgatcagctcgtccgcctcctgcagaagaggggagaaaaacgagcggcaaattcacaaaccgccgccacatttggggaggaaataataatcaaaatacgcgttgagtttgatcattcatctgcacctgctgctgagctatgtcaagcagcatcagctccagcttctgcccacgcagcttcagaacctaagcagaggactccgatttcagatcgcccacccaagacgacgcagcaaacgagagggggttcgagcgagaatgcgtacggtgaggggacgggggagggtgatgcccctgccgacggcgactccggtgcgtgcttctcccaggtccacgccgaggctgaacccgcagccgtcccgccgccgcgccgcgttgggcaggagcgcggcgggtagctcgtcggggctcccggcgccgttcgaaggaggagaggccctgatagcgttggctctgacactgcgtggtggctgcggcggaagctggaatctccggagagcggcggcggcggcggtatccgcgccggctcgtagcagcggcagcggctccaccggcttcgcggctgccatggcggattgcggaggcggagccgcggggaggaaagcgcttcggtcgttgtggatagggaagtttttgggccatactgggccgggaagtaaaccggctgagattcgagcaggcccaacaagatcgcatcagactatttagggtcgctgacacgtagaccctaataaaaagttattacaaacctcaacataaaaacatagcaattaccccacatcaacccactaaatactactccctccatctaaaaatatagcaacctaaaactagatgggacatcatctaatacgatgcatctggacatggacatggagcctgtaacaggtgatgtcccatctagttctagggcctattcactttgatgccagaaaaaaccttaccaaattttgttattgctgaaattttggcaactgtgcttgccaaaattttagcaggatttcttatatagttatcaaaatttggcagcaaactaaatgtagccacttttttggcaactttaccaaaatttggtaaggttgaaaatggcatcaaagtgaacagacccctagattgttatattatgggacggagggagtactactacattcgtgaacttggtacggagtatgcgggaaaaattaactgattctgatggagattatctccgagctttctgctgcaagtacatctgttccatgtgtgattgcctatctaaataaatgaactatgctgattctgaatgtttgacttcgcatttgtgttttcagctacagacaagatcacaagatcgacattcagaatctggtgctagtgatctgtctgcatccagcgtaaaaggaacttggaagtgaagcacagatgaagagagtggtaagtgcttctgacttctgaacatttccttccacactgcaaaaatcttacttctactcacgaagtcaacattctttgtcagaaatactactattactgctactaagattcagttgaccagccaactgaaaccctcaacttgtcaatttcgctgatatttttcctctctaaagaagagttcactgctatcgcacatgatcaattttgtcatccaatgtcacaaacatcccatctttgttgcccagtgaatcatgagatactgatttcccaccatgagaaactaatcatactactagatggcccatctaaaatcgatagcgcgtaaagtatattttgcttgcaaagattccaagttttccaacccatcgatctcctgtttttccaccgaaagatcatatcagtttaacagcaatgcaacctttttttcctctctagcaaagcatcttgagccactgtttgtctgtgtggatggaccagttgctgctagctgctgctgctactgctttcactgtcaagcatcttgatctcaccctaatgcagcactgttcggataatttacagcatgtgattgcacatctacattagcaacatctgggaatggccagccgaaagagttcatcttttgtatcaggcaagcatccatccaatgctgagctactagctactgatttgtgtaatacaataatgtacagggagatgcctgcagccacaagctacattcgatttcgcttcacccctttcactgttcgatcacccgacagccaactaatttggcacgtatatgtagtactattgtaggtcatctgtagagcctacctggctggctgggctgcatttcatcatactgtcagtaccactaccttgtcttttaactttgtcatgttaccttcatgactgtatttatgcaacgtttgctttccctttttttttctgggttaattcacctaccagcaacctgaattccaaagcatatactgaagcaaccgctgatcatctgaagagcttgattgctttctgcttgtagcagatcgagcagggttcagacagttcagtatcattagtcgagtgacaactgacagtgtgcttagctccgatcttgtttggcatgcatggcccacgatttggtagcattgcattggcattgcaatgcatctggtactgcactgtggatgcatgatctttgattattattgtaactgcacagggggggacaaagctaaagtaaagttcagttagtaccacagatgagtgaagcgaagatcgaggagtagctaattaagctatagctctgaacattatacacatagcttgacttggaaactacggttacttctgctagctagctggtcctcttcttggttggagctaacaaatggaggggggaatctcgtacagagccgatcgagatcgattcttcagagaaggcagcatatgcatccttgcatgcagaattgcagatcgtcgatcgtcgtcggctacgtacagatcgatcgttgacccagtacaacaagatcgaggaagattatacaattgggaaactctaatcagatgattaattgtcgtgtcaggaattgggggttggtgctgggttagccagggtaggtagtaatgtcgacgctgccgtaccagcaaccgaacattgcatatgcctgcctgcatgctttcttctacactctctgcagctagcagatgagacttcaatttggaagcaagtttcctgtcaatatatctgatggggatttcctgtacattttttcagccaagtttatacagaatccttttaatttgctcccagcaagtttaaaaagcatctagcatgagcaccatacaccaattagaaagatgtcaaactagagtggataaattaataagaccaatccctaattaatgattacccccattgacaaagcctagatttcatcatccaacattacaccatgcacgcaccactgaccaagtgagatcagacagtggccaccacacttccaaaaaccttttatatttccccagttgcatgttgtgcacgcgacgacgacccacctgtgcgacagaattctattctccaatttgccgccgagataaaatacatcaatcgatcgatcagcaagcaatcaacaccaccacctgatatacatcgatcgtggattaattgatcgatcgagatgcatggctcagcatgcgagagaaatctctcatgacatggtagatctagttggcaccgagccaccatgcatacacgttagaacttagaaatgtaagtgaaccgacacgtgaatctacttatataaataagtgggtaacttgtgtgttcccgcgttatagcctgacttgttgcacatagggatacaagtggattaactctatacctacttatagatcaaattatcaggtgatccgggatcaatacacaagttaattatccactaattttacctataaatcgattcacgggtcgatctactcgactccctacgcaagcatacactcgaatgcatccgcccaattgagattattgacatgcatgcatgcgacttacctactttgtccaccgaatcatcggccgtccaactgaatgatcggacgtacgaactccgtccaaaagggaatggggcccaccacgacgttgaccgggttcaatcttgactgccaccgtggcagcaatgcattaggcatggcaccacacccctaaattagttggtctccagtccatgggtgaagtgtacgtgcgagtcaatgtagaagatccccttattaaggcctaactaaacgtcaaatctgtaatgtgtgtgttggaagctatggctctccacgggaaccaagccaagtgatcgctccactgaaaattctgaagaaaaaaaaattctagaagatggagatcgatctgcaatgcatggtagaagaagattcctactgctactgctttctactccctccgtcccataaaaagctaacctagtattggatgtgacacattgtagtactatgaatttgtacatttgtccagattcgtagtactagaacgtgtcatatccggttctagtttcgttttttatgggacggagggagtatgtgctcacactacactgacatttcggcccacccaccagactcctacctttcactgagatgatactagtagtaatttttcggaccaaaaagataaatatagaactaaatgtgacatattttactacaacgaatctggatatgacagaggtatgtttaaattcgtagtattaggatgtgtcacatacaatattagattgtttttgtagatggaacgagtagttacctagtactagttgcctgatttgcatggttgatcttgatagaaaggtgagggagtgtatgaagaaccaaacgaaaaggagcaaaatcgagagtcgcgctagctaggctccaaagcaacggcgagcagttggcaagctcatctgagccactgccagcccgggcccactggcagagccaggcttccatggccccaccattcatcgtcacgcccgtgccatgtgggccacacgccctgacacgctggaacgaacaagtactagtgcgagcaggagagccttttttgcattggcagccaacagagacaggcacagctgctctcctgctgcctgctgcccagctgcatcagagtatcacagaagcaaagctccaaccagctaaattctagtttaatccactaccactaaccaaaaaaaaaaagaagctaagataaactacaacagctaatctctcactgacattgtggggcccagtgcaggtaccgggccactgagcataattaagtgaagtgtgtgcacagtgcatgactttgtgattcactatcgaacaaaaaaacggtgtggcatgagcatgagttgtgtcatgagtgatggggtgtactggtgttaggcaaaaggacagtgtgaccaccacctctggaaacatggaaggcacagagaaatctgagctataaattttggtttttttagtacttatcaatgagcattttttaatctgatcaagttagaggaataagtaaactgttactggtaatgtgaagttcagagtagcagaggttaatggtaagacaggttaagaaacgaatgaatgcgttcaatgagataaatggagcaaaaatatcaatttgatttagatacagagcgcccaaaatgaaaaaaagaattttcagctgctcaactgaattttcagctctagcaatagcagcaacagcaacagtaactgaagcttaagcaacaagacagagaattctccatgatctggtattctggttcttgcaagagatgcagagcttcttacctcgaatgaatccatccttgcatgcagctaggaagcagtttgtcctaccgatttcttggtgatctggagttggcagccatggatgatcagctggttggtggtgtgtggtcactgtctcgtgctggcgaactcggcgtcgtacacggcggagagctcgaagtcgtcctccattgtcgccggcatgttgagatcgatggagccggagctctcgccgcatttcgccggagacggcgagggcgagggccgcgcgccgccggatggcatgtgggcgcgcttgtggccgcccagggcctggccggagtcgaacacgcggaagcagaatgggcactcgtggatggccggcgcggcggcggagctcgccggcgccggacgtggcggtggcacgcagccgccgcccttgcctctcttgaggctcgcgcggtggccgccgagcgcctggtacgaccggaacaccttcctgcatgcgccgcactggaacctgctggtgcggtggcgcgccgccgccgcctcgccgccgccgtagctgagctcctcgtcgtgatcctcgccggccacgtcgcgggcgtcctcgtcttcttcgtcgaacacgttgacgacgttgttgttgttctgctcggcctccgagctcgccccccggtggtgggtctcgtgctcggatctggaacgcgtccacgagtcccgagacagcatcaagagcgacatggccacgtcctcctccgtcgtcgcgtcggagacgctgctcgccggttcgggatccggcgcgcgacgccgccgccgcgcccgcttcgaccgcctccggctcacggcgaagaacgaccccgctccgccgcgcggcggggacgactccgtgtcgctctcgccgtcctgcacgacggaggatttgccgcggccaccaccaccaccaccaccaccggagaattcaccggcgctcaccttgtagctcctcttgggattctcgcgcaacacgtacgacgtcagcgtcttctcctgctccgtcttcttcgtcatctccttcttctcatccatctcgatctccgtcgacgacgtggacgccagtgacatcgccggcgacgacggacagtacgcggcggccgcggcggcggccatgacatgggagcgcatgtggccgccgagagcgcggccattgtggaatcggcggaagcagagcttgcaagtgtgcttgtccatcaccagcaaaccgatcgatcgatcgatggatcgatcaagcaagaattcacttacttgcttgagctgagctgagcagctgcttcttgcttcttgctttgctttgcttgcttcttttctcctccctttgctttctcctcttggttggcttttggctccaaagatgataatagttttatggggaagagaggtagaacaagtgtgaggagagtggggaactcaaaaaggagtaggtgacaagcatccttccaccaaggaacaagatcagcaaacaagaagaagaaagaaagactgaaagaaaacaagtgggagaaggaggtgacagacaatgccacttaaatacacagcaatggcagggtgagagaagcagaagttgctcaagggttttccctgagatttgcaaaaccgaagatccaaagtaattaactgctaaagatggggtgggcccacctgtcaatggcactgtttcagaaacggaaaattggtctgtaaaactggccacaattcaatgcaggatcaacctggcaaatcttcaggtcaatatactgcaaaatggggctagtgggagttacttgcaatttcagagtttgatgcattgccttttctttagcagggaattaagcaatataggctgtcacatgcctgttggcgcaaacaatggagggaatttataaagtaatttgtgtgatgcttttgtggaggtgcattggatttgaccagtgggagattatgtgctcatggccaattgtgagccattttttttagataatgtaaattttaagggatttagataatgtattgtgagccaataaattggaagggattaaacattgagatacgctcaaatctccatttcaatgcctccttcaattgatcagcaactcttatcttggtgtgagaagattaatttagctagggggacatatatgtaaagcactaaagcctatcctgatctccccaacattaggttccattttgtggaaacacatacttgcacagtgggcaaagaagtactgcaagatgtgactgtatacaactacacatttcctggaactaccacagtagtagaatattaaattatcgatatcatcttgttttactcaaagaaaaaaacaaacatgttgctaattagggatgatcccatatgcaggggtatgttcaattgacatggatgtgcgcacgaattagcatgccctttttctgtcggtgtgctgattatacacagaccaaaattttcagaaaaataatttatcacagccagatgagatcatgagataaccaccggttgctagctaatacatccaaccttggttcagagaaaattgtagatgggatggaaggaataatggcaatgaaaagatggtgtctcccttgctttatttctccaattcatcctcctttattttctttctttttggttgtatcgaccacaccagaaagatgagcacgcagcagacgtcggcgaatgaagctgtccatccacttcgatcagtagccaaggaccaatgtagcaaaagctgaggtttaattaacagaatcatcagccatatactactatataaacagtgatgcatgcaacctggtcaagctgtgatccggatattactgtggccatcaacgcctttcttcactcgaatcatgtcgataatcttgaattgttgacagtggctgcgctatttttggaacatatgcaagcagagggatgatgataagatcggtgaaaattcattgcacatatattaatatatatactcctacctctgtaatgatttattctaattcagttgcctactggagtatatacatttttacacgtgcatatcgatcgtattttcagcagtaaataattatttgctggtgctaggcactgccagcagggagtgttagttagcgtgttgatctgcatttggtgtgacctaatcgatggaggaggtaattactagagcattgatcttcttcctttcttttccttttagttgtaggttcacctggatggacttggttgtttatggttattcatcatgttgttcctcgaattatttgctccatgcttctataaaaattataatatttatctactgtatttattatgttcatagcatataatatttaattattgctacaatcaagtaaataatccatcacttttggccgatgaataaataaaagagtgaattacaacttgtgccactttttgttaccacggtttcactttagatcactcattgaccaacatttttctttgggcaaggtatttttacctttgttgtaatttcgaatactctaaaccacttatttaacgcatcaatgacctcaagcatattggtttcgaaacaccggcaaactcctccacctctctgtagaccatatcgttacagggagggagactagacatggctaaagattaaagaatagagttgaatagtccaaagtgcaacaaaattaaaaaaattagtcttaaataaaaaaattagataaaatgtgattcatagtgaaacttaaacagcgcaaagatggttgaaacttgaaagtacaaatcgctctaattaaaataagcactgctcatgaggaggcatggagagagcaaatctgtaccagctgcgatactcaatttaggcagatgggccacgtatgcatgcagctagccagtcacggccgtgagcattagccagggcccactggcccagcttggcgttggggcccacatcgcagttcacgctacagtgacacggtcttaatctagcaggtgatcgatcagatggaactacggattcagattgtgatagatagtagacagagagatcgaatcagcacgatctcttcaaaaacaatgcaaatttaatttgatcaaaaaattcctcgtttattaatttcctaccgatccaaaggttttcttttggtttaaatagatctaagtaggaagtacgtgtagttaattatggacttggtaatcgatcgacgtactgcacgttgtctgtggcggggacgtaaccggattctggccctacgtaccagcccgatcgatccaattaattctctggagcagttggtgtcactttttaattagggagtttctgtccgctgcaattcctctcgaatttttctttggaacgcagcaagatttcaaaaccacaagaacaaaaaaaaaagaatcacaggagtatgatgccatgatataacgtctccaaaggaaataaaaccattggattttgcaaagaacattgtttcgtagctccatgcatagaaagaaacaaaggaagtttataagtcaaaacgaagagaaaacattatgttagacctcatattagttttcctttagaattcctataaatagcctatttttacaggattttcaaagaaagttgaaagagtcattcttttgtttcaaaataccttatactacgtacgaattatttttagagtgaagtacatgagcggtctctaaacttgtaccggtgtgtcatctagatccctgaactcctaaaatgcatttgtaggtccctgaacttgccatgtgtgttatatagatccaaacaggttctaacccactcaatgtgctgacgtggcaatgccacggtgatgcttacgtgtcagtggaatccacatgtcaataaaaaataaaattaaaaaccatattttctcctcttaggtagacagaaaaaaaaataaaaattttaaggtagagaggagaaaatatatttttctaattatatttttttctatgtgactgacacgtggatccaactaacacgtatgaactatcgtggcatgccacatcagcgcatggaaggggttggagctcgtttagacctgtatgacactccaaaacaagttcaaggatccgaaaatgtattttgagagtttagggacctagatgacacacccacacaagtttagagaccgctcgtgcacttcactcttatttttatatatgtatccaatcctctccgaacttcctctaccttttctttgttccaaaggagcccttaaattaatgagaaattttatagtcctttagaaattacctgaaggtaccaagatttacactagaaattttggtataaattttacattagaaattatggtatctcttggtaccttctaaaggatggtaaaattaccctaaatcaatagtctaaattatcacttgaattttaaatcctgaaaatcagtaactacaaaacttagaattaaaaagaaactatagcagtcaaaagttaaaaattttaatatttttatattctcacaagctgactacttaacagccgcatccgagaatctaaagctttgtcaaaggaagcctaattaactcgtcgtattagctacacgtactccagctcgtacgtacgtacgtacgtgtgctgagttagccagccaaacctgcgtacttccgttgcgcccatcggcccatgccatgctttgcttcagtcgtctaaaagtctgaaacttgtatacacacacacacacaccattcgtacgttttgcaatcggcatatacaaattgatcgcagtgtgctgctaatgtacatgcatgtagaattgtagatctatcctacatggcttatatatatgtacagatgtactgatctaccatctctatttaaatgtattttgatgaaacagatcgaagaagtgagccatgagtatagctagctggctggaagcaagcacagcgcaaaagctcagtactattactttggtcatgcacatccggtgaaccagagtactagctatagctagctgcagcccatgatttctcatcagcatgcacggtcagatttcatatacagcacttagttcaacaattaatataccccaacagcttaatgtacagtacatatactctctccgtttctaaatatttggcgccgttgacttttttaaatatgtttaaccgttcatcttatttaaaaaatttaagtaattattaattcttttcctatcatttgattcattgttaaatatacttacatgtatacatatagttttacatatttcataaaagtttttgaataaaacaaacggttaaacatgtgctaaaaaatcaacggacggagtactactagtgtacacgtacacagtgcccatcgtggtgcactgctggtatacagtgtactataattaaagaaccaattcaaccgagacaccgagtgtatgtatattggactcacaatttaattacaagctagtactaactactagtcatgttactggttgatgttacctaaggatcactggcttacgtacatacatgctgcgagatgatgcagtatgcaagcaaagaaggtcatatatggccctcttaattggatggcagaattaatatagcttaatgatttatcataattgttcaaggttataaacaaatgaattaaactaatataaagatgaaaaatgattttatagtaaaccatattcatgtacaaaaggatttgtaaaattaaatcacaccgtttagaagcctaaaaatacgtgtgctaatctattcaccagttcatcagagaagaaacaaggccaaatggaccattgcatgcatgcatgagctgaacagggtagcaaccattgatgcatgcatggatggatgcatatctatatacaggccggcatgaggcttcacgtgaatggccgaacggtagaattggcgttaatgtgctagctagctagatcgatcgttggatgctgcatgctgtctgtgtgtgcagccaggggcctggccactgcagcttgctccacgctacagttggccaaaaggttcgaggcccaacagcccggctcacggcatgagattttgatccggcttagttacgacacagcccaattgttgggtcgtgtttgtacctctgcctcggcatggtggaccggtccggcacggtccaaagatcagggaggcaaaatggatgagtgagccaaagtagactgatcaaaccatataaggcacgatgaataagtctattttgcctctctcatctcttgtcctcgatcgaatcgcatcccctaaccacaaaaccgggtataacacataccccaacttcaaaaatcggtataaataaactcctttggtggctttggatgtggtttttgctgacgtagcatgttgtgacttgtccaaatatggacgtggtagccaatcatcaaatgaattaaaaatagaagtgggtcacacgtgtaagtgaaaggggtaaaagtaacaaaatgcgggaaccgcttgacagccccccccccccccccccccatcttctcttcttcctcccttctctctctcagccgccgccgacgcgctgcgcacgcgcacggcgactgggcggtggtctctcaatctgatcacggcgatgaaatcaacggcgggaattttgctcctatctcctcgccccgcaacgatagacaaatccggagcacgtctacacacgagtgaagtgaagtgacgagtgagtgaggactcaggtgaggatgcaaagatatggcaaatagagggagtacgttgttgctgttctttctcgttgatgtattaagcccaatcgatcgatgcagtggaggcttttgtctaagataggcaagccggtggatttcgagagatctgatgcggctacggtggctagtgggagcgaagccgaacttccctttgcgtcgcggcaccggccgcctggtcagcctaaacggagcgggtttttggggaggcgccaatggcgagctcgtgggggtattggaggcggagcggtagatccatgctaaagctggtggtggccttgtgcttctttgctgtggcatctccatgaccatgtgcttcgtctgcttcagctcgatcggattgcagtggcagtggctgtggctgtggattcaggtggcacactgtgctgctccgtttaggtaatgagattctgcgcacttgttcactccattttggtagtctccagctcagtggctagttctgggcagaacctacttgtttggtgtttcatcgccgttgatttcattgctgtgaccagagaccaccgtccagtcgccgtgcgcggccgaatcagcctcagcgcaggcgcagcaccgcagcggcggctgcgagagagaaatagaagggaggaagaagagaagggaagtggggctgtcaagtggcgccgccattttttaatttttacctctttcacttacacatgggacccacttctatttttaattcatttaatgactgggctgccacgttaatatatttggacaagtcaacgtatcacgtcagcagaaaccgctttcataactaccaaaggagtcaatttatatcggtttttcaatttaggggatatgttatacttggttttgcggttgaggatacgattagatcaagagcaagacatgagggaggaataatagacttatttcaagacacaacccaaatagacaagggatacaaaataaacttattctagccatgtcaagactgtccaaaaagataagggagccaatagactttttccaactaggagcacactgagcttttgtgtcttcgagtcgggccgtcattgcctaggccaatggttcaacaagtgggcggacacggcccaactcggcgtgtaggtcgggctcgactgatcaaaatatatccaatgttatactccgtatttaatgacggcggcgacggtggtgaaacattgggacacaccccgattaagatggaattcagctaataaaataaaatatataataaaatattacagcacatttgcctaatgctgacatttaagtgtcactttattaaattaattagcagacatgcttcctcgtgaagttggcagctccacatgcatataatcaacctgaataaacttaatgttgttcttagccacaagataagcaccaacgaagtttgtctggcactgtggaaaaacaccatcagctaccatttttgattctttactcttccatttttcaggaagtaaaggaacaaaatatttgtgtctttgcagtgcgaaacagctacagtaaaaatatttggcgtaaccatggtcttatgatccctttcataaaaagccgtactcggctttgtattaattttaggccgttctttcttctttggctccataaatataacagttatcataacaacttttttacccttaccatcattcacataaataaaatttataccaaccaaaataacagaattatgtgagccaactaatactgatatgaaagaaggattcttgttcacatcaccaagtttgagcaaactcttctacccaagctcgagccgagcctattgtaccttcgagcttttattcaagctcggtttgagcttgttcgagctcaagctcagcaataagtagtataatatatattattttaatgataatatcctgagaagtataattattttctatttgatcacactaaaaaaagagagtagaaaatgactaagataaatgtattacgctaacacatgctagtttcttgtgtaattagatactaatatatatattgatctattagtttattaaatcaataatgtgaataaacaatatgaactacacacagtcaagctcggtaaaagctcgagttcagttcggtagagctttcaagcttttttctcaggctcaggttaggctcgtttggagctcgatccaagcttgaatcaagcataggacgagtcaagctcgagctgcttgctaagcctcaagcttttttgacagctctaatcccatagtacggattacgggttatcaaagaaataatcaatcctattgcatggatatatgttggtaatataaaatgcgaaaattaagatttatagataaatagaggggtataatcagtattgtacaaaacaaactaaacctagtcattgttggatgtcactaacattgacactgcatctaccttatagttcaacaaatagttttactcattcatcattcatcatatcacacatccaacgatctaaagtcatctgatgatttacatccgatggcactggaggcgcgcctctcctccctcccagatcctcttgtcccacaccttcttctctcccacttcgcatccatgccgccagtattgccgcgatttcctccccatcccctccaacaacgcgatctccgccaaatcccccgcaaggccgcaagcccgcaacacatcccctcgcatcgcgttccatctctcgctagatcactgtcgcctcgccgccctcacggtcgcactgcataggccgattcgacgccgccacgagtcgctgcccgtcttccgcggccacgccatcaccgcctggccgatcgatccccgtcgaccacgaccacgccgcccgccgattgcccattgccacccgccgatcgtcgacctcgaggttgattcccgaatatgtttgtttcgctcatccctttttccaatacttgcgttgccgactaacttccctcgatcagccgtacacgattcaccgccaccgccagtcgccacattgctgtcagatccggttcttcgccattgacatccaccggtcgtccactcccacaacgccgctcacgtccttgttcaggtattaggcatatttgtggcatagtactcgttctcagttaaatctaatgggttttctttctaatttctgatgaaatagatttgctgtgtagtcaaattgaaggggagagacttttatatcagatcactgccggcatttatcttcatgcttgaatttttacagtcattttgaaatgagattggctgattgggtgtgttctttctgggatatattaggctgtagctatagtagttggtcattgattaatacacctcctatgtatgcatttggaagctttatgtgcacttccaccaactaaaacttggccagtaactgactaactgccgaaaagcagccttgttaaaagaataacttttctgcatttgctttcagggtaaattatgattttctttttccttttctgccgtaaaattctcttccagggactgtcgtgaagcttctcccctgaatttgttagctgtagcatgtgacaatccaattattgtggactgtttaaagaagaagcagtacaagcttttattaaataattactttaggaaaaacagagcagcgttttccatgttgtttcagtgtactattatgaactgtggtttctaggagctaattgggaggctgctgatttttaattgtttaggtttggatatcatgaaagatcccatattggagattatttgtatatagcatacatgaaacttatcaaacaaacttgcagtttattaaaaaaaagaatagagttatttttttaaactttctggaaattcaaaaaagaatgcatctgaatcttctattatttcatattcagatcgtaaagataaacgtggcaacaattataaattgttatctcttgtatgtgtcagtctgcatatgtcaggtcagaatgactcttgtttgctgcctgaatttatgagatgactcaacaaatgtgtttttcacatgtgcagaacaacggcaattgatagctcaagtgcttcttgtagcaaacagaaaactttgctccattagaaggaaacaaaccaatcgagaagaaagcaggtgagagagatgttttatagtcatcccatgtgaatagctttaatgaatggatatgtatacattagataagcttattatgagagtaaattgcatggattgtttaatccgttgcactcttcaatgctgatccatttgtagatgactgtcccttatatatgcacttttcattgactcgaacaacatatcattgcagggccctgtaatttaatttaaatttataattatgccaatgccaaattttgtaaagataaatttttcaggttcagaagttcacagtataaaatctatccatatcctgaaattaaaaattgtactaggtttgtatcgtcaaaggaatggtagtgatattttatcgcaacacagcttgcagtcaagtaaacatctcagctaaactagcattaccacattgttacaaacgaaactagagagacagtgctagctgttaattgttggattatacaaatgtgttttaagatgttaactatatcatcagtaacgagagtaatttatagaaaatttggaaaactcaataacataaataagatttatgctgcaaaaaaagaacgtgatgacgatatagccgagtaggtccgagacatcaaattaaggttctgatccgatatacgaaaattcttttaatagtattttataatttaagagtttattgtgaaaaacatataaaacatttagtgttttttaagaaataatattattatgatagaatatatgtgtattagtatgagaaaaaataaaaaccctaacaaataaaagaatctttcaaatattttgtgattgtaacatatgaatattgtaaatatttaagtgtaaaattgaagcgtaaccgcataagaacataattcattttagtggaggagagacagtgagttggtggtggttggagatttataggaggtaggggtgtaggccagttgtttatctttttttttttttcattcttactacacttcactttttgtgaggcattggaagggtctagagcacccttgttttgatattaccgtttactctttactacctctccctatacaatccaatggtcttttttcatttcgatggacatccaacgggttatatgtgtttgatgacgctggctattcttgtgctattttggggttcacttttcaatgggaaagatgtgcatatgagatgccaagtggtggcacggcaacgctcgccggcgcacagacagagcgaacggtggggatgaagggggaaaaagaagaaagaaaggcagattcggcggtcttgggatttccgcgtaaacgtcaacaatttcagcccacggatccgctatagcaaactccttcgggccggaacgggatttctggtagcctatgaaggcaccggaaaatatttgggagaataagtttgcattaggtccctctatttgtcgttttcgtccctgaaccacaaaaccgggtacaacatgtcccccaacttacgaaaaccaggcaaacgaggtccctcgatggttttgatagcagttttggctgacgtggtgcctacatggctaatttgactcggtcttcatccgacgtggcacagacgtggcgcttacgtggcaatttgatctaagaaaaataataaaccctgtgggaccacatgtcagtttcacacataaattaataaaaaaaatggtgggacccacatggcccccacatgtcatcctcactcctctccttcctcctctctcccctttcttcatctctctcccctctcctctctcaggcgcgatggagagggagcggtgcacgccctgtgccgcaaccagcctccaccaccgtcgccttctcacgcttgtcgatgccatcggcagcagcaaagcagtgtgcggatgtggagaaagagggaggggagagaggagaatacaacctcaccgtcgcccctctcttttccaccgccaccaagcttgtcagcggccgcccgtcggagcgaggagcttccccttccccttcttccactcggacggcaccatcatgcgcccctttgtcccccgacacgccgccctccgccttcggcccggtcctctcccgcgacgtgccgctcgacgcctccctcaccacctccccaaccccgtcccgccgccgccaccggcatccaagctccccatcattctctacttccacggcggcagcttcgtcctcttctccactgacaatgtcttctaccacgcctcgtgcgaggccatggctgcgaccgtgccagccatcatcgtctccctcgactaccgcctcgcgcccgagcaccacctccccgccgcctacgtctctaccgtgctctggctctgcgacgcggcggcgggggacccatggatcgccgcgtcggcgagggaggtcgcgggtgtaggggccgtcgccgtcgggtgcctggccctctcttccctaccctactccggccgccaccactcctccccgccgccaccgctccgccccgccgctcaggctgagagagagaagagggagagagaaggggatagagagaagtggtagtgaggatgacatgtgggtcccgtaggttttattatttttgatcgaattgccacataagcaccacgtcaatgccacgtcaaatgaagaccgagtcaaattagccacgtaggcgccacctcaaccaaaaccgggtcaaatactaccgagggaccttatttaaacggtttcgtaagttgggggacctgtcgtacccggttttgtgatcaagggatgaaaatcagactgggtgacaaatagagggacccaaagttaacttattccgtatttgggcctacgtgggattctcaacattcgtcaagccagcaatttgtgtacgtgatgcgccgcgagttgggctagaacatgtgatgacgccctgatgtgatgacgcgtttccgatcccacccaggacctgcattcttgtgggccgaaggaaagaattacacggacctcgtggtggaaaaaagttcacctgaggttcctcgtattgttgccaagttacaaaatcgtccataaataaccccggttttgtcttatgtggtagctgagttaacgtaagacccatatggcagcacctcaatcttcttcgacatctatcctctcttttcccatctcaatcaagccttcgggatggctggcaacgggcggggagaaccggggtcaatactgcctaagcacctataatgatccggttatataagtttagggatgccatatatctgattttcggttcaaagacgattttttaacttcgtgacaagatgggagatcttaggtgaacttttttcctttgcgaatacatcaatgtttgctagcctctcctccctattgtgttggttcattttgcaatgggaaaaaagtccacttacatccctcaactaatgttcggtttcatttaaccgcgtctctcaattacaaaaccaggtacaatgtagccctaatctaaagaactggtagagaaagagatggggtgtttacatccaaatttggcacctaggaataaaatagagaaaattaccaaagtttggaagtctgccggttttcctctgagatggccggtctgaccgccgtgcgttggtcggtcagaccgccgccagtaggtctgtcagaccggcggtgtgtagccggtctaaccggcagagtccgatcccgagtctgtttcgtcgggtttcgagttttccttgcttgggaagtcatgtttcgggtttcctttggtttctatcctgagttggacgtggaggagggcctgtagagggcaagaccaacccctatataacggacaaggccggttcaattgtcaagacacaatcaacaatcaatcaatcgaatcgtttttcacattgcttttagtttttacttagtttgttcatctttgtcgatttgcgctgtaaatcgtccgccgccgctgcgagagtacgacacctctttgtaggtttgtcctgaaaaccttccatttttcccacgagacgggtagttatccatcattctatctagatcggctccgctagctggtttagtttatcaaaacccatcttgatttagcgtttgctaaattgaggtggttggcaactctaggatcaccgcaaagctttaggtgttgcaattgtgcttgtcaacttgtcataaaaggttgccaacacagggatagggatttttttttcgtgtgtgtctgacatgtgagtctcatcgtatttcatttctttttgttgaccataagtatcatgtactccctccgtttcacaatataagtcattctagtatttctcatattcatattgatgttaatgaatctagacatatatatctatctagattcattaacatctatatgaatgtggaaaatgctagaatgacttacattgtgaaacggaggaagtaggatcttgggattatatttacatccgttttataagatgaggttcccggtttttctggttgagggactcgattgaaactcaactcttatataagggacaaaaggtggactttttccttcagcaattaacttgttcctccaatgttaccacggccacaggcaaaggccagcggccagccgtgggccatccaaatgcgagcgaccacacaacagcatctcatggcgcagacagagagaaagcgaaaactcggtccatccatccatctgggtccaagctgaagaaacaccaaatgatggagcacggtcttaccgatcgttaaccggtcgttgttccacgaaacaaaccgactcgccgccgccctgccggcccccccggccagaccggcccggtagttagtggtccagcaatgtccaccagttttttgccccgagactggattggacggcccacccgtcatccaatttccatcgttgataattttgctacttttttaaataatggaaatggattacatttccggcctctacccgtaggcaaacaaccaaaaaaatccaaaaataaacagaaaaaagcttaaaataagataagatgggacaaaccccccaacttctaccaataatatgatatactaaaataatgcttctaaaatcacgtagattctatcacaaaattgctactatagtttggttatatccacagacatgtcgcaatccgactaatccaagtgtggctttaatatggtggccattccatatccttcccttggtataggcagcataatgattcatcaacgtgtgatgaggaaccggacgaggcagtgcacatggggggagctcagctgagctgctcccttgccgctttcaccttttcaatgcccctgcctccttgccaaagctaggccaatcacaccaacaaaccaaaaaaacaagaacaaaaaacgtactactaatgtcaaatgtggctgcgtagtgtaccgggctgcctctcaacgtgggcttcattgtctcggtattttgctttcctctccaatcctcctcactccgggtcaaattggagtgacgtctccaacagttgatcactggcatattgtcatgtgaggccggatgaattttcgtgtgttttttcttttcaacgaacctgtcacgacaaaggccgacgtgcacatcactccggtcacgttaatcacgggatatacactcgggtcagtcagggccggactccctgaaatccgaacagaccacgtctacattattccgcccggtaaccaccacttgttcccctgatcctcccataccataccataccacactgcaattctgcaagcaacgcgaccatctgtatgtgccaccgtgcaaatggcagctcacgtgttcacttgcttcagcttgtaagcaactgcaaaatatatgaaactacgctgagttcctgtcattctgatcacgttgcaagttactcgcaatcgatctcgccgtgttctctgcaccgatcagcctgacctgcatgcatttcaggatggataccaaaagttcaaagttcaaacattccgtctgcaggataacaatggataaatagcgtgccagacaacaagaacaaaccgatgcctgaaaagcaggccccaaaacctgcaggtttgttactactcctactagtactatccacacatcataacacactgtacagccattggtcgaggagtgcacggttttctctttctttcttccttttgcgtgcagccgtagccgcgccgcagcgagaacgcggggggcgcggcgcggcggcagacggggtgcacgagcgcgaggcgggggatcggccggcgaaagctcagtggatggatggatggcgacgcgaggacgggtagagtgagagagagcgcgcagtgggtcctggaaatctgctgcaacagcgccgttttgcgtgccgaatagccaaaaaaacaaacaaccaaccggagaatctgagcgagcgagcgagagagagcggtcatatatgcaccggtgagcagcagccgtcggcgtgaatccacattgtctcagcccgcacatgcgccgtcgcagtcgagcctgtttactttgtcctctttttcagtctgggtaactgtcaggtgaacgtgagatgtgcaagggtatcgttcttttttttcacatatctcacgtaaacaaataaaacataaaaaaatactagagtatcgatatttttatcgaatgtaatacttttactttatctactgccaatacatttatttcatatttttagaaattctgatgtacttcttccgtttcatgatgtaagattttctagcattgtccacatttatataaatgttaatgaatctagacacatacatatatataggagtaatgattatttagaaatgaacttatttggataagcgggagagaaaaagaaataaacttagtatgaaatagagggagtaattagagccttatttggttccatgggctaatgtttagccctcaaggatccaaacaggtgggctaattttgagctaatatgaattagccccctcaaaacattagcccctccaaggggtactaatggggctaattttgtatggggactataaaaaaaacagctctctctcatctctttctactctctctctaccttttagccttgaattagcccatggatccaaacataccaccctaggctaatgtttagcctaccaattcatgactaaatattagctctcaaaattagccctgggctaatcttccaaacagggcctaggtgcagtggaattcgagcgaaaacttttcgaattaagcagagccaggaattgaaccggtttatggtgagttccaaaaaaaactattgccttcgatcactgatgtgaagcacaaaaaaacaaggccctgattgattctatggactaattattatctctcaccttttagccttgaattagcccccaagaattaaatatgtgggctaatttggggctaaagtgaattagccccccttaaaacatcagtcccttcaagggatgctaatggagctaattttatattgggactatcaaaaagcagctctatctccctctctatctactctctcttcaccttttagtccatggattcaaacatgtcactctagactaatatttagcttatcaatttaagactaaacattaggctaatctttcaaacaaagcctaaatcctttgcaggcttgagctatggaatgaccagtcatgtttctctgctggcacgcatccagagctgcagaaagaatcaagcttcacggaatggggctaactttctccatttctcgatgaccgattcatcgttgacaagtgtttattacagtagaaaagagacaagttcttcagcgtgcatcacggttagtactcccatttatgacctcaagccagtcgcatctaagttcgataggcgtgcagacactgaagttaaccttaattgtagtcaagagtcagctttgcaaatataagagcgatggtttaacgccagtaattccggcgagaatgcagttggtcggcaggtaattttgaagccggcgtcgttgccgagcctagctcacataacttaactgaagctaccaacgaccatgataacgatatcttggactgatagtataccagaatgctggggatttgtatcatttgggttcaatcagcgcagtgatcaccgtaattgagtatacttgatttgcacctcgcgataacaattatgctgaacctttccaggattgccaaaactagagaaagataaagttaagcttttcgctctgctgcggcctagcaagcagtacagttctgaaaaatggtatattccaagtcagcttgagatctgcctgcactttttccctttttttttcttgatctatttgtactaataaagtaccaatccctgactcaacctctaaatttaattcccagttgctagtgtgggtttgttagcctcattaaacctatctattggtaatgctgaccaaaactgactgtttggtttataatcagtacatgaaaattcggtaaccatttcctaatgaaattgaaaatttggtaaatccaatggaatctaaagttaagctgggggcaatgtgtagtaataatatcagtctgaaaattgttaccagtttttagcctttttttttttccaaaacacatagtacaaagcaaacattcatatacgcacacaagcacatcctatttgaaaagaccaaatcaacatatcttacaattaattctcaaaaaaaaaacatatcttacaattgatggaagttcttatctgaggtacgcccaattcgcttcgttccatatatatatatagactttgacaatatatggcagattttagtttggtttgctgggagcctaaagtcacctcaaactgggagcgtaatggtattctgcagtacagttctccaggtattagagaatggcatatttttcagagatctgctcctccggtatatccatacattgttgattcccaaatcaatttgatatgtatgtgagtaccacgaaagaacatggacacgtactacttaaccaacccgaacacgagattaaatcagagaatctatcagagagagccaccaggaagcacatgattaggtaattaacttaagcattgtatttataattctgtagccttaagatttggttacaaagcactgggtagtacagtgacagtgggcgggagagcacatgcacatactgtattactgtgcccctcctccattttcccacacatgcatcacttcaccacttcacacactagaccagacagcacatgaggcctcgcctaataaaaaaaaacacctcaatcccacgcaaattttgcagcagcagtagtagagaataaactaatcgatcgatcgatcgatcgcgagccaatatgattccatattcgatcagcagtggatgattgatctagctgaactggacgatggagcggtagttggagttgggggaccagttcgccgggatgacgttgttggcgacgagcgtcttgccggagtcgctgcggatgcggagggagaagggcgcctggaggcggtggttggagtcgaggcgccagatggagccccacgactccctcatcggcgtccagacgccggtggcgccgccgtacgccgacttggactccatgaggtcgacctgcacgacgtcgccgtcgaggtcctcgtactcgacgagcacggcgaagtacaccgggttggagccctcctcgacgtggaagttgatcttgaggcccgggtagttgcaggggacgcgcctgaactggatgtcgatgatgcccgagtggcggagcttgtcgttgagccccggcttggccatggcgccgaacgccgtgccgctcaggtcgaagtggtacctggccacggggtagtagttcatgtcggtgatgatcaccgtctcgatgttgcccgagcacgacgggtccttgttgcacctgatctgtaacaaccaagtcaaacaaatggtcaacaaaatgtgccgcactgcatgttactcctacatgcatgctatagaaaaatgtagtagtagtacgtcctgaccaatcaaatcaaatgattgctaattgcaaaattggtgccatggtgaagtaatttgactagttttttcgtacctggtagcatgagccgcagcccttgccgtccttgaagatgggctcgttgccgcaggaggtcatggacgagaatgggtactggttcacgttcttgaacccgcaagcgccgcctgcaaattaaaaccgaccaaataatgccaatgcgtcagttcagagaccaagcaaaagcacagatgagcaccacaagcatcatcagtagctgcaaaatgcgcaccgttgtcgtcagggccggcgccggtgggagcgccataccaggttgcccgggcagggagccagccggagccgtaggcggaggcgtcggagacgttgtagttcacaggatgccccttgcaagagccatgcaccacgagcacggacagaatcgcgaggattgcagcgaccttgctgcccattctggctgccatcctagctagctcgaaaaatcttcagctcggagaagagcagtaggctagctagaactggcagcagcagcagtagtagtggtagtaagtattgtctggtgtgtggtttgatggttggaatcggaggccattgccggtgtatttataggcagggcaaaacgagaggggaagggaaccaaatgtaatggacgagcaacacggcggcatcaaggggtcgttgcacccgacgtggccaccggccggcgtggtagagagagagctagctgtgtcacatggctagggagaaaatcatggacggatggagggttcggttcacgagttcgtaccattataaaatcacatctttggcagttatcccatgttatgatattgtggacgatacgtacctgccaaatgatcgatcgtatgaattttttttttgtggtaaggaagatgaatgatcgattatattccagaatatgtatatagtttctcgtttcagatttagatcgatgcatgcacagatcgattgcatgatgggtcattgacgttgtttcggggaacggaagagattccataataaggcaccagaaataaccacgcaatcacagagagagatcaatcagcaggggcaggttgattagggacaataatctcggtatcatttgaagcaatcatttgtacccaacgctcttctagggtgaccatatcattgtagtatcaccattgtgcgtaactaacgcgtaggtagtgtgaaaccacctagtgaccgtcctaaatataatcgccaactctaatattgtattgacagagtgacacggtagtgtgatacatatgtgcatagacagcatagttgcatactagccgtatttttgtcccttacaaaaatgtggatatatatggtagttacaacttacaggataccctgcaaaaagtgaatggaaagaaggcatctcactaagattcaggacacatgccaagcacgactttgctgacttcccaccggtgttttaagggcacccgcaatgattatttataagctctttacaagagatccatgtcagcatatttttctacttggaagtgattaaatgaagagagagagagcaaagctatctactaacctgaagatagtttatagagaaaaacgagacaatagattagagagctatagattcccatgtagacataccattgaagtggtttaatattaatctaatttattgctgagatgtacatgttttatagataacaccttactttaccattacaggtgctcttaagtaaaaaaaatgatgcgaggatataccgatcacatccacacagtgatacaatcattgacatatgcaccgtatcgagatacggtgctttgggctctggctggtgagtctggttatatagtagtatatacactgacacatccattagtaactgtgaatagtgaattagagcacccgcaatggtaaagtaaggtgttctctataaaacatgtacatctcagcaatagactagattaatagtaaaccacctcaatagtatgtctacatgggtatctatagctctctcatgcattggctcgtttttctctatagattatctccaggttagtagatagctttgctctctctctcttcatttaatctattccaagtaggaaaatatgctgacatggatctcttatagagagcctatagataaccattgcgggtgcccttactccctcaatttcaaattgatctatatatttcatgggtacaccaagatcaagaaaagctaataactctctcatactatatttactctagcaacaaactcaatgcatacatcatccccattatttcctagccaatagcaaatcaagatattgcatgtgggttataaatgcttgtgtacgcatggatgcatgcatcaatgtccatttattcccaggcacaaataacgaatagacctaataaatgaacacaaatatgtaaatcatttaggaataacctcaaaaaaaaactatatgtagatcaatttgaaattgagggagcagtactaaacatgtacaaaggcaatgtgtaaaaaactagaagaggcatcaagagaattttttttttatcatagcaaaggctctatactgcaaacacgggtcttaaacaccaagcatagcaaaggggttcttcccttaataccaggtactttaaataaagattactatgtccgtcccagaatataaagagttttagagttagacatggttattaataaagtaggtaaaaagaaattatagaatattatgattggttgataagtgaaggtttgtgggaaaattgaatggtgaagggttgtaattggttgagaatggaatgttggtgaataagttgttatattttgggacaaatcctaaaggctaaaagttgttatattttgagatggagtgagtagtattcatgaagaaatccactttaatttccatgggtgtgagaggcggatctagggcttgagcccccatgaagcccccacatgtttttttttcatacgtagataggagagcggactgttgtagctttgttctagtttgttcagacattactactattcttcttggatccgcccctgatgggtgttgatcctattatagagttaggtgtgttctatacactacacaaatctctattatatttatgcatagtgtgtgaactcaccttaattaatactcatggggtttatatgaatgctctaacactatctgcactatctactgattagctatacccagtgtcagatgtaccgtaaattctcaaggaattttagaaccacaatctaaatattaagttgtagctcggattaggcctgtgcaacaagcaagaccaataaaatctaaatacatgatattgttctggggtgaaacctacgtactcatgatgtagcgagttgaattaggttacactcctttttatttggcaaaaatacatttttaacacgaaatttgtgttccaaaatcaaagccatgagaattttaatttaaaacattatggacaaatcaatccataaaggaaccttaaagaaaaaagtgattattcaaaagataacagagcaagctattatagtgggtccataattttctgaatttttctccattttgtcctttacctcatccaaacatctattttcctagaatttatatgtttttgaatcatctattttacacgtgcatttctgtcctattcttgtatttttcatgtattcctctatttcaaaattatatgtttcaaaggagcccttaagtttcccatacggccatacccattggacataagtaaaactctggactcatgtttttaaaactcaagttcacactatacagcttcaaatttttgctgaaatttgttaggacatcacctgtcagggacccacgtctctatgactttacgtcagaggagctccgttcggctgggccttagctccaccattggtagtgaggtggatcaagttttattgatactttgtatataggatttttttttgaaccttcaggtatgcttgtatcttactttacttacacagctgtgggtgcgtcctctaatacatgttgaaagaaatgaatagaccaacggcaactccctactcttataaaagtccttttgaaagcggagttgagggtgtgagcacgactatgtctccatagtattggtactttgccaactcctacctattttgtactctctttacttgatataagttcccctttttttttctcaactatcatctagttttactgcttctaatcaaagaatggaacttagggcatgtttggtagagctccaactcttaaatttagtttcaggagttaagtctgaagtgaagttgtggagcagcctatacacagctccacctctctggttcattttatgagagtgcttcacccaacttcgctcttattttaggcagagatgaaattgtttggctgagctccagcattaggagaggtgaagctgaagctagagttttaccaaacagacccttagacaaagaattggctgatacggaatgcagactgtgatttaattaatttgtctttggataataaaattaagtcaacttcagttagaacatgccctaccccatcattacaaacttacaccacacaaaaccgcgcgctcacacgcaagaacatgcaccatggccgctgcaaccgtgctgcttccagcttacggtacatggcttcacgcaagacagtgtaatgaacctcgaccacacatgacggacgtttttgttgtgcgtacgcgcccggggcacctcacgtgcatccgccgtagtacggctcgcgtgtactgagcaacccatgctgctgctgctgctaatggtgtgatattgtactactctgtgatctgataagcaaacacaccgtattaattcagttcaattacaaacttggttttggtcacaatacaataagtctgccaatccggtatatatatatggcatattggcattgggtcatttgtcaatgtgggcggttcagagcaagcacatggatactgcgtgccctgcccctgttccatttcccacacatctcgctgacacacacaactacaaattaaaaagagagagagaaaaaaacgctcttaattgatccgttcgcaatttgcattgcaatcacacacacacacacacacacacagaatcgtagtacagtactagtgccgaactgccgatcggtagaatcaaaattcgttcttgaccggcgacacaagacgacgaaggcattgcatgcacataggtagatcgatcgatggatcaacggaactggactttggagccgtagttggtgttggccctccagttggccgggatgacctggtgggcgatgacggtctggccggactcgctgaccatgcggagggagaaggggccctggaggcggtggttggcgtcgaggcgccagatggatccccaggagcggcgcatgggcgtccagacccgcgtcggcttgccgctggggagcgactccatgacgtcgagctgcaccaccgtgccgtccttgttggcgaactccaccagcacggcgaggtacaccgggttggacccggcctcgacgtggaagttcacgtagaggccgcggtggtagcacgggacgcgcctgaactggatgtcgatgatgccggcgtggcggagctggtcgttcagccccggcctcgccatggcgccgaacgccgtgccgctcaggtcgaagtggtacctggccacggggtagtagttcatgtccgtgatgatcaccgtcctgggctgcccggagcacgacgggttgttggtgcaccgtatctgatgatgaggaatataattaagggcaaaattaatccatatgtgcatgtaattaagcagcagctagcacaaagtcaaacgctgaactgaagaacgtgttacccacggatttcaaggcccgttgaccaatcaagttgtgattaccaccaactgcagttaacgtggcgggcagtacggtgctcgtaaacaaaattatgttggtacggatttatttatgatcagaagttccatacccactgttttgtacacttttcagatgtagggtacaaaggttaatgttgagatgtactatttattggagaccgtgtcgataagccaaaacaacatatgtgatcacgaacgtggttatactatacctggtagcaggcgccacagcccttgccgtcctggaacagaggctcgttgccgcaggaggtcatggacatgaacgggtactggttggtgttcttgaacccgcacgcaccgcctgcgtatcgatcgaacaatgccaatgcgtgtcagcattcgaatgtcagaagagcacatacgtacgacagcgtaatttgcaaaaaatgcatgtactacacgcaccgttgtcgtcgggtccggcgccgttgggctggccgtaccaggtggccttggccgggagccagtcgttggtgtagacgacgccggcggcgaagccgtacgtggcgagcacggagagcagcatcgcgacgaccttggcagaggccccagccatcttgggaactccctctgctacgtacgtacaaaagcctgtactactaccttgtctgctttgtgttttggcgagaggagatttgcccgtgtatttataggcagaattaggctaactggcaaaaacgaaaaaaaccggatcgatcggcaacttggcaccgataagtcgttgcacccgacgtgcgtgccgtgtgtatgtgagagatcgatcgagcgagctagctcggtctagtcacatggcgctggagcgaatcgtggaggaatggagattaagcctcggtaaacgagaattcctattgtcaaatcgcatcttggcagggcggttatggcatgttggggaggtacactctcgtacagtgcagtacgtcattacctgccaatcattactatgtacaagtcaaccatcgcttgcagaaagtcggtcggttttcgtaaaccgtcggatctcaacacccaccgtgcttggattgttaacacgtgtatatatccctcctctcgctcatataggtagctaacgtacgtgacagtactgccctaacattcttaccgtggtctctaccgttacgagttacgaccgatttattaaaaaaaaatcagttttattattggacacatattacccctcccctctcctctgtcctcgccggatacgatgaggaaggggacagcttctcgtaagttttttgagtttttttcaatgtaggttggaactatttggtgtctaaggtttgcctttcatgtttttcatggaattaaatctatttagattttttcttgtcttttttaatctatgtgttgctggctacttcattcgtgaggtcctcgatggaaatcaaggagacttgcctgtcggtcatcaaatattacattgttggcgttagttttaggttccaaattgtcgacttgttcggtggtattggtttgctcttttgtcgaaggatatatgaatatggtgagcaatattcattttacatgtttttgcgtgtgttacaatgtcagcattgtggctacactcatttgctcatatctcttgcggtatttcaatatgtggagcctccttgttctgtgttggtagttcttttatttccagatattgcaacaaaaagagttgtaatctcttttataatttaatatgagctgccctgttttgcaaaaaaaaaagataaaagtttctagtaattgagctggtaaaaaaatattaatatggtcgctgtgataatataaaaatggaaggtttaggagaatatgatttctaccccttataaatatcatggtatttttcgaatctctcggttctttccactgcgtgtcatacagcagccctataatacaattatttttcgtgtcacaccaccgttatcttcatgacacactccctagtcattgccccatccccttccctgcacaccacatcattgctaatgtgtaccacttatagcaccatggacaagccaaaatgcttaaagaaaaacgcgagaagaagaaatgtatcgttttccttgcagagactcgctaacagtgatctgattagcgacaacttcaccataaataccaatgatggccaaacgcgatatttggtttggtttcgtataaggtttaaaagaggacacttgtcgttactttaatggaagatgcatatgagtacttatggagaactgggagtgttctttttagcttatcgatttatggaatatactatgtttcatattataaaaaaaaatttctaaaaaactgatcacatttaaataagtttatttagaaaaaaatgtttcaaaaaaagtttatttagaaaatatgtattataatacgaaacaaagggagtatgtatcgatgaatacttctccaaatacaccactgaaaactacattgtcgactaccaatgaaaaaatataattatttataaatacaaacacatctgttaaatctgatatttaaatatgggcgattaggtttcagtgcaaggagccttaccagcttattagttactcagttcgcttctcttttttcatctctttttttttctactccagtgatgtatagaaatccattatcttcatattctactctatgacgttgggttggattaggagacggaagtcacgggcagataagccagctagaaaccaaactgcaatagtatttccgtcgcttttatttcgtgagcaccgagcccgtacgcaagaaaaataaaatacgtgtcaaatgcattatggagcgagaaataacagtacaaatacaggaagcatacgacaaatggatacggaggactacgtggctcgccgacacggtcacagtcgagcatgcctttcatagttgcatccacgaatacatagatgtactccctccgttttaaaatgtttaacgccgttgattttttagcatatatttaatcgtttgtcttatttataaaatttaagtaattattaattcttttcctatcatttgattcattgttaaatatatttttatgtaggcatataattttacatatttcacaaaagtttttgaataagacgaacggtcaaatatgtgctaaaaagttaacagtgtcaaacattttgaaacggagggagtacatgtttaattacctcgatcatatccatgatcattggaatcaatcattttgtagtatctattgtctcggagcacgttcgttaatgcctgcaactaaccatatgcgtgcaaccacgttataccgaccaaaattcattttggtcgttgaaaaaagatatgatatcatcgtgatatgtgcatgtgtctaccggtcatgctgctattatcccataaaaattgtgaaatggtagctggacagagcgatcgacgctgtaaagagttatttaaactgatttctgacgtttcaaagaaaccacgtaatttcattcaacttatattcgaaaagaaaagagaataaatctattttttgaaatggagtactagttaccaaacttgtattttgtgatagccttcaactgtgcttatggtaagagtttaaacctttgtaggggtaggaaaaaacactcaggcttatattggtttggtttggctcgatcgatagccaaacgagcagagccaaagcctcctccgaacctcatttctagaatgagctgggttcgagctagctcatgagttattcggtagctcgcgctagccagcctattatagtttggtttatttgtctagctcaaagataagcactagtaaaaaccctaattctctctattcttttggggcagatgacagcgcaacaggagtgcatactcatgctacaccgccaagtcatgcacacagaaaatagcgtagaagggagccacatttgtacgattacacaatattgacttacgcctacgctgacaacgcaaccaactagtcgcttccccctcaattgaaattggaaataacgtcgccgctccttgccagcttgtcctcgcaggtgtagtttacaacctatgagtcacaagttcgaatgcctgggtaaggggcgtggtgcgctagacttggcctccacctatgcttcaatctctccaatgtctatcattgcttgtctgtttcgcaactgttcaagtgaagaggctcgtgagccagatcgagttggctcaagctagaaaacatagggcctgtttggggagctttagattctgaaaagtagctgtttggtagccagcttctaagaatctggaaaagctctgaaacccagcttctggcttcttagtttatttttcagaatctttaactacatattctcaaaagctgtggactgttaggggcagtttctagcagaagcagcttttgggaaaagctacagctgggacaagctcccccaaacagcgacatagtatttccaattagctgatttatatattagcatggactactcaacataatctagggtcatgataatccaacccatcaaattaacagccggttctttctgtagcttgtgagtatccttagagtgaccaattagtataggtataaatgctcagtctaattaaggttagacacaaatttgtatgcaagtgtagttgctctctcaaacatatgtttcttaggttaaaaagaaaaggaaaaaaaacattattcaaccagacacccgtataataagtagttgcaccaaacaaagttttcataatccaactcaacaacaaacaaatccataaagctatcgttaccaaagtgacaaaaaaaagaacaaactctttgtaagaaagtaaactcccccaagcatggcatttgtaatttccatggtca

SEQ ID NO: 58313 - DNA, 4960 bp, Oryza sativa
  unsure (1)..(4960): unsure at all n locations
tagtgttgattttactggaggtaggtgtatgtacctagtttccattttctttggttgcactcaaaaattatggatagattactcacagaaattagaggaatatgggttctttggaaactagttcgaatttttaggagccctaaacagagaagataaattctgaaaaaattatttttattaatgataaatgacctagtatttgaataaattattttacttatacacttctatgcagttaaatgcacttttagataaagtatggttttagccgattaagaactacagttaatctagtttttattagtttgactgatttatttgaggtgcaaatttagttattaaatcataccaaaattacagtgagttgtatgtgttgagtagagcctacatgaattttcccatgattttatcttgcacgaattattttagataattctcaagatttatgtcttatatgtgtttccctttcctaaatgcatgtaaatgtttataaaagttatatttggactctcattaacctgaggtgataatgatatgttagaatttcagtttaccttacacaggtcataagctccttacctattatgcacaagtttactttagtattaaattaagagaatgcttatagagatgattaagatagaatatatcctatatgatataatttatttggtcacttccatgttcatgactagtcttcagatggatgaccaaaatagttttgtggggcttggcattggccttgttgatatattttaaggtgtatggttcctattttaacttcctctagctagcactaggccctaatggttcagttgtttatctagatcttagttaatattcatgagacctattatgatatgcaaatcgaaaatccgaatgcaatccaaatccaaatgcatatgaaggactcaagtcaaacatgtctatgagagtatgcatgcttacacataaatttatatttttgtcctaggttagagatgcaaaggtttttaatttgttctaaaattttatcatgcaagagttagatcaacttcacctaggtttaaaatggaaatttttggtttacaaaatagaagaacttccctttcaactagttttgatggaaattccttaatcctagaattcaggtatgttacagtattccggggatcatcaaattcctatccatccggaggaccaaagtaagactacgttcacaagtccgtacggtacctatgcttattgtaggatgtccttcggactatgcaacactcttgcatcttttcaaaggtgtatgatgtctattttctcggacatgatcgaggacattatggaggtcttcatggatgacttctctgtctatggaaagaccttcggtcattgtctgcagaatttagacaaagtcttacaacgatgccaagagaaggacctggtactcaattgggaaaagtaacatttcatggttctgtgaagggattgttcttggtcatcgagtgtcccaatgaggaatcgaagttgatcatgctaaaattaacttaatagttcagcttcctcctcctgtgaacatcaaggggatccgcagtttcttgggacatgccggcttttatagaaagttagtggaaatggaaggttcgggttgtgtctcgattgttgaaggtttctctatcttggacacggatgcctctggatagggctaatcagattgtgtcatgaaggaagtattttctagaatgcgatctagaattacttttccttccgacggtgttttgtgcatgaatgatcctccgacggttatgtccagatagaatgccgattccttatccagactcgtatgaaaatgttgcaaaagcacatactcaggaaaggaaaaggttggtccggactgcactaaatcagtgaatatggaccaggctgcaccgatcgattcgtttttgatctgctggaaactgaggatctctactcgaagggcaatgatacgagtaactgggaagaaggcaaggcagaatcggtcacgcaaatatacaccaacacttgtggattatgtgagattaaacacctattactatgttcgatgttttattatctagactttatgcagatgttggcgatatagaatcagcatttaataaccgccaacatggacgtccaggattgctccataatgacagttggagggcgtttaggacatttcccatacaataaccgtcatctgaagcctataaatagagctcctctccctcattccaacacacaccaagatgtagagctgaattacaagaggctctaagtatactttagcttctttatatgttctatagtatacttagaatagggagagagtaaagtaaaagaagtcggaggactcccggagttgtcggtaatccactccttattcttgtacttttttaattactttggttcaatagaaatatcattctgagtaattaagattttcttagtgagaattattctttgttagttcctaataagcatatgtgatcattgttcactatagtccattaattatatatttattgctttagtgtttagctagcacaagagtagttattaattgcgtagacgtgttgtctgggcaattgatttccagtggttgctgcgtatcccacggtacgttagaggttggtgtagaggtggtgacagcgcataagagcacttaagtcctccctgtccaggtacgtagtcgagcgacatctgggaatagcgggttgctagtgcctgaagtatcgtgttaggattaaaattaagctttacttagacactgtttctcactaggaaatcttctctacctttatccatatttatcttgtgtcattgatgaaccggaggaagagataatcacacatgtttccttggattcgatacccttgaaatactccataggggaagtgctacatcggtatatccgtgcgcttgcggattctatctgtgatcgtaagaaacaccaacaagcatttctggcgcctgtccatatttttctattcttctacgttcaccctgctctatccgaagaagtttcctggaatacacttcttcctcttctatggagcaacctatctttgaattatctgctcatagggatgaattttatgagtgtcacgaccggaattaacccaacgggcgttccttacgtgtgtgtattattccttgtgctaggaggcaaggtacaccaaaagttgatacatttcagagtttatccagcggaagcataaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacctacaagtgcaggttaaatgcaagggagtacaagggggttataatataaagggttagggtttgcagtaaacagcattaaaagacacttagttgctcaaagctattttgtaaacacgattccagagctatacaatattattaaccaaggccgtgaacccacacgaacctgccttaacccaaggcctacaatgattcagaccgaactggcaacccgaccctgggtcccagcttgtcccaagccaacccagggcaaccattccacattttagttgttaagcaggttttaagaattaaaacactaacttcggtacattgctcggcttgcccataaccgagggcgcggctattcgaataggttatactctgatcagaggtgtagatctttacccacaagacacatcttcctcacatgtaaccacgtgccacataccaccatggtatacagacggaagacatgacatagtttccaacccatcctagccatagacaagagtaccgacccaaccctacctacggccggaacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgggtacttttgtttataatcaaactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataattgaaccattccataatgtccaggtgatatgaatattcccaaagtctagagttgtaaaaccacctaatgttgcctaattaagcggcgaagcatctacctaaattcatactagtggtaccatgagtagagtgtccactagttggggtttggtttattctagggtgaacaaggtaataataacaatagcaataataataaggtcataacaaaggtaaataggcatggctaaataaaacaatgataacgcgggaatttaaataaagcgataatgcaataatttaaatcaaaataattttataaattgggattcaatatgttcaaggatgatgtgactttccttgctccctttcccaaacgtcggcttcaacctccacgaagagcggatcttccgaagctgcagcgtctacacgaccaacagaaaagaaaaggcttttactctaataaactccatataacaagcagaaacaaagcacaaaaatgggttcttgacttcttaaggaaaaattagagacttgaatggtccaattccgagttcaaatggccaagttatggccatttgaagtttatatgctatttaaatgaatatttgcgaatttctttatttaaattntaattttaaaaaggtttattgcgtcagcccggggggaaggggtgcgccgacccggt

SEQ ID NO: 58314 - DNA, 7108 bp, Oryza sativa
agggagatgggccgacccggcccaaaggagggaagggggacttttagggtttttctttttttataaaacctttttaactttatttatttcttaattatttttttgtgctccgaaaattccactaaaatttatttacacatttcaggcttttaggaaatatacaaaaatcctctaagccttgtttgacttttactttgcacattttaatttttggaggctttcacacggattttaattattctaggcataatttaaaggatatattttagggtcgttttgggacgtgacaaatctcaatgacaataaagagaagagacagtggacgggtcgtagaggagtataatcgcaacgtttgacgggacatctggaaattataaaaacgaaaccctatatgacaataaactctaaaactataaaatccaaattttaaaggttccagaaagaatgaatagaaatagtgatagatcgagtaagcaaataaagaaagagatgacataggaggtagcaactggtgtgacttttaaaaactatataattagaaacacgaggatgatactggtgtaacttttaaaaactatataattagaaacacgaggatgataaggtttggtctttcaaagtcttaagacaatgagatagctatttaataaattttaagtagaataatactaaaaaatatatgattttgtttgggtgctagccgcgcaattgcgcaggccacccaggtagttttgaggtatgtggcaggtactctgaatctcggggtggaattcagaaagaagcaacaacaggttcctcagctgaatggctatagtgacagtgatatggctggggatattgatgatagaaagagtacaaccggagttctatttaaattgggagacagtttgatcagttggcagtcacaaaaacaaaaggtggtagcaatatcttcgtgtgaggctgaatatatagctgctgcaactgctgctgtacaaggagtgtggctggctcgaccaataggtgagttggaaggccaagaacctggttgtgcactgatcaaggttgataacaagtctgctataagtctcttgaagaatcctgtgcttcatgatcgcagtaaacatattgatacaaagttttatttcatctgggattgtgttgatcagaaacgggtggaggtggaatacataaggttagaggagcaacatgcagatattttaacaaagcctcttggtaagattcgatttttggagttgagaggcaagctgggattagttccagtctgatgcttcaagattagggggtgaattgttggattgtaatcttgagcatttatattctcttttgtttcgttgcatgtagagttctgttggagtctgaattctagccagtagaatagcatttttctgttttagcatatttgcttccttctttagctgcaatgactcggctcggatcgtgggatggcgcggtcagtagttgatccgagattgtcatgatttgattctattatacatgtaacaaaatctgtgtggagatgaataaatagaagagaaaaccgaaaaagctgcactgtattacgcagcgccaactctgttcgtcagttgttctgtacgactctgtattttcggaacttcttcagttagctgtagctgcacctacaagcgtcagagtgtgtgttttagagagactgagagccagttcgcgtgagtttttttctgacaaaggcgtcattagctctggttgcgtcttgagccatctcgttggagttgccgttgtcccgtggacgccgctaagccgcccaaatccatagacgatgaggcgttgccaactaacgcttgtccccatcaccatccgatgcccaccggagaaggccattctcaggttgccaaggggttggttgccgatacccggaggtcgttaacatatcatccacaagccgcgatggtattgtcagactatatgtgccggcacctgtcatgatgcagccttgctgggcagagatgccccacaaagactactaatcggtgacgccctctgtcccccacgctcatcgtagcctctgcgggttgccgccgatgtctactaaatcatcctcgccaatgctatgatcttcctcatgttataattgtcgagccacctgagaagaatgccggagcgccattgcttggtgcttgcacgatcgtcgccaagtccagccatgatcccttcgctttagctggctgaggtcgtcgtgccatccttccacgacgctttcgcttcggcacgtcgggatcatcctcatacccacaaatacggtgtcatgctcgccggtcttgaccgctcgatgacaaaatctttatatgtacaccgccatcgacgatgattgccgaatcgttgccgtcgccgatcatactctcagacccgcaccgccgaggcgtcttcatgattgtcatcgatgccggtgatgcgatctcgtccacaaacaggacgtatcctcgtcatcttcaacgatcattggcatacatttatccttgcggctatcaccgatggcgaacctgtttctggtcatcatcgcccgcactgattgtttctccgccaatgacaagcccgttcttgtcgtcgttgccggtaccaatcgtgcattcgtcgccaacgtgcaagtttggagccactagctgttttcacgaacattcttggcatcaccgcgggctggtaatgacctcgcgtccgtctcacgctgtcgtcacgctcgacgaccccggctgtccaatgacgaaattcttggatatatatacatatatctatgcatatgcaccaccgtctctgctcgactgctgccggcgaagatcttcaacttgtcgctgccactggcgtcatcatcacatgaatcctcacctcgccatctagtgatcacgagttcggcatccccaccgatgtctctcactccacaacgcccatacacatgacgtattatttcgtcgtggccgtcgtcggtgcactcccgagttaagccactacgatcgtaggcgacccaacaaaatttgggttcggctccgattgtcaggcacatatacaagagggccacccagttcctagaacgtatctcatcgttgccgggttaggctacgcccctaacatcccctaaaatcacttaatcttgagtgtgcagtgcaatgatcggaaggcatactcctgtaccacaatgatcttcagccattgtgctagaaaccagaaaagcagcgctatcccgagtgtcacggtgattggtcgactgaaggccataccaacatgtacctctacaccgagccagagacctaccgcgacgataatcgagcaaaacgattggtcaatgttctctcccaattattctcccactattgacatggcaccaagacggtcaagaagagttgtaccagcctcctagtgcttacaaccaaaaaacctatgccaactacatacgctttttaagactgatgaggctaaatggcacggacaagtggagtctatatgaagtcgatgtcacctacaccggcgcacggaccgacgaggccgtgaaccgctactagcgcccacacacatcgacaccatcaccaccatcacaatcatgcatgggagaatgtgaagcgaagaccgacgacgacgaccagcgtagcttaatttgaggtgtctcgcggtctaacccgcgagagtaattaaccgggtgttttccgagaccccgggaaccatgagaacacagtcgccaagtcagatccacctcgtcaatgagctgtggagcgcatttgaccaaggatttttgtatttttgtaattcttcaagaattataataaaatgcattttccttcttctattttattttgtgtacttagtacactggcacgcccacacatcttattttatttatttcgctgggtgaagagattggaagttaaattctctccgttggtacaatgttgtagagacgtaggatgcatctctttttgagcaaatatgcaagtaccaactggagtggagcagaaaacacctagaaaagaagagtgcatctcctcttgcttgtgtgcgagtaggtgatgcaagagtgaggagttgtgcacagctaggagtggatgaaggctaagccaaggcaacacatgagctcaagagagaggctgggtgtagccaggcatcatgatcgctaccagcaaggtgtatagccattttttaaagactcacacataatgcattctttgatctaaatgtagcccgtcagctctcttgctctcttcctcttctcccatctttttttttcatttttttgttgtctctcctttttttttctcttttttttccttttttcagcaaggtaagactaacaccaactgtaaaccaagatggtcttggttgatggaattcttcatgcaagctcgtagacctccctcccccacacttggtcttttgtgtcatgagacgtcaaaaaccaagtatgtgatactggggcctcttataaagcgtatcgcattaccaaggatcaccatggtgtacggttgatgtggctcccgtgttcttaggcatcgtatgaccctcgctcttaatctcaacgtgaaatggttagcgaccaagaatacccgaatgtgtacactatcttaaacacagtttcttgcttttattggaaagaaaacttacaaagataatccgggtatctcccggcagtgctttgtttatggtcttaatgtcacaccctgaaaattcaaaatttataaattgttgtttaattggaatttttagaaataattttaaaagtcttgaagaaaagatctaattttaattaataaattccaatataaaatggggccagataaaatttcattaaatactttgcttaattctataattcctagattttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccagtccggcccagtccgcagccgccgcgcgcgcgcgccctcgctgtcgctgacaggtgggtcccacctgtcaggcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcattcttcccgatctttccttcctcgccgccggccgccgtgggcctttgccgtcgcctccgagcccctttaaaaggacccccggtgtctcctctacccgtcgccaccctcgccttcgcctctcgtcgtcggaatcgctctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgcctcttcgccgtcgccggagatcaccggagcagcatcgccgtcgtcaacccgaaggttcccgccgcttcctcctcgtcgccgtcgccgtccgttggtcttcccccgccgtttaggtcaccggtgagttcgccgcgttgtcctctccgtcttggtgccctctgtttgcgtcctagcatcgccgttcgccgacgagcgtgcgccgttcgagccgtctcctccgccgagccgccgccgctgtcggtgatgtcaccgctgacgtcatcggggtcgtccgccgtgagccgccgtggacccgatcgatctcggccgtccgttttggatcaagttgatctcggccgtccgttcgtgtgaaccgccgcccgtgcgcccggtccaccgaaaccctagcccgctgacgcaataaaccttcttttccttttcaaaaataattcattattgcgtcataattcaatttaagccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgttcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattctttgttatggcccttttgtacttgattacttcattccttcataccttgggttattacaatttgactagttgagctttatttatattggttcaactagatattagatataattgcttagcctgcttagaaacattatgtcacgaccggaactgacccaacgggcgttccttgtgtgcgtgcattaatccttgtcccaggaggcaaggtacaccaaaagttgatacaattcagagtttaacaagcggaagcgtaaatagataatttattacatgggcagcgaaggcccagcacacacaaagacacacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgctgaataaatgcaagggagtacaaaggagttatactataaaggggttagggttgcagtaaacagcatttaaagatatttagttgctcagggctattttgcaaacacgaatctagtactatacaatattatttatcaaggccgtgaacccacacgaacctgccttaacccaaggcctacgatgatttcagaccgaactggcaacccgaccctgggtcccagctcgtccaagccaacccaggccaaccattccacattttagttgttaagcaggttttaagaattaaaacactaacttggg

SEQ ID NO: 58315 - DNA, 1650 bp, Oryza sativa
ttttagggtttttctttttacaaaaccactttaactttgtttatttcttcttaattattatttgagctctgaaaattccactaaaatttatttacgcattttaagcttttaggaaatatacaaaaatcctccaagccttattcgacttttaactttgcacattttaattgttggaggctttcacatggattttacttattctttgcataatttcgaggatgcattttagagtcgttttgggacgtgacacattagtacacattcgggacaacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacataatgtggggttgtgtcttgtgggtacagtggtacacctctggccagagtaaaactattcgaatagccatgcccgcggttatgggcgggtctaacaatgtctttcgtgattagtttcacacttctcaccttagtgaatgatgctataattggtaataatttgattagctcctggtttggaatggtatattcctggtttggagatagaactgtgcagccggtatggttgtatagaatggttgggcctatacaacagggtatgttgtatagtgttggattaatattgtttaattattacttaactgttttattaaattctgaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggagtaggtgtagccttggtcaagctgcctgtggagtggagccgtctgcgccgtttaatttatttttccgctgcttagatctttattgattgagaggaactatctacctctgtaatgacattttatacgcttattaattagagtaataattgtactctattatcaatttgttattgtgtgcctcggctaattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtacagaacatctattactgtactaatggctt

SEQ ID NO: 58316 - DNA, 6632 bp, Oryza sativa
tcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttagatgccgcgctacaagcctgagtacctgtttggtgttgagggttttgtccaggagttgcgtacgatgtcctttgtcataggatttgggactgcccctttttatgctcagattcctcatgatcgtcatgaagagaagtgccgagtcaaagtcaccttgaatagtaatagtgaagatgtcccctcagtgatgttcgaagctggaggaagaaactacatccatgcatgtcaggaagtggcaaggatcgccataggagagctccgtgatcgctacagtgatcggttggctgacactgagtatcgctaccatcctcgtcaaccacagggaagtgaccgtggcagctaccttgagactgaaggaattgagaatgatgctaccacaaggcatttagttgagatgctgtgggctatggatgaaagccgtgcagagactgtgttagcggctcaagatcgtgaagattggaatcgtggtaagatttgcaagttagaagacaaggtggatcgtttggagaaggaactagccgcgttgaagggagaagcaccaccgcagaaggccaggattcgtcttaccgcaaggaagagagctctatttgtccctcgctatcaattggcgccaaaagttcgtgtggtggagaaagaagttgccccagcagatcctccggtcatcatcataagtgatgatgaagaagaagaatccaagcgcacccattccaagattgagtgggtagcaactcaagatgatgaagacgagccgaacgagcctacaatcgacctccgatgctcggaagaactagagtgacttgttaagtccgtgtcttagatcggtgtgttagttgcttgctttaagtttgcttgtgtgtgtctcgcatgtgatttacatcagtggtgggatgtaagtgcatgcgtttgtttgcttttgagtgttaggaaagtggtgagtttagtggtgtgagagtcttcagtttgtaataatgaaactcagttaagatcaataaaagttaaagtatttctctatcctaagtagtttcccccggtttctttttttgtgccctggccagatggtgctcactcgcagcaacgggaatggccccaacagcaacaataacaacaacaatggagagaacccaacacttgctcaagttcttgctctgcagactcagttaatgaacatgatgatgcaccaacttcagaatcagcaaaaccaaggaaataaccatgcacctccccagaacaagttagcagaatttcttcgtgtgaggccgcctattttctctagtaccactaatcctgttgaagctggtgattggttgcatgccatagagaagaagatggatttgcttcagtgcactgatcaggagaaggtctcatttgcatcacatcagttgcttggccctgcctctgaatggtgggatcacttccgcctgaataggattactgctgaacctattacttggcttgaattcaccgctgctttccggaagacgcatataccatcgggagtggtgtctctcaagaagaaggagttcaggtcgctcacccagggatctcgctctgttacggagtatctgcacgagttcaatcgtcttgctcgttatgctccggaagatctgcgcaatgatgaagagcgccaggagaagtttttgggaggacttaatgatgagctttcttacccactcatggttggagattatcctgatttccagaaattagtggataaggctatacgtcaggaggacaagtacaatcgcatggagcagaagaaacgccggattgctcacttcaaggcacaacaggggagtaatcagaagccgcgtcttactttaggaccccagtctgtgccacagggaggttcttcgtccattgttcgtccgcagcgtcagttcttcaacaacaatgctggcaacaacatccgtaatcaagtcccacgtcctgttgctgcctcgacacagcaacaacctgccaagaggaagcaaggcagcaagcccgtggtgtgtttcaactatggagacccaggacattatgctgacaagtgtccgaagccccgacgcgtgaaggttgtccctgcccagaataactctgctgtaccagcatcaaaggcccgtgtcaatcatgttgctgctgcagaagctcaagatgctccagatgtgattttgggtacgttccctgttaactcagttcctgcaactgtgcttttcgattctagtgctacacattcattcttatctatgagttttgcgggaaatcatgggatggaagtagaagatcttagacgtcctttgatggttagtaccccaagtaatcaagcactctctctgcaacgtagcccctctgtcagaatagaaattcaaggggtaccatttctagccaatcttatcttgttagaatctaaagaccttgacgtcattctagggatggactggttagccaaacataaaggtgtgatagactgtgccaacagaaaagtaactctcatcagcaatgatggtcgagttgtaactgttcatgcattgtcatctgagtttttaaggtcaagactgaaccagataactttgggagagattcctatagttcgggagtatcccgatgtgttcccagatgatttacctggtatgccgcctaaaagggatatagagttcagaatagatttggtacctggaacaactccgatccataagagaccttatagaatggcagccaatgagttggcagaagtcaaaaggcaagtagatgatttgcttcagaagggatacatcagaccgagttcatcaccatggggagctccagttatttttgtggaaaaaaaagaccatacccagaggatgtgtgtggactatcgtgcactaaatgatgtgactatcaagaataagtatccgctacccagaattgatgatttgtttaatcagcttaaaggtgccactgttttctccaagatagatcttcgatcagggtatcaccagttgagaatcaaagagtaagatatacctaaaaccgcttttaccactaggtatgggttgttcgaatgtacggttatgtcttttggacttaccaatgctcctgctttcttcatgaacttgatgaataaagtatttatggaatacctagacaagttcgtggtggtctttattgatgacattcttatctactcccgaaccaaagaagagcatgaagaacatcttcgccttgcattggagaagctacgagagcatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcacagttttctaggcctcgcaggatattatcgaaggtttatagagaatttttccaagattgctaagcccatgacacgcctgcttcagaaatatgtgaagtacaagtggtcggaagaatgtgagcagagttttcaagagttgaaaagtcgtttaatatcagctcctattttgattttgcctgatccaaagaagggtttccaagtgtattgcgatgcatctaaacttgggttaggttgtgttctgatgcaagatgggaaggtggttgcctatgcatctcgtcagttacgtccgcatgaaaagaactaccctactcatgatcttgaattggccgcagtagttcatgcgttgaaaatttggcatcattatcttttcggtactcgtacagaggtgtataccgatcacaagagtttaaagtatatctttactcagccggatctgaacatgagacaaaggagatagttggaattaattaaggattatgacatgggaattcattatcacccgggaaaggctaatgttgtagcagacgctcttagcaggaaaggttattgcaatgctaccgaaggatgacagctgccattggaattatgcaaggaatttgaaagattaaatttgggaattgtcagtagaggttttgttgcagccttagaagcgaagcccacactaattgatcaagttagagaagctcaaattagtgatcctgatattcaagagatcaagaagaatatgagaagaggaaaagctatcggtttcttggaggatgagcaaggaactgtatggttgggcgagagaatttgtgtccctgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcggtatgtgatatttgccagcgagtcaaggcagaacatcagaaacctgccggtttgttgcagcctttgaagattcctgaatggaaatgggaagaaatcggtatggattttatcactggtttacccagaacgtcatcaggccatgactctatttgggtaatagtcgacagacttaccaaagtggcacatttcatcccggtaaagacaacttattccggaagtcggttggcagaattatatatggcaaggattgtgtgtttgcatggtgtccctaagaaaatagtgtctgatcgaggcagtcagtttacttcaaatttctggaagaaacttcaggaagaaatgggttctaagctgaactttagtactgcttatcatccacagacagacggacaaaccgaaagggtgaatcagattttggaagacatgttgagagcttgtgctttagatttcggtggaagttgggataagaatctaccttatgcagaattctcgtataacaacagttatcaagctagtcttcagatggctccttacgaagcactgtatggtcggaagtgtcgcactccgcttttgtgggatcaaacgggagaacgtcaggttttcgggacggatatcttaagagaagcagaagaaaaggtaaagatcattcaagaaagattgcgtgtggctcagtctcgtcataagagttatgccgacaatcgccgtagagatttgagttttgaagaaggagattatgtgtatcttcgtgtcacgcctcttcgaggagttcatcgttttcacaccaaaggaaaattggcaccgcgttttgtgggaccttataagattgtcagtagaagaggagaggttgcttatcagttagaattacctcaatctttggcaggagtctataatgtgttccatgtgtcacaattgaaaaagtgtttaagggtacctaccgaagaagctaatattgagcagatagaagtccaagaggatttgacctatgttgagaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatttataaattgttgtttaattggaatttttagaaataattttaaaagtcttgaagaaaagatctaattttaattaataaattccaatataaaatggggccagataaaatttcattaaatactttgcttaattctataattcctagattttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccagtccggcccagtccgcagctgccgcgcgcgcgcgccctcgctgtcgctgacaggtgggtcccacctgtcaggcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcgttctt

SEQ ID NO: 58317 - DNA, 5715 bp, Oryza sativa
aggtactctgtcacagtcctgttgccctgatggagtgcacgaaattccatcttcttttgtgccatgaccccatggggcacgggtgccttcctgaagctacggcagaactctacccaagtgacttcagtacccggtgggcgggtggccatgtgattgtcccaccaggctgacgcaggaccctgaagctggtgtgtggcgaaagcgaccttctcctgatcattgcactgcaggaggttcagcttcttctctatcgcatggagccagtcatttgcctccatagggttggtggtgctggagaaggtgggtggcctgacacgtaggaactcaggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggctagcgtcggattctcaggaagtggtggcggaccattgccggaatcactgctggggtgcacaccattagcgcgttcttcgccgttgctgccctcgcctgttgcgcggctaccagtcctggtgtagaccatctggagggaaaagcagacgggggggaaagaagaaaaacagatgctcagaaactaagctttattacaaaggaattaaaactgcaattgttctgatctgaattaaaacacttaaagagcaagcaaaaatccttattaagacagccatatcataggcacatgatatcgaccgtcgactgaccccaaacaagcaacctaaacacaccaactaacaagcagaagctagacagtcgataaactaatgggaaaaacgagcctaatgctcggaacggctcctgcggtcggtggagtcgaaggcgtcctcctgctcgtcaccaagtccctctgagcgactcctggagcctggcagatacgtctcgccgctgccactgggagtagcagacaaccaacctccggtgccactggctggacctctggcggctgatgctggagcgaaggagagagcggactcgggagctggagctggagctgcaggaactgcgggcggaactggaggtgctgcgggagttgctgctggaggtgggttcctgggcgcaagctggatgcgcacgggtgccgtcgtagtcttgcggggcgtagtgcggatccggactcctcctggcgctggaagaccctttagctgagcgttctccttcttcaggcgcgctatctcgtccttcagagcaacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacagaaggagctgacgccatcaccgttggctcgacgggggtggtagcggtacgccgtgtcgtggaagatgtagttgtcgcgctcccgtagtctggccatcatcaagtaggctgcctcctgacaggcgtgatctgctgtgcctcctgacgcctcaactgccatgttagcgaggcaagtccccacgtagccatggacctccaagcggacacggtgaggaagctcgccactaagcggcggaatagtcgtgtactccggcgcgttggggtagcccaccaccagtgtcatgcgtgccagctctgccacaaagtcgatcatgccttctccgcggtggttgggtgggtggccagccatctagagaagacaaaggagtaggatcaatgcatgctcaaatccaaatttaaataaggcaataaaagactcaaataagggaaacgaataagagcgaaatttttatgcatagatcattttgcatgagagcgaataaacaagacagacccacataacgataaaataatgagaaattagatatatactaataataacaaataaagcataaataccttgcaacccatgttcctgagctaggacctaatgcatttcacccatcaaaccccaactgactgacgaataaatcccaatagttttactaaaaccctagactgacccgttttgaaaaaactcacttaacgagcgaccaagattttttcccttgaaccacaaaaacagatcccaattttcccggaataaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacaacaatgttgacattcagatccacgtcttacaaacatcataaaagtcttacaaaaatgcagcggaaaacaaaagataactggagctaatccttgactcgaactgcagcgggaacaccactccacaggcatcctcgacggcacggacaaagcctactcctcggagaacccgccatcggacacatactcgagctctgggattggggaaaatagagcaaggctgagtactacccactgtactcagcaagtcataccggaacgggggtatgatgcagggattccacaagggatagctaagcaggttcatttgcataaatactggcatttataaacaggaattgaatgcgaaaacagttgtaataattaagcagtattaatcatccactgtccaacgctacaccacgttgcgacaggcccaaccatccacctaaactatccaaattcaaaagattacactagggtgagactaattacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctttcgtgcctaggtgaatccggaagccgcataggccgtcgcagggcccatccaaactccatcacgcccacccttgcctggatgcgtcgactagaggaaagctacaccacaagcccagccgttgcccacgctggcttgtggtaagtacgataagttcttccagggcatcccgcgaaccggtcgttaattgccatgggtgcgactagcaaaaccatgcacccacagcccaccattcagttgcattttagttggataattacgaccatgaagcatggccagatgtctcgagcacgcagctcactctgatactaaaaaggtctaatattgtaattatcccatcaactgagctagtggtaattaagcatggctaagcatatagttctagctaagtcacataagtaacacgagctagtcgatttattacccaatgttgacaaaggatagatatcaagtaaacatggcacaagcgagcagataggtaaaccctgatcccgtgtaattagcaaaatatgcatatttatttgtaaacagtaaaacatttgtaaattaggatcaaaatgctcaaggggaatgtgtgacttgccttgcttcttcactttgatcttccgaactcttttccttgcgaccgcggacttccgaaacgacggaaactacacgctggcacgcaaaacgaggaaaatctctaataaaaaccaaggaaacagtacataaaaactaaacaaacatgtagagctcaattttagatgaattttgcaagttgaatggctcaatttggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcgggacaagggcgccggtccaccgtggaccgggaccaccaaggcggtccaccgccggtccacgggaaccgatggcccggatcggcccaaaccgatcgagcggccaggggcggcgcggctggggcacagcacggcacaaagccagctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggtgcgcggagagggcgatttcagtggtttcccgaagccaggaatccggtggccggtgtgcggcttctgatttccgatcccaaggaggaaacggcgcagtccggcgtcgaccggggaggcgaggcgacacagatggagatacaaacacggcggcgatctcgggttggtggtgaagttggtgctcggccggcgagaggcgacaaccgagcggcggccgagcttgactttgaggcggcgaaggtactggcagtggtggcgcattggggcgacggctagggcggcggtggtgcacggctagaggcggtgaaaggggcggcggcctcgggtgtgcggtgggagtggtgctcgagcggtggagagggggaaataagaggcggccggacttccccttgcggtggcgaagctggcggtggcggcggctcggcgcagcgacggctgtggcggcgggaaacggcgaccggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgatgtggggtggtggaggggttaaccggcgccgattttcgcggggagagtgggggaaatggtggaggacgtggagaggatcgttcccacgtcgttggatgcgagctcgggtgcgggagggcgccggattttgcggcgatgtggacggcaatggcggttggggtcggccggcgagaggtaggaggaggagctgacgggtggggtccacgggtcccacctgtcggggagagagggagggagggaccggctggggaggtaaagcagacttgagggagagagagagccgagcgggccgagggagaaggccagcccgagagggagagaaaagggcgcgcgggccgagggagggaaggaagacttgggccgaaaatggcccaaagagaggaagggggattttaattgttttctttttattttaattgatacaatgatctttgtgctattaaaactatttctcgagctccgaaaattcacggaaaaattccggagagtacattagggcacaaagaatattacaaaatattcccggccaatgatttttaaaggaaatttttaattccctcaataattcacttgattaagttgatttaacttttatttaatttctagaaaatgtattattaattgatttttattcccgaacgaaaatcggggcgttacaccccgtctgctgtcggtcacgaccggaactgacccaacgggcgttccttgcgtgcgtgcattaatccttgtcccaggaggcaaggtacaccaaa

SEQ ID NO: 58318 - DNA, 1475 bp, Oryza sativa
ttgtaataattaagcagtattaatcatccactgtccaacgctacaccacgttgcgacaggcccaaccatccacctaaacaatccaaattcaaaagattacactagggtgagactaatcacggtgaatctggttgactgcccataaccgcgggcacggctattcgaatagttttactctgatcagaggtgtacaaatgtacccacaagacacagccccacgacacgtttccatgcgccgacatgccaccacgacatcccggaaagaggccgtgacaggaccattcgcataaccccctctaaccaagcacaccacacctcaggtttcacccccactcctcgcaaggcagcaggcagtcccctctcgtgcctaggtgaatccggaagccgcataggccgtcgcagggcccatccaaactccatcatgcccacccttgcctggatgcgtcggctagaggaaagctacactacaagcccagccgttgcccgcgctggcttgtggtaagtacgataagttcttccagggcatcccgcgaaccggtccttaactgccatgggtgcgaccagcaaaaccatgcacccacagcccaccatgtgattcattttaattaaccaacacccaagcggtgtcactagtccaacattatcatataaacctatagtctaggttttaaatgagatctccccattgtgtgctagttgaactaagcatggctaagcaaaccctagtcctaactctaatcatgttataacccaagctaacaaaggagcatggtatcatattagcatggctgtaacaataggtaaccatcccatagtaatattgcaaaacaaatgcgatatttgaaagaaaacattaggacatttgcaatataggatcaatatgatcaagtgacaagcatgacttgccttgctctgctgctggagggacctcggcgactatctcgaagtacaccggagcgtcggaagagccggaatctagcgacatacaaggcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataacaaaaatccttaaataatttattgcgcaatattaaccaggactgacgtcagcacgggggcgcggcgccgacatgcggggcccaccggtcagcgactcgggagagggaggaagggcgccgacacacgggacccactggtcagcggcgcgggagagaaggggcagcggcaccggctcggcttggctcacggccggccgaccgaccgcggcgacggcgacggcgcgcgcgcgaacgcgttgccggcgacgacaaccggcggcgaaggcgacggcgcaaaggcgatgcggaggcggctgcgctaacggcggctaggaaggggagg

SEQ ID NO: 58319 - DNA, 1095 bp, Oryza sativa
atcggactcctcccgcaaaaaatcggctcggcaaaatctaaactcggtttttgggaataaaatcgaacagaactcgattcggataaaatacccacccatttgctccgattctggaggggaaagatagaggaggatgagaggataaaaccccctcaaaaatcgaaaaaatcggggtcggattgggtgcggatttgagggcacaaggtggcgcggtagggcggctcgggctcggcttggccggcggctggaggaggaagatgggtccgacatgtgggtcccacatgtcggtgacccgagaaggagggggcgggcggcgtcggctgggccggcttgggccggttcgaccgcgcggggaagagaagagttgggccgaaatcggcccaacgacttaggggaggattttaaaaacttttccaattaaaataattcgtgaaatgatgtttcatttattaaaatacttcccttgctcaaacaattcctagaaaattctagaaaatagaggaacaagcaaagtatttaataaaattttatctagctcatttttatattgagatttaacaaattaaaattaggtcttatcttttaagcttttaaaattatttctaataattccttttaaacaacaatttataatttaaggattttaaacaagaaaagaacttaacaattataattagatcattattgatcaaataattactgaactgttctttgtatcatttaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggaagtgacagtgtcacgtcccaaaacgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaa

SEQ ID NO: 58320 - DNA, 922 bp, Oryza sativa
aggcgacggcgcgcgacactaagaggagaggaaggggaaaagaagggaggggtgcctcaccgagggtggccggcgcggaggaagacgatggcgaacggcgacggcaagccacgggaggacgacgtcggcgagcggacgagcttcggggtgccctaaggaaggaggagagagggattagagagagggagatgaaccacggcgaccggaaaccatggccgaaggcagcggtagaggtggtgctcacccgtgcgcgaggggatgagggctccggcgacgaaccttgacggaggagaggtggacggggtggatctcggccacgcgaatccgacggcggtgacggcgcggcctggcggcgaccctaacggcggctagcggcggccggagaagcggaaaatggcggctgcggaggttgcacgacgcgggggcgatgggaggctcgagagagtgcggcgaaatggggaaaaagtgagagggggcgacggcggtgcttaaaaaggggaagagagaaccgcacatggccgggagaggcggaaatcgccggccgacgtgggggaatggggaagagagagaggcgggattcgattttcgaatcccggccatctcgggcgcgggcgcgagtgggagatagaggggagtgggcgctggagacgcggcgcacgcgcgggcgtggtcgacgtggcccggggaaggcggggacgtgggcgcggcggtggtttcggcgcggcggcgcgagcgcgagatcggcgggaggagggagacgggcccgacaggtgggccccacctgtcggcgaccccgagagaggagcggcggggctgcctggctgggcctcggcctgcggccggcccagtaagggggagggaaggaaggagggaatgggccggcggcccattcgaaagaaaggaggaaaaagagaggaaaaag

SEQ ID NO: 58321 - DNA, 1325 bp, Oryza sativa
agtgtccaggtgatatgaatattcccaaagtctagagttgtaaaaccgcctaatgttacctaattaaaagcgaagcatctacctataatcatactagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaacggatttattgcgtcagccgaggggaggggcgcgcggaccgggtccacgggagtggggcccacgcggcagcctcacggtccacggtggaccgggtgcacacgggcttacgccggccggcgccgtgggtcccacgcgtcagccgcacccgagcgcgcgggcggctgacagccgggccccacgcggcagccactcggcgcgcccgagggcggccatgccggcgcggtcgacgggaggcggctttccttcgcccggagaccatcagctcggcggaccggcggccgagagaggggagggaagggggaaaggaggcgacggtccacaactcaccccgaggcgacggcggcgacggaggaggcggccagagcggagggaggcggtggcaaggctcgggtcgacggggacggcagcgctccggcggtcggcgaccgaaacggagaggtggacgaggtcggcaaggatgcggcgaacccgaaggaggcggctccgaggtgggaggcggtccggggcgacgacggcggcggaccggagctcggcggcgatggcggagagagagagcgacgtcgcgagctcgaatccggcgaggaggaagggcggcgagaggcggaaacgaacggaggaggtgcgggaagggtttaaatagggttggaaggggagagagcggctggggaggaaggaaaccggcgcgggaggttcggccgccatcaatggcggcggcgagatt

SEQ ID NO: 58322 - DNA, 999 bp, Oryza sativa
aactcttatgatcagtatatatttcacagcgattcccaatgagatagtgccgccagatttttagagcatgaaccaccgcggctaattccaagtcatgggtagggtagttgccttcatgaggtcgaagctggcgtgaggcataggccaccacatgaccgtcctgcatgagcacgcaccccaatccttggcgcgaagcgtcacaatacactatgaagtccttgcgagtatccggcaagattaacactggcgaggcaaccagcttttctttgagagttctgaacgccttctcacattgcgggctccacacaaatttctcttctttcttcaacaactgtgtcatgggtcgagcgattttggagaagttctccatgaacctctgtcacgaccggaaataacccaacgggcgttccttacgtgcgtgcattaatccttgtcccaggaggcaaggtacaccaaaagttgatacaattcagagtttaacaagcggaagcgtaaatagataatttattacatgggcgacgaaggcccagcacacacaaagacaaacgagaaacagcggaagactagggcgacgaccacaggcgcttgacggcaggcacgagctagacaccgaagccttcatcctcctggaactcttcttctggggttgggaaaaattgagcaagactgagtacaaccaccgtactcaacaagacacacccacaagtgcagaataaatgcaagggagtacaaaggagttataccataaaggggttagggttgcagtaaacagtaattaaagatatttagttgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaatccaacccaggccaaccattccacattttagttgttaagcaggttttaagaattaaaacact

SEQ ID NO: 58323 - DNA, 1143 bp, Oryza sativa
agattttggccagataaatggttagggaacttgcttttcaagataagcatccatccttatatgctattatcagaaggaaaaattcttcaattgctagtgttatgggctctgttccgcttaatgtttcgttcaggagagcattggttggtcataatcttgtatcttggcatgatttgtgtgcttctattgtacatgttcagttgaatcaatcttttgattgttttatttggaaatttaatcagagtggacgattctcggttaggtcgatgcatctagccttgattaataatggcaacattgagagaaacaagataatttgaaagcttaagatgctgcttaagatcaagatctttatgtggtacttgcttaaagtggtagtgctaactaaagataatttgactaaacaaaattggaatgacagtttaagatgctgtttctgtatgaaaaatgagtctatttaacatctatttatgaattgtcatcatgcaaagtttatatagagagcagttcaattctcttttggtttataccttcctactagcatttctcatatttttgatgggtggctcttaggggtggacaagaaaaagagtaaacttctattggttggagcttctacaatatgttgggcgctgtggttgagcaggaatgatatggtttttaacaaatcatcatcttttacatatatgcagataattttcagagcaacatattggctctgattttgggcacaattataaaggtgtgatgaagacggagatcttctaaaggttgcatgtcgtaaacttgagacgacggttatacaactttttaccaactatggatggagattcacaaataggcttcaataaatgtgtactccttatcctattttggttattttacttcttaaattggtgtcctatttttttttttgaactttacttgttttagagtgttagtttgtaataattggttgtagctcttttgagcaaaggccgggatgatctattccattatctaaaaaaaatcctctttagttggatagttatcgggctctaactcatttggaatcaacagtagatttcgaatatgcatttgcatggaattaaaataaatacggtggataatattgttttggccaaagatccttgctatatatgt

SEQ ID NO: 58324 - DNA, 704 bp, Oryza sativa
attgaatcccaatttgtaaaattatgttgatttaaattattgcattatcgctttatttaaattcccgcgttatcactgttttatctagccatgcctatttacctttgttacgaccttattattattgtattgttagtatttcctttttcaccctagatcaaacaaaaccccaactagtggacactctactcatggtaccactagcatgattttaggtagatgcttcgctgtttaattaggtaacattaggtggttttacaactctagactttgggaatattcatatcacctggacactttggaactgttggattatcgtggaattggcttcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacaaggccggtgtcctcctgctaggggctcagtcctgcctgcctgtcccgggtgttccggccgtaggtgggattgggtcgggactcttg

SEQ ID NO: 58325 - DNA, 689 bp, Oryza sativa
ggggtggtagcggtacgccgtgtcgtgaaagatgtagttgtcgcgctcccgtagtctggccatcatcaagtaggctgcctcctgacaggcgtgatctgctgtgcctcctgacgcctcaactgccatgttagcgaggcaagtccccacgtagccatggacctccaagcggacacggtgaggaagctcgccactaagcggcggaatagtcgtgtactccggcgcgttggggtagcccaccaccagtgtcatgcgtgccagctctgccacaaagtcgatcatgccttctccgcggtggttgggtgggtggccagccatctagagaagacaaaggagtaggatcaatgcatgctcaaatccaaatttaaataaggcaataaaagactcaaataagggaaacgaataagagcgaaatttttatgcatagatcattttgcatgagagcgaataaacaagacagacccacataacgataaaataatgagaaattagatatatactaataataacaaataaagcataaataccttgcaacccatgttcctgagataggacctaatgcatttcacccatcaaaccccaactgactgacgaataaatcccaatagttttactaaaaccctagactgacccgttttgaaaaaactcacttaacgagcgaccaagattttttcccttgaaccacaaaaaca

SEQ ID NO: 58326 - DNA, 3451 bp, Oryza sativa
agtctatcaagtgacaaacagaattagaagttgcaaaatcaagtcgaacacaggggttaaaaacatttatcaccagtttaggtctatgttgaggacagaacaattcggtgcaacaataaatatatagtgcagatcaagctacatctgaatagatatgtaactctaagtatattacttagaaacaaattgaaaatttatactagttgacatcaaggaagttttattacagtataaattaaattacctatatagactctagaatcccccttaggccaaaaggacatgcagtaacttgtagccacacaacctctaacaaatagcatgcatttagcatcagcctaagtatattcagcacaatgcgccatctacctaagtggcatgaaaaaaatgtatattcagcactcaaaggcagaatatcagatccttgtatcctcaaattcagatcaacacatggccaccaactttcagttaatctcaaacagaagagcagctagttcgaccaacacagtttcagattatatatgtgtgtttatttaaaatccaagatatatacaacttaatgtattacaagttgcagaagtacaaatcattatatgcccagaattttctctattacagattcctaaaattcaatatgagttacagttaacttctcggaataatcatcacaaagaactaataatctaaaacatgatattcgttagaaaaatcatttcagtgtcagtagtacaactgaaagtggcaaagaaggcttttgacacaaagagggactagcaagaataacaatgccttgaaacaatattcgttcctctgcatatacttcttatttaagagaatcctatgatctctctatacaagcttatacattatattcaatgtctaatctaatcctaatagctttttacaagtttgtactgtgaatcggcaaacaaataagcaatccctagctggatcaacaatttcaacatgtgataaagatttgcttcattcagatgttagcagagcaatctaatctgctgcaccgaaaccaagaacaaaaatagcaatgcctgtagcaaagaaaacaaaccttggttgcagaaaccgacttgcagagaaagggttgcacggtgctgtggatctcgaacaggaggcggaggcgacggaggacggcggcgcggtgccggatcttgaccgggaggcggaggaccgacagctggtggaggcgtacgacgcgccggcggacggggtggcgcgatctggatgggaaggacggagcgtcggcgctcgcggacagggatcgggacagcaacggaggatcgcgacggggagggagaggaggaggcggaagcggagggggagagggcggcgcaaggcggcggcgggcggtggccgccgatccagtcgccgagctcctaccgccgtgggttctcccataaagaagacccttttttactgcccatgggctgaaccccattctgagctacagtgtccagcccatcgtaaccctcattttatatggcccaacccaaccctgcccttatccctcctataacccatacaagacacaccattttcaacccattactgtttcaacccgtacaacccatgggttggccagcccattaccaggcttagctgcagtagagtagccaaacatgtttgtcctataaaaaaatattctatctataataatctaccaaaataaatggtcttcatttgcagtaacataattactttttatcgaggatggaatcgtctattcccttcatattgtaagatttctttcaagttctattctaataagtcaaaacatttttaactttgaccaaatctatagcatccagatatttacagtaacaaacatattcattgtcggtacataatttatggaggatttaacgaaaccaagtcaatgttgttataagttactccctccgtttcaggttataagactttttaacattgcatacattcatatagatgttaatgtgtgtgtctagattcattaacatatatatgaatgtgggtaatgctagaaactcttataatatgaaacggaggaagtagatagttttgatttttgatgaaactaaagtgcgcgattgcgatttactgcaacggagggataattttaacttataataaaattaaagtgatttacaacataaaatgaattaaggggagtatttaaatacctcggcggcacgggaaacgagggtacgtgatgttgctaaagaggaggttgatgatggggaaagatgggaggccagtttactaaacacgaagcgcccgaccattgttgccaatcgatcaatctgtggtgaactcggcttcgaaattctcgagaaatcgatcggattggatgaaaagggtcagcttggctcttcttatatgaaggaagggatcgatcaccttttgaaccacacacgaaattgaagctgaatacggaaacatattaggataaggatatgtatttgtgatccgttttctgagcagaaagtggggggctgctagctggcatgagcgtgccagcagcgagcacttccctcccataactactatatattagttaacacttaacactaatgatgggtaattaggaagattctcaagatttttctttcttttttcgggagatttttttactaacagattgaaaatttttaagtcagatttgaaaactttcgatttaagatttaaattttaaagtcaaattttgaaaactttcaactcggatttgaaaattttcagctcgaaatttgaaaactttcaactcagattcaaaaactttcaactcgagattcgaaaactttcaagtccatatttgaaaaatttgaaaacttttaacttgagattttaaaattttcaactcgagatttgaaaactttcaacttgagatttgaaaattttcaactcaagatttgaaaactttcaacacaagatttgaatactttcaagtctagatttgaaatacttgaaaactttctacttgagatttgaaaattttcaactcgagatttgaaaactttcaagtccaaatttgaaaattttaaagttgagatttaaaaattactagtaaactattcactagtaaaaataggaaactagtctaaactaattacgattttttctctaatccatacggcaggaacagcgaacagcgaaaaaaaagaagaaacggcggtgtcaaaaaaaaaaggaaaaaagcggcggtgtcaaaaaaaaaagaaaaaagagagaagaagcgcgcgtgtgtaggccttgtgggccggaaatacgcaatggcaacgcgcgttcgccaattagcattcgcacataaagcgtccaaattcccaaatctgcatggctaaagaaccttttgctttcagataatcaaaactaattacgagaaaactacctttcatcactgggtcctaatattcattctaactttctaaggtactccctactcggttcattttattttttt

SEQ ID NO: 58327 - DNA, 812 bp, Oryza sativa
caatctcagcgaatcgatcagagcgagacctaatagaatttttttaacgactagcaccaaagacagcgaagttcaaactgatagagcagaaaaaaaaatacatgattacaactctggaaggtcgtaaccgggaaaacgaaaaaattaaccaccgcccacgcaccgacaacgccaatacatagacctaggagaaggctagcaccggaccggccgccgttaagcgtggccagggccgaccaccgctaggccaacaaagaaactacagccgggaacgcccgaaacccaccctaaaaaccagcaccaaaactccgctctagccacatttttaagattgaggagagggtgagagagaagatgaaactgctctccctctaggccttccaatgtgaccaacttgtataagctaggacgccgacgcaaaaggacaaacatctagagcgagcatgtaccaattgcttgggaggttttagcaaggggctgccaagacgatgtctacagggagtgaagcgacggtggtactgtcgctgccgtctgtcgaggtctcaaagagaaccaagactaggttttcatccgttagcccacaagaggagggggacatcacgacaatgccctcaggagggaaaacgacgcccgaagcgtcgtcattgtcagcccagctaagaccgggcgcaggttatcacccgcagccctcccctgccaatccatagctattgctttgatgctccaccaccgaccatcctctgccggcacgtgggcaaagctacatcgacgtcctccacgggccagcctcctgcgtactgccacacggccaa

SEQ ID NO: 58328 - DNA, 15359 bp, Oryza sativa
ccttggttgaatatgattagaattttgatcatgtttagttgtatgtaactgattggtttcatgaggagatgaataatgcttgaaacatgcgaattttcttttcgttcgttataatacaggtggctgttcacatgaaaatgaattggacagttttgcatgaataggtttggggaaacatctcgttggttttatctcaggattgggttaagtcgtattttggtccttgaaatcttcttgaagtccacttttcacccttaactaaaaacaccatttgttgttgaccctcaacggttaacattcaaaaccgggtaaatcacaccctaaaccatattccaaggtggctttgattggcatgatagtaagcatgtacaccaattaagtttcatttcattgatgtgaacttatctaagtgtcatctatgtctggaaaatatgtataataggagttggcacttgtgaaaaccacctttgttttaaacaaaaccactataaaataggccttaaggtggtgtttgtccagttttgaaacttgaggctgaaaaacaactggtcttttagttgagatcgaaaaatgaattttgagaagggttcaaaagacaaaatggaattttcccgccaagatttctccatccattttgacacccccaatagaaaaggcaactgatgtacatcttggggagaatggcatcaccaggttctgcaatttgtgataacaaaatcttcactagttcccttctattccagttgatattaagctttggttatttagtgctatatatatattgctgccagtcaagttgcattaagcttttgcatcgactatgtagttttatgcagagcatacatatgtggtactggcacatatcctgattcccttctttacctgtgatatttaagataaggaaagtgaaggaaaacgattgtagctgtgttgactttctgcacttctccaggtacttattttgtgactttgccgctatggttcactgatactgcgatacgcttttttttttctgtattcagaaccttatcaagttctgcaatcccaaacgcaagaggatctctgagggtagcaaaaagaaaaggaacatgggatggtatagatgcacataactcgcatcaggtaaatcatttttaattattaattcctgtcctagagaaaatcctgtgtctatctttgaattccctatcttttttttttttctaatttgtaacatgctgtttactcaggacatagcaaaatactgtaaatggtcctgttctcaaagaatgctgccctagtgttccgtgtgcactgtaagtaaagttactgcagtgctgagatattgaagagcttcaatggtaccatcactccatcagaaacagtaagaaactcttccatccatgtgacatgttctattattctgtaccctatgcattttgtcatatagggcctgttgtattcacaggatcgaattctttacgcgggtaatttgatataaaacattagaatgacctcatttggtgggggtgcctaaggggattgaattacttgtgtttatcaaaagggattgttagcccttcactcttggcagattctctctgggaacagagtttggcacaattagctacatggatagttagacattgacacaggctacaaaacaacagttcctactgaaatcatcgatgcaccccaatctttagctgttttgtcataataaagcatagtgttgggaataactagagtgaaactcgaatcaatagtgctaatctgagatagatttaagccacatgcacacctgatggcctaaaaatgtgggtggctgttaacaactgagtcagaataaagctctgatgatagcatcatgggtataaagtggcgactatgggagttagtagacttcactattttcctttacctttctttgatataaaccttcatatgtagtcatatatcagggttgctgcatgttagatagaacacactgaaaatccaactcatcttgagttaaagctagagttcagcctggagtctggacacaatatttttcttttcttttctgtaatactagctctcacttcggttcatggaacatgttcctgcatcgacattcattgaatgaatgcaaaaggtcatactgatggttgctatagcaacacgagaatttgtataggcaatgtaccccagattctttataccaagcacgtttttcttttctaggtaaatttggatggacatattgaaattggaggcctctacaattgtactacctccttttcaagttataagactttctagcattgcctacattcatatagatatacatgtctagattcattaacatatatatgaatgtgaacaatgctagaaagtcttataatatgaaacggagaaagtagcattaccctaaagaaagctttttacccccaaagctttgaaggtccccacaataatctttctttcactcatatcccaaagccaaactctgtggtcacgtggctgttttactcttctctcaaagtaatcttcacagaatcacagccccatatggttacaagcaaaacgagtcaatctcacatgcagacgccaaagcgtatactgctaatcttcagacagcaatgacaagtagattcagcgaaaatgggaatatcttttagtaactgatactgattcagatatatcaaatatggcaggcatgattttcgagagagggcataagctggagatcaagaggatgcatgtatatgaagatctgtgtaagaataagatgatgggccatagacccttacactcgaactgctggaggctccctgcatttgccgtccatgattgtgatgtccaaccttctgcatggcaaattggtgagcgattctgaggatcaatctggtccaacttactggaccgtcgcttgtcgggaggcatcttgcgtatctttttttttttttgaaaggaatcagcacgagattgtgctatttcattagatataggcgtaaaaaaatacaacccctaggggcaaaaaaaagagctgtacaaaattacataagcgctatgattaagttggtaggaattctccaagtcgccttgcgcctgccattatccaggttcttgcctcttcctttatttttgccataaggttgggggctgccgtttccttgtgctcgaagatcctttggttcctttctttccagatttcctaggctatgagtaggattaaggatcgcagccctttcttgggcacttcccttttgttggctagcatttcccaccattcgtgtacgctttggcatggctcccaattgctgataagccacccagttggccgtcagtctccagatccttctggtgtatctacaggaagctaaaaggtggcataccgtctcgttcgtcatacggcatagggggcacactccgctatttggccatcctcttgtagctagtcgatcggaagtccaaactctattttgaatcacaagccacgcataaaatttgcattttgcaggggcccaagatttccaaattaggggattgaagttggtgccgactgttcctagacactgagccttgtatgccgaagaggccgagtattctccatgattcgagagcttccagacgatgtgatccgactcattttggtttagcatgatgtcctgggttgcgctccatagggacacaagctggctgatcagctccagtgtaaaagtagtgttcccatttagctccaggtcatcgatgcaggtgtcattttcaatgccttcacgtagcgatttgcttcttttcttggaaatagcatagacgagcggcatgttgtcctttggtctttgcccgtccagccaggcggactcccaaaagtagatcgtgtttccatcccctattgttattttggtagctgcagcgaagagaagtttgtccgtttcatcacacggtgtctctagtcccacccacggcttggtggggtctttccattcatgccagagccatctcagtcgcaaggccctcgtaaacatctccatgttcagaacccctagtcctcctagtgcggttgggaggcacgtccttttccagttcaccttgcatttccctcctgtaatgtcccccgtccctacccagaggaattttcttctctttgcatctagaacgcccaaggcttccttagagatcttgagggcagtgagcaaatagataggctgcgcagtcagtaccgacttgactagagttgatcgccctgctggcctgatgttttttcccctccagccggtgacccggtttgctattttatcaaagatcggttggacgtccgtcttgcgcagccttccaagcagaagcggtagtcctaagtattttatggggaattgggcccgtaacgctgggacgccctcaagaatggagtctagatcaatgcttgcacatctgattgccgccacctgcgatttttgcatgtttgtgaccaatcctgtcgcacgtccaaaacgcacgagaatgtcggtgaaagcctggacatcctctctaacagggtttatgaaaaccactgcgtcatcagcgtacatggagattctaaggcgagccgctctgcctcttagcttggttatggcgtttagttccgttgctttggagaggatccattgtagggggtcaattgccaatatgaagtgaagcggtgatagcgggtccccttgtctgagtcctctgccatgtgctatcttttctcctggtatcccgttgagtagtacttgcgaggtggaggtagtgagtatggccgtcacccagtctctccatttctgcgggaacccatgatgttgcatcatggctaaaaggtaatcccaacgcaccgaatcgaaggctttggttatgtcaagcttgaagagaagcattggccgccttgttctatggtatcttcttgccaaatttctaacatagaggaagttgtcgtggatgctcctgcctttgatgaaggcgctttgattgactgtgacgagggttcgcatgtgtaatcgtagtcgcaaagccaaggttttggagaggatctttgctatactgtggattaggctaatgggcctgtagtccgtcacctcatccgcgccttccttttttggaatcaggacgatgttagctgagttcaggaggttcatgttcgcacatctcagattattaagcgattcgaagaccgccataatgtcccccttgataatgtcccagcaaactttaaagaagttccccgtgtagccatctggccctggtgccttgtcagctggcatctccttgattgcccgatgaatctcctgttccgtgaaaggatcgtccagatgcgagaggtccgtcgttggggcatgcaaggcttgccagttaatatcgcatgttctcggttctggcctactcatcatcctagaaaagtgttcgaagataacatcatctttgtcttggtggctcaccgcccagccacctccactgcgaagtctttggatgtaattctttcttcttcgagcattgactttgaggtggaaaaattttgtatttgcatctccctccttgatgtgcattacgcgggaagcttgcctcttccttgcgcgttcaagcgttgccagaccaagtaggcggcgtttaagtcctgctctcagccagtgctctagcgttgtgagctctctttgctcctgtgcggagtctagccgctgtatgacgtcaagcgccatgtggaattggattttcgcctcagtgcagattcccctggaccactctcgcagactttttccggtaatttgcagcttatgatttaaccgatgcatgggttctgtgtgagtcgtctgcttgctccaagccgccgcaacaacgtccttgaatcctggtatccttgtctaaaaattctcgaacttgaagggacgtggtttccgtggccctgaagtattggaaaggagtagcggacagtggtcagaagggcctgatggtagagcatttaggatgtgctgggggaaagctaggtcccaagcctcgttacaaaagcatcggtccagtttcaccatgatcggccgtcgcctctcattactccaagtgaactttctgttctgtaagtggatttcttttagctcacaatggtcaagggctaagcggaagcgggtcatacgcgcaaggttaatgttcccattgctcttgtctctagccctgtaaatcatgttgaaatctcccaggagcagccagctctctcccgagtatggcttgagtcttcttatatgccgaaggaaggcatcttttagacggtgccttgtaggcccatatactccggttagcatgaaggtagtgtttgattggatgactttgacatctgctgagatagagaagcgaccgtctcggacgttttgcacatttaatgtgtcactgtcccaaagtagcaggattcctccctttgtccctctagctggtttgaagtcgaagcgatccagtttgtatcctcctagaacctggcgagtgaatcatccatgttttggagtttcgtttcctgaaaacatgccatgttgcatttcgtgtccagcacgagctcatgcaccgtgttgcaccgcgcagcggaattcaacccccgcacattccagttagggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgttccagttaactatttgcaagttttgtgacatttggaatgatggttgcctcactgattctgctcggcccaaacagccagagtttggtccagcttaaaagggcccaacttgctagaagtgatggccatgtggtttcccggcccaacccgcaaggcccatggggcacggtggcgcagtactcgtgtaagtgcgaaggtgggctttgtgttgggccggtggcattagaggaggagtaggaaggcttttttcctttttctagcggcccatgcactctgtcgtcgtagattttttggcgatgcactcggtcgtcgtcgttttggcgatcgctgaggccgttgatgccctgagtgcactgcctcgttaccacgctcttttcgtgattccgcgtcgtagaaatcacagttgaaaacgaagaatgtaggagattcaaatcaggcttatgccctggaaaataattcgtgctactccctccgtttcatattagaagtcgtttgatttttttcttagttaaatttctttaaggttgaccaaatttatagaaaaacataatagtatttttaacacaaaacaaacatattacgaaaatatattcaatgttaaattaaatgacactaattttatatgagtaaatttcataaaactgtaattttagtgacaaaactatcaatttgctgcaacattagtggcatgtttcagtttgctgcaacaatagcttgagaaattatcataaaactgtaaattttacgttatatgctgttacaatacatataggtgacaactatagcagcatataatgtaaaagttatatgttgctacaatacatataggtgacaactatagtagcatataacgtaaaagttgcagttttctgaaacatactcattttatattttagatgttaaatttttctataaattttgtcaaacttaacaaaatttgactaggaaaaaagtcaaacgtcttataatatgaaacggagggagtataattcttgtatcttccactgcaggtgggcattcgcatcaacacacacctacaatcgtcaatcactcgtgtaagtcttagttcggtagtgagttttggtttggctactccctcttttaccactttaccatgagcatgtttttcaaactggtaaggtatatttttaataatttttataagtttctttaaaatattaaataaacccatatttcaagtttataataattattaataccgaattaagtatgccgcagaaaatctccatcaaagcaaattccgaactcagccttagactcatttttttttactagaaagactaccagggctttgtctagtagtatattttcattgaaaaaagaaactatatatgtacaaagaaaaccaaagttacaagggccaaaaaaggattataaaggttgtaaccaatcaaaaaactaattgctctaaaggctccttcattctgcacatatgcagaagaatttcattcttgaagaggcttctccatgactgaaaaagagggcacaacattctgaaagataaacctatttctctgtttccagatgtgccaagaggcaataaaaaaaatttccaagaaacccattctggcaaagttcaaccttgatagaacaatcatttgaaagaactccatgtgctgattccaagtgatacccagatgtcgccaacatctaacactgaaagggcgggtgaagaagagatgaagcccggtttctctttgacccccattacacaggacacaagttaaatcagcattctcctttgcacaatgccttctgtcaagcatatccgtggtatttagcatgtcactgaaaagaagccaagcaaacaccttaattttcataacacactttgacttccatagccaaatatagggtcttgggggctgaaggggcataaaattgagcttgtaaaatctcttagaattgtatgtacccgaattccaaataaagctccagctatctccttgtcctggctacaaatgcaaaagactgagctcttcttccatcaataggaattcttcataggcctgcactgacagaggaagaagaaaagaatcttccagtggtcttgagcacatgcctaagactcatttttgtgtgggcttcctaatttttatatgggaaattggttaattagtatatttttttcaatatgctctattgttacactgataataatacatatggtaaatactccgacggaccaccgtaaaatactacttcctcggtttcacgacgtaagacttcctagcgttatctacattcatgctatgaatctatttgaatgtggacaatgtcgtagacaatgctagtgcctactaggaagtgttatagtgtgaaacggaggaagtattagttatatacacatgttttcattatttttaagaacttggctctgcttttactgaattctattctttttgcctttttggaaagtagtaagtatttcagtttatacattagtgctccaaaattctttttaaccaaaatttcgatgcggaaaatggctacttcgtcccttctttctccttccttgtcccttgtactgatcttaaaatgatggtgtaaattttacatatatggtgtcggacattattcctgcattgatggctgctgatatgggccatcggagtgcactgatagcgaatacggaacttctatctgacctgcccacatttatggatacaataactctgcacgtttgaattttgaattttttaggcgaagtttgatctctgcatttttcagatttttttggactcgtttgaatcttggcatcgtttgagcagctagtacgtacgttggcttccgtgcatcagagatgagaatccaagccataaagaagccatgaatgctcctgaatgagagagaactgtgctggagtacttcatccataggagtacggccaaaatagggttcaaaagattcgagaaaagacagcaaattttttacgtttagcctgctaaatcctgaccatgtccggacaaatttatcccggcagtatttacacagagcttcttttggctcattagctgtgctttacttaggtggtgtttggatccagagacttaactttagtccctctatttaaacactaatttagagtattaaatatagactacttacaaaactaattacataaataaaaactaattcacgtgacaaattttttaaggctaattaatccataattagagaatgtttactgtagcatcacataggctaatcatggattaattaggctcaatagatccgtctcgcgaattagtccaagattatggatgggttttattaatagtctacgtttaatatttataattaattttcaaacatccgatgtgatagggacttaaaagttttagtcccatctaaacagggccttaggcccctcacagtggcttagtcatgccacgtaggttttttgccgccgtggagggagggaccgcgccttagctaggttcgtcgtcccctaccttagcgacgcaaagcctcgccaaaacgagggcgcgcagcgaggagaaaaggcgggtcacgcacgctgtgggcggcgcagcctcgtgctcgcgtggcctagcgcccaaaatcccctcacgcggcagcaaaattcctgattcaccctcccaaaatcccctcccgccacaacattctttctcccgccacagatcggattgatagataagcaataaaatcttgaagattggaagagaagaacagatcggattcaacaagatgaaaacgaaaacgaaagcaaaatcatcacaacaagattcaacagatcggactcctcctgcaacaccacccccgcctgctccgattccgacgacgaggaggacgacggcgaggtggggagcgacgctgatggcggaggacttgccgctccccccgccggcaagaacccccccccgctcgacaagaaccccgcgccgctcgccgggactcctcccctcctcctcgccgccgccaagaacccgccgccaagaactcgccgccgctcgccaagaaccggcacgggagacatggaggtgaggaggcacagcagcacgggaggcgaggaggaccagctcaccggtgctccagatccggccgccgccgccaagaaccgcctaccgcccgccaagaaccggcacgggaggtggcgaggtcagccgttggcgtcgaactagacgaggccagccgccgccgacggagtccgtcccgctcgaggtcgccgcggccggagagatgccgagctccaccgccaacaccgccgcggataagctacggcggcggtggacggagacgacgcgggagggtgccttggccgccgctgcttgaggtcgccgcggtggaggaggcgcggcgaggcgcgcgtgagacggtgcggtcgacggggaggaggcagcgaggtcgacggggaggaggcggcgctgtcgaggagaaggaggcgaagaggcgtgggagggaggagaagaaggggcggcgcggctgagagaaagagaagggtaggtgaggaattaaatttccttcacctgctagtgccccatgtgctagggtatgcccactgtagactttgtatccttcaacagtagcttcatctcgttaggtcactcaaaagaagatacctgcactgtaggcttgagtgtctttaggtcacttttttaggctaagcccccttattgcgtgtcttgcactgtgagaggccttattgataccggaagttttaactttttacccaaagcttcaaatagaatgtacaagcactgcaactaacccggaatcgtctgcaaatactcacaaatatttgcatctgaaaacagttacagtgactgtacaactattgatactggagagtcgtgtacgttgcacaaccgtcatatacattattgtatcgttccaactaattggttgagccgtaccgttccaactagaaaaatgacgtttcatatactccattgaattaggcgtctacttgatttgtctcaaataatcgtggaaatttttaagtggggtcagcataatttacacacatggctttcccaccatttttggggcctttattccaacaaaatagggaatgatattctattatgagatgtttacatcataaaatactagtatcaattacttgatttttttaagataatgaaattactctatcttaaatctgtagtttcatatcaattcaatgtgaactactatgtagttttagttttgtaatatggtgccttaagtatgtagtctttcaatttctaatactcaatcttaaatatgtaattatgtgataagtttatagctaaatctgtaattatgtgttatatcgtcaagtttgtagttttgtgataatttaatagaaataatctacaattttacaatatttactcaaaattttctaatgcttcccctttttctcggtaagatctaatccaaccttacgagtgaaaggaaatcattttaaaaagaaataaaaaagcatgaagtgcttactattatcagaaagaactagaatagtatttatactcctttaaaaataccaatgatattggtgaatggtaaatctgccaccactcactaccaatactatgtaagtctccccaaatagtgagataggtggacttttatcactttctcaacctcaacccaataaacaagaaaattttcttttgaagtgaggaaaaatgatgacaaataatatgatctgaagattttacaataagaataattttagtttttaggctttagagtgtacggcggggttctcctttttaaatgccattgcaacacaagagcattcaactagtttatgttaaagaaaggagatcaaaagaagagaaggttcagtaaaaacaaataatatatgcaactactatatacatatatgtaacaagtacttattgtcatgaattttacctgattataggtatttcttttaaccgaaccgacaacacaatgtgctaatttcattgaatatagtatgagaaaaatatatatatcaatatttaagagaaaaaaattataccggccggggttgtgaacactacggtaaaaaagctctgagaggtgtcttgcttcaccagttcagctcgggtccaggttctagcccatttagggccatttttctttggtgccaattcttcccctactaatcctttggtagttttgaataatgcatgttagcattttggattgaagccaatttttgccaaatcaatagagtggagctaaatctatactattaaaaatttggtagtgtcaaaatttgctcaaggtttgatactaccaatattttggtagattttcgaaccaaacatgcccttatttttgctcccaaggttaaagtggatagtttcttgtatggaagcagggcggccatgtcattcggggggacaaatccgcgaggagatcacatcaaggccctccacatcaaccaccaaatatactaggcagaatcattgcgatcttagaacgaatccacatcaaatgccagtgaaaagatcagttctttctcatccactgatctctcgtagtcgtagtggtagcagcgtaggagtagtatttccatttcgatcccttctcttgtagattcaggcgtgtttaattttaggggtgaaaagttttggcttgtcggatatacgaacatacatttgaagcgttaaacgtagactactaacaaaacaaattaaagattctacctgtaaactgcgagacgaatttattaagccctaattgatccgtcattagcaattgtatactgtagcaccatattgtcaaattatggagcaattaggcttaaaagattcgtctcgcaatttacacgcaatcggttgtaattagtttttttcctatatttaatactctatgtatgtgtccaaacattcagtgtgacagggtgaaaagtttttgcgtgggaactaatcagggcctcagtctcttcttgtttcgtgttgtttatttctctgctgtttttcttgggatgtgattttggctctgtttagattccaccttataatttttcaccttatcatatcaaacggttgaacaactgcatgaagtattaaatatagacttaaaaaataactaattgcacaaattgtgactaatttacgagactaatcttttaagcttaattgtttcatgatttgacaatgtagtgctacaataaacatttactaatgatggattatttatgcttaataaattcgtctcgcggttcactgatggattctataattagtttttctattagcgtccgaacactctatacgacaccctatataacacccgatatgacacgccaaaactttacgcgcctgatctatacacccccttagcctctctgcaaatttgcctttttccctttctttctttttatgttttgtccgatgaacgcgaggttccatggctgcgtctgcattcctgcagaaaaggatgaaaggaggcatcttgcttttggccgttcttggtggtattcttgctttcctctcggctttctgcgagaaagtttgcgttttgatgtgactggtggttgtataatatcagcagcagcagccattgcaatgacttgctgctctcaaactttggaagattataatttgatatttcagaaaatttttaaccaaatttggaaagttcatcacggggtatttcggtcattaggataaaattgtacaatagcactaatggagcctaactgaatgacgatggtatattatagaagttaaacaaaatacgatggcatattgtagaacttgacaaactcattgatacattaatataatatagaatatggccaaaatcagtggcatacaacaaattctctactccctccgtactataatataaaataaaagattttaggtgaatgtgttatattatgggatggagggcgtatttcttatggttgttcactaaactacccatctactatggtgccacatttttttaaaaaagataaatcttatactataagtccatatcttacatattaaattacatacacttaaaatattttagataaatatagaaaaaagatttatttatccatttaattatgggaaaaaatattagtctaaattaacatatatgtaaaaactaatatgaaagaattagaaaaataccatataaatactgatacttatcatatatcatgcattgagaaaagaagaccataattgaatgtttttattgagcaaaatgatggtattatttttatctttttagttggatctatctaaccataattaatcaacctatattagcaaaagtctgtatcgtcattcaataacatatcataacattattagtaataattgagtagaccggcccacccacactgtgcagagacgataaaactgtagttggcttagcatagcatgagattatcggctaatggacaacccactttattaattgctctagagaaaaaaaataaattaccgtttgtacttatatcatcctttaaccattcttttcatttacactacag

SEQ ID NO: 58329 - DNA, 6450 bp, Oryza sativa
agtgagttgttgtggttaagaaatcttctagttgagctgaaaattttggagaacactcccatgaagctattgtgtgataataagtcagctattaacattgctaataatccagtccaatatgatagaacaaagcatgtggaaatagatcgtttctttatcaaggaaaaactagacgagggagtgttggaattaggatttgtaacgtctggtggacaagttgctgattgtttaacaaagggcttaggtgttaaagagtgtaattgttcatgtgacaagatgggtatgatagatatctatcacccatcttgagggggagtgttgggctgtaaatagactagttatgtgtgtgtgtcttgtgtgctggcccatctattgaagagggcccatcccatgtatatgtaagtgagaatggcaatagagaaagtgaagcttccagagaaaaaatcacaagacttcattcctgccactcagataattcacagcgaaggtgggtaatagcaacataagcacagttttgcatagcagacttactatcccaaccataaccagtgtattggcgatccctttctaaaggtgttctaccccgaatgcttacgcgagccatgactgcagtttgggaggtaccaatggacttgttgagtactatgtggtactcaagtggataggtgaaacgggcatattgcagcataagccagagcatgtgctaagttgagtttccaggtgaacccgctgcagtagtagaatggcgtatacatggtaggcatctacaagaacaaataaagaacgaggattagtgaaagaacctaggtgtttacatactttgccatttctttaaggctagctagtcagaattaaattcccattttaccaatttcaagattttatctcctggcctattattacttttaaatggtttcatgttaatttctaggtttacatgaacaaggtacactatcccccttaaaatagaataaaggtttgttctaggtcttattaacaaaacatatagatgggaggtaaaccaacttttgtgctagatgcagtccttcatagattagtgttgcaagctgaagctaaaggatacgttttagggttgacaagctatgaaaaattttacctttgacatcctaacaaatttgtctatggttcaagaagaaatggtgatttttggtgaggtggtttatcttacgggcagtgttttggatgaatgatgcagtgctgtaatgtgtcggcctactgtttcgtctaatatttgagtaaggttctgaaggctcaaaactttgggtaaaaatcggggtgatgggtatgcaagattgtaagttaccttaaagaaaccaagattttatcacttataatttgggctacacaaatttttcaaccgggttaccgactgttttcatattgggactgcgcattactatatgaatttttatgccatgatatgcaatctactgtgaaaagatgcacattttatcaattaaggtttgggctacacaaaatgttgaatgcaactgttgacaaattccagaattttttttgcaaatccgcgctagtacataggagtagtttgcaaatagatttcaaagcttttcgaaacattttgactgattagttgagattaacaggtgatttcaaactcaattttatagagatgcaaacttttaaaaggtttcgatcctaaagacaagataagaattttcaaaatttcaaagtagaaacataagggaaagtaatctctggagaagggtgagatataaggttgaatatggttttcgcaaataatttgtaactgagagcaaagcccacaaaataattttaagaatccattctaaacgaccaacttaagggtttcctatggtcggtacttgctctgataccaatgctgtcgtaggctgtcctgaccttccattatattcgaaagatgaagtgattatatttcaaatcatcaatgaacataatgaaacgtcttaaaacctcgagagaacattattcgaaacattgctgggcctttagcctgccagtcaacttcagcctgagatattctcgtcaaaccactcgaaggcggcgaccagatgtgttacacattcaggagacttgacaatatgactaaagatctacaacaacttaaataatcttaactcatactcatgtgaatccccaggatgtgcactagattcacactttcatctcaagcatagatatacatagcaaacacaaataagagatgaaagcaattacatctacatctatgattagaaacaatggctgaccggccaaataaatataagaatagcggaagcttgtctatccaatccacaagcacaccgactaggggtataccctattaagttcaactcctagaagaatcaatcggaacccgcatcacttaaaggctaagtctaaacctgcaagcaaagattatatctgcagcaagagtcagtacattaaacaagttaatgtactgacaagcacaaatcaatcctaacatactacatgtaaggcatatattcaaaggagggcaatttgtagttcattttcagcataaagcaagttttgtttcacaaatcttttgtaaaagagttgacagttcaactaacaaaaacaagttttaattttcatcatttagttcatcgaaattccatcataatcgaagtcttcttgtcatccatgacaacaagtcacattatatcaccacactcacactactcaacacatttcatcatttccaaaccatgtcacatgttcacaatttaaaacatagagtctatactcatgacacttcaccaaatcgctcttgaccgtgagcacggctaatcgattaattttagactctgcaaagtttgtacagctttatccacatgatgtgaatcactctagtttgtccggtacccgtcgacaccactatactctacacattgagtacagtctagaggacacaatgaagcctttacactacttaatatctagctttgcaccagcacgatacgtgttcctccatcctaggcatactggaaataatacttagaaccgttaaatggtgggcccacaccttaaacttaacaccgtggtggcggacacgatgggaacccaccacgtggcacaataccgttgtattgaacaggcttagtcacctaaactaccacgtcggggcaaataggaagctcctctgagttattcgaacccatacacactagcctaccagaatgcaaggcttgatgctaagtagattaattagcttaggccatcccatactagcacatgtggacgtacgggttactttaagttggtgatacaagttcggtccttatggacttgggcaaacactccccctatcggtatgcaactaacacaatatgaacaacacttgctacccaagtcaaaatcacatttttacacattttagttcacaaatactcatcacattcattttattccagcaagtatccacatatttaaaatcacatttgaagtgtagatggaataagcatttgcttatttctaagcatggctaagcaagtagttgcatatagagcatatataaactcatttgagcacaagggatgtactctaaccatttctaagggtacaaacagcatggaacacaattattcaaaggagggaatgcatcaacttggccatagctaccatattcaaatttttaaataccgatatagtctaggttcacatgcaacttttgcaaacaaatattttcattcctcaaatcatgggattcaatgtgttcaaaggttgggaggagagaacttgccttgatccaaggaaatgttagcacctaatcctctctgttgatggtcgttaccgacaaagttcgaccatcaatttaactaaaataatggagaattagctatgcttacaatgcattttatttctaaataatatgtatttccacttgtacttggaaaataacattttgcaggaattgccaaatacaataaaagaaatgaggaaaactcactcccaagcaagccatggataagatggtggcccacttgtcaggtgtaaccgtcgggaaacggttttaactgcttaaccgtcataaggtcccacctgtcagtgccctggccaaggttggaggcctgctgggccggccaaggttcggccgaaccgaactctggctgcagcggcgcagctcggccctccacaaggacgtccaggatgcatccccaatgacggttacaggggcaaaaccgacaactcacctttcaataaccgtcataccggccctataaatagaggagctcatttcacttcaacacacactcaagcaagcaatttcctcttcatactttagtattaatagtttagtgctaagtggagtagaaatagaatagtatttggagtccctcggagtcttcggaagagtttcggtatggctctagcagcttttgtaatctcttctgtagtactttctgaattaatgaaatattcttctttatatatccccggtattttaacacgctgaaaattcgactaacaaaatcaaaaccctaaaaatacggaccttcaaaaactttttaaataaattgcatcatgccggttttattcgcctattttatttggatttgatttcggagttcattaatcgtgagtaaggaataattaattaggaataaaccctaaaaataaattgtcaaaataaataattgaaatataattttaaataaagattaggtgaggatagaaataaataaaatattatcgcaaccatattggtaacaattaaatttaagtgcgatggaataagaattggccctaattaaaaattcaaataaattatataaaaataaaatatgggtaaaattaatctagggtgaatcttttggttaaaatagcacaaatattgagtaaactccatttgtgcaaaaattaggatttatagaatgaaatttatataggaaataggctaaattagggataaataggactagcactgttcattgtgcagtaggtgctcgatgaggttccctagccctgccccctcctctgccgtgtgcgcctagccgccccgagcgccacgcccccgtcgccgtcgcgtcccgtcgccgctgctacgccgcgcgccatcgccgtcgtgtcccatcgccgctgccgcgccgcgcgccgtcgccatcgttgctgcgccgccctagccggcctcgcgccccgagccgccttcgctgtccatcgccgtcgacgtcccatcgccgcgcgcccgtcgccgtcacgcctcgcgccgcgcgcccgccacctcgcgtcccgcgcgccgcgcgccgtcgcatcgccgcccgtcgccttcgcgcctgcgccccgccgcgcggccgtctcgtcgctgtcgccctgcgccactgccgcgccgcccgtcccatcgcgccgagccccttgccgccgcgcgcgtcgagtcgccccgcctgtcacgtcacgcgccgctcgcccgtcgccgtcgtctcgagccccacgtgccgcgccgtcgcgtcgccattaagccggccgcccctccccgcgcgctataaccctcccccccggtcgcccttccatcccacaccaccccagccccttttcccctcttttctcctctcttcctctccaccgcgccgccgcccttcgtgccgccgcgccatgtgtcaccccgccttgcgccgccgtcgccgccgccgtcgtcggtaagccgccgccccctccccttgttcggtcgtcgtcgccgcccgggtaggcagagggccgagagggaagaagaagccgggagagagagaaaaagagagaaaaagaaagaaatgaagagagaaaaaagaaaaaggaaaggtaaattgaaattagggagagattaaggaggtttagaaaattaaaataattggggttagttgtagatttcttttagttgtagaattgcaaaattttatataattatagattattttgggtaatctctataagtaattaattcgcggtaaataatcggatttaattactaagaattgtattcttcattgaattttaaagaagatacttctaaatcacaaaatgacttaggttgaatgagcttaaaattggaataacgacatagcagatggtttctccactttggctagtatgaggaggtgaagattccgtggtctgcaaacaattgaagtggccaaatatcaagagatatcggttagcaataaagaatttgacaaaaggaagaatacttacttgcggaaccatctctcagaacatgttagtcaggtatatggaagctgattggtgaaaaagatgttttttccactctgcccaccatcggttaaaagttgaactcctcatcaaggctagcacaatattatccatactgcctagtgggggccctgggatgttcaggagtctatccatcatgagggctgatgtgatttctcccctggtctggatcttgtccacgaaatataagccgattgatagctgacctatttcaagttgtctagc

SEQ ID NO: 58330 - DNA, 10376 bp, Oryza sativa
catcctcgacggcacggacgaagcctactcctcggagaaaccttcatctgacacatactcgtgctctggggttgggaaaaattagagcaagactgagtactacccactgtactcagcaagtcatactggaatagaggcatgatgcagggaatcatcaaagaagagctaaagtggtttatttgcataaagtgagcatttataaacagaagttgaaagattaaacagttgtaataattaattaatattaactatccactgtccaacgctatcccatgttgcaacaggcccaaccatccacctaagctatccaaattcaaaagattacactagggtgagactaatcacggtgaatctggttgaccgcccataaccgcgggcacggctatttgaatagttttactctgatcagaggtgtacaactgtacccacaagacacagccccacgacacgtttccgtgcgctgacatgccaccatgacataccggaaagaggtcgtgacaggaccattagcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtagtaagtacgataagttcttccagggcatcccgcgaaccggtccttagctgccatgggtgcgaccagcaaaaccatgcacccacagcccaccatgtgatttattttaattaaccaacaccaaagcggtggcactaatccaacaataccattagaaccgacagtctaaacattaataggatcttccccatttgtgaactagttgaactaagcatggctaagcaatccctagtccaatctctagtcatgttataaccccaagctgacaaagggacatggtacaacaatagcatggctatgacaataggtaaacatcccatagtaacattataaaacaatgcaatatttgaaagaaaacaatagagcatttgcaatataggatcaacatgttcaagtgacaagcatgacttgccttgctctgctgctggaggaacctcggcgactatttcgaagtacaccgaagcgtcgggggaaccggaatctagcgacatacaaggcaaacattgcaaacagactataagactactgaaacagggaacaaaaccatttttaatggattctacacatttttcttgatttactgagacttgaatgggcttaaacggagctcggatgaattagttatgaattttagaagaatcactgtgtttattactataaaagaaaaaccttaaatcatttattgcgcaataattcccagggctgacgtcagcacggaggggggtgtggtgccggcaagcggggcccactggtcagcggctcaggggggcggttcaccgtggaccgggaccacgcaggtggtccaccgccggtccacgggaccgacggcccagatcgccctcaggccgattggacgggcggcgataaaggcggccgccgggctcggctcggcatcaaagccgaccggccggccagggctagcggcgacagcacacgcgcgcgaacgcgttgccggcgacggcatccggcggcggaggcgacggcgcaaaagcgatgcgaaagcggcggcagcggacggcggcaacgaccgaaggcgacggcgagcgcgagcggcggcgacgcacggggaatcggggaaggaaaggaaaggggagggagtcctcaccggaggggacggcggcgaccggcgacgaggagcgatggagggaagtcgacacgcggcggacggcgaccgggacgacctaaagaacgaaaggaaagagataagagaggaagagaggggccataggagacgggaatgtcggccgaaggcggcggacatggcaaccctcaccgtcgcacgatgggaatggcgctccggcggcggacctcgacgaaggaggggtggacggggtggatctcggccacgcgaacccgacggcggcgacggcgcggtgcggcggcgagcctagcggcggctagcggcggccggagtagcggaaacagcggcggcaagaggttgcacggcgcgggagcgatgggaggctcgggagagttcggcgaaatggggaaaaagcgagagggggcgacggcagagcttaaatagggagagagggggccggacgtggccgggagaggcgggatttcgccggccaacgtgggggaagtgggggaggagagagaggcaggattcgaaaatcgaatcccggccatctcgggcgcgggcgcgaacgggagagagaggggagtgggcgcggggaacgcggcgcacgcgcgggcgtggtcgacgtggcccggaggaggcggagacgtgggcgcggtggcgcggcgggagcggcgggaggttggggaaggacccgacaggtgggccccacctgtcgcgaccccgggagaggagggaggggcggcttggctgggcctcggcctgcggccggcccagcagggaggagggggaggaaaggagaggatgggccagcgacccattcgaaaaagggagggaaaaagaaaaagaaaaaaggagaaaaggattttccctggaattaaaatattgcttgctccattttaattggttaaaattatttcaagagctctgaaaattccactaaaaatcctgttagtgaatttcgacatttagaactcaagaaaaattccacatgccaattccgattattatttgcattgatttaaaaggggtttactcttgctttgcaccggtattttcttagggtcatttataaattaaatttaggcttgggaggagaacttcggggtgtgacatttagccaccttgatggtatgaaggttgagccatacttgcaaaagccaccaagggccaccagtgccaatgacagaatctacagcaatcttagccgatgcagaattcagagtttgatacaatgagcctagcagatatttgcccaaggggaattgcttcttgtctacaagggctttggctatgtgctgccagttggtagtagggccacaacttggaccacagaacaagaacttttccaaccacatcattagaaaggctgtgtgttccttaggggttacagaaccagttcccatgttctgggtgatgaagccaatccaacctccgatgctcctagttttgtaagagaatttgcccttggtattcatactaactgggttagccgatgatgtgatgtctaagtccatgatcatgactatatccaggagagttggtgttattggtccttggttgaataaaaaagcattcaaagtattggactagaaataagctgcagccgatagcacaggctcatctctattcatatcggctacagtgaggactaggcactgttgacagtcgttatcgaacaatttcgaccgtccatattacccaattaatgaagactagctatgcttgcaatgcataaattccaattaaaatgtctatttccactatgtactatgctactaacatgtatgcaggagaagcacatataaatggaggagaatcgacggaaagcaaacgaacgatcaatcggaagccatcgagaagcaaacttgtggacagatgggctaataatacagaattcacacgagtaaacaagcctaataattcacatcagtggattgaggaatcaacaagaagtccacctacaaagttgtgggctgattgggcttggccagggttcggcctggttcggccgaaccagtagctagcccaattagcccaattcttcatcagctggtagttatccttgtcccaaggcggttatgaccggttaaactgaagaaaccgtcactggacacatgtcacaaagagatgaagctaaggagaatatgctccttggatgcttggagcatatccactctcccaaggcaactcatgtcacactgttaacgaccaaatttggtaaatcaagtatcggaattggagataaaaccgaagcagaatcaaagggaattaacagtttcggaaatagagtacacatcggctggggtccgaatcggctacaatctacattggtagagtttaagtcggacagggtagccgatgaagtcgattccgacaatatggcgatagaaacattgtcggattgggttgatatgcttcatatcaattgccacgcacggattgagtcctaagaaggtaatttgtatctattaattaggatattttatataattttcttgtactttgagtcggtaagagtccaccttaaggacttgtttgtttcctaagttgtaatagagttaggagtcgtgtccgacaagggcatatcatgtattttgggtataaaagtagcccaaaaccagtgtaacaaagtaacaatcagttcaataacactttcgacgcatcgccaacctttcactttcgtttactttcgatgagttcttgctttcgagttgggctgcatcagtttgatctccgacgacaaggtaaaacttgttatggcggtttgtgttctcgggattagtggttctatcttcatgatactctaatcttgtaatagccctagctcataaccaggtatttagaagtgcatttgttgtcttttagattgcatatttactatattgcaatttgatcatatgcgataacaaaattaactctaatcggtaaaattgaaaccacttctatttgaacaataacttgaacagaagtgtacatgtttaataatttattcaaatactagtttatttatcaccaacaaatataaattttgtggaatttttcctctctttttagacctcctaaaaattcaaactaactttcagattaactgaattcactttttcactagaattatttaactcaacattttttagtgaaaccaattggattagaaagcatgttccaagacccatctctggaccagaggccaaaatttgaatcccctcctaagcaattcgaattagcaggtcatgagtgagaagagggaataaatcttagttttgtcttttcttcttgtctcttcctctccaacccctctctctttgacatgtggatcccaccagcagtccctggcccacatggcagtggcccaaccctctcatactcaggggacaagcagaagaatagccatgccacgttttggccatgcaagggagagagacaagtgtgacacctctctctttactctcccttctcctctaagcttctggccactttctccactcctcccactcccttccagagaaataaacgcaaggtgagagcacctcatttcgcccccatcttccttcttcctccttgctggccgagagaacttcgtcgtcgccgccgtgtttctggtcgtcttcttcgccgtccaaccctcgttccctgctctcctatgcatgccctaactcccctcaaaatttcatcgattttcatgcagtgaatctctgggaacgcacatctctttttggagccccggagcgcggccggtgtcgtcgcgtcacccaagcttccagtgttcccgacgttccaggccgagatacagggtggtgctgctcattctaattcatcttcctcccagatgtaacaccgtcaagaatcagcccaagccgagctccaggcgtggagaacgctcgccttctttcctcagccccgatctagacacgttggctttgttcctccctgtccggtgagctccagatcctttaccttggccaaaaagactctgcatgcaatgttctagctcattcaagcgtttatttggggtttttatggccagatctagtcgttctcgggtcctcatcgtgttcattgtgttgccgggcatctccaacgccgtcgatgcttcctggacctctccgacccctttcagctgcacggtgagacactgcatacccctgaacaccccatgcatgcacccatatagcccattcagagctgtagctcgacacgcatgcacataccaagaaccaccgccgctgtagcttgtttttcgcgagctacagaccaccgctgtagctgtagcttgttcatcagcgcggacacctacgtgttcgcatggtcctcctctacagtttctctgttgaactcgaccccatccgagcctccgttcgccgtcggcaagctctagactgagcccagccatggctgcctccccgtgagctcgagccagggacctcatcggtgaattagataaacttgagggttttttcccaaaaaacagaccaagacacataacactgtagccttgaccactctgtaatattcaggaagttcgaggactcttaatggaaaactgttttcaacatgtgctgaaattgtactaacttcaaaaatgtgtagaaaattcatctgaactccgtttgagctgaaccaaatttctatggattaataaaaacgtgatctacaatgttgtaaaataaaaatggctaacttatgtactggtttttcctctaaaattgtgaatagatctaggtatccttttagtagtctagatcttggacaatgcataagtaaatattggaatatgataaaaatataaaataattttgttgaacttgtaaaatggtactcttcacttctgtggaaaagatcttgacaaaactacctcttaaatcatgcttagaagtttatttagcattcctatgatttaacttgtaaaatccataaataaataatgacaacacttatggttgtgaaataatttttcttaggacctgtgagtgatgtactttactctaaaaataatcattattatgaaatcttggtttgaaatgcatgttaattgtaatgtactccctccgtttcgaaatgtttggcaccgttgactttttaagtatatgtttgaccgtacgtcttattaaaaacttttgtgtaatatgtaaaattatatgcctatataaaaatatatttaacaatgaatcaaatgataggaaaagaataataattacttaaatttttttgaataagacgaacggtcaaacatgtgttaaaaagtcaacggtgtcaacatttcgaaacggagggagtactaaaggaaatattaatatttacagaactgccatgttcagtactgagagcttatcattttcatatctcccaaaccataagtgataatctgttgattctttcacctaaattcaagttaaaatatgatctacccactgtatttatttcatagtttattgatcattttgcatgtgcatgtttacttggctcttattcgtatattgcttcttttcgatagattcggagattctggagagtaacgagccatatccagaggatgatagtgactaccctcagcagcaaggcaagcacctaagcatatagaacctatactttctctaaaaatgatttggttgcaatctatacgtatatatatgcatgcattgcctagatattaatattatcggtttatggtgtatgggtagaacctatttatgcatttagttcttgtgatattgctgtccttataccctactgccactggtcacatcatgcacgcacgtgactaagtcgtcgggaaccccagcatgttataggtggttggggtggggctaagaatgggcatgtaatgagcttgaatcacttgtgtaccacactcgacggggtgtgtagcatttgatctttgttcatttcatgtgggtccagttgtacacctctaatcagagtataatctatttgaatagccgcgtcctcggttatggacaatgcttgatgtgttagtcagttatgttagcaccaaatatggattattatggatgggattctatttgatggtggtgttgccatgttgtgccatgttggtatggactttggtagtccatggttgataatgagagcgccgtttgggctcatttgcttatacatctcagaattatatacttgctgtccataaataaaaatgatgctagatttacttgtccttacttattttactcattaattgctcaataaaattagctttatgcaaatgttgaacctagagacccactgttggctagaaagcttgcatacttctctctcccttatgtatatttaattttgggtaagacttgcgagtacaatcttgtacttaacccggcgccgctgtttcaggtgaggataccggttatgagttatgcttcttgtgtggtcattgctctgccgagggcggcgagggcgatgagtgatctcttgcagtttggctcttgcccggttggtttgccctagtggggttgtggcaccaccggttttatcttttgcttatgaactctatttgagactttcgctgctatatttatgtgttgtatgttgggacctcggaccctattatgtgtcatgtatcttgctgcacttaaaccctattatggtacttgctatgtttactaatggcttgcgatgaaagtgtgaggctagtcgcattcctggggactagctaagcatgagtaacaggttttgatcgcttgagatacttggggatagcgcttttggatcgagttactggggtatgtttttggtcgccgccttcatatggtttgacgagcatatgacggagtggactggcaagctatcttatggttatctctcgcagtcactactcggcattccggttattatagtagaaggtgtcaactgtgataatggacacattgaggatgagtggctatttatgcgtgtatagatcccacttctccaatagtatgtggtggtcgcgttggacactggatggtataatactagggatgtccacaaatcttgtttatgtgaatcgtcaagttatcatatattctatataatctagatcaatattgctatctaacctcaaatcggctaacatctatcactggaaggcggccgattaagctagatctcaatgttgacttagattatatagcatatccaccactctatgaatcatccaatgacttgattgtctagatattgttcttctttttatacttaatgttgtatcagttaagtttgatctattaagtcgtgtttaagtcgtgtttagaattataatttctagcctgttaattggttgccgattagggtagtatcggggtttcagccgatcttaccttattttatgtttacttgatatgctaaatatgccctttatattaagatatcactgtaattaaatatattaagcttgttattgatctgttaagtcatcttaacacttgattgatctctatttaatatattttgtttatattggtatcttagtataaagtggtatcggagtattagccaatacatgttagatctaaaacaccggctatgctatgaacatatataatatctgattcaagttacttttaaacataagtgatttatactatctcggcaagctgtccgatctatcccaatcacttagtttaaatatatcttgaggtatatattatatactgttgatatctatagccgatcgactaggtctaaccttccttttaccttatatttcattgctgatctaattcacgttacatcggctaagttacaattgatatgtcatcggtgactgcccgatcggctatcgtttatggatttaaatgtgtttctttatttcttgttcgttgcaggatcaaaccaactggcataccctcgaactcgaaaccaagatttggacctgcactagagttaagcatatctcaggccggtgtgtgtttttcgcatcaacacacaccctgattttcgtttcaggatttataaattatttaataaattatttctacaatttatattaaatattcattaatttacaagtaaagttaaatgtgggaaataaaatttcctaaatgttaagaatggctagatttaatttttattaaattctctacgattaattatactctctggaattttctcgtatttttcggagctcaaatcctaattttaataatacaaagagcattttagcaattatataaatactaaatcctaattttaatcattaaatggtctgattataattttgttgaatactttgagtgtccaattattttcaggatttttcttggaattatgtgagcgttggaagtatagttaataaatgaaagatcatttcagtatttatttaaattgaaaaaaaaaatcaaaatcctcttctatgccttgggctgaatctggccgatctctctccttcagccctgccgatccagcagccctctccctctctctgtcgtagtctgattcgcgtcccttcttcaatcgggcctagtgaaggaaaccgcagaaaaagtctagtgtgactccctatcgctacagtgccttcttcaacctccagccgcccagccgagctcgagcagccgccgccccctcgccaaagggctgcagg

SEQ ID NO: 58331 - DNA, 1134 bp, Oryza sativa
atagggtatttacaaacttgtggctaactattacagtagaagctatacgatgactcaactctagtgttttgctatagacttaaactatctatctaatctatatttgagaattaagttagaatgagactaacttatgattgaactcccggcttcggcaagaactccaaaatgactctggaaaagggggttgaagcaagggtgagtacaacgtactcagcaagctattatattcaataataaatgtatgaaatggtaatatttgagtagagctaggtttaattgcagaaagctgagaataaagaagtagaaatcctgaaatgtttgatatgcaacagtatttaatagagtttgaaattatgtttctaaccaagatgccattgtgagtcccaatgctcgataaccgcgagcacggctatttgaatagttttaataatattcatactgcagtagatgtacgctttacccgcaatccatgacgtgccaaacacattagccttgtcatggcaaagcttttcggttactaacatcagtggtacctgttccatgaactctagtccccatgcgctctgaacgtaacgttatcagcagcaagaggagttctggcgttcccggggttttcagagagaactggttgagagacccccgtcatctcaatcaggttttcataattcacacacagctcgcgagataatcaagatatttacctgcgcctcggtaaatatcataatcgccctgctcggcgtaagtttgcctcctgcgcgaggacttaagaagaaccactatacagaggtaccacctttgctagataacttaatcagctaggtctatgcccatacgagaattgtggtcgtactcgtatgttcttcacatgtacttggcagttttatgtcggttggaacagtactagccacccggaaatcaaccatttctaccgtactgtcccaatctaagtttattatattttatgcaatctaactaggcatggctaagcaaaatctagcatatctggtttgctatgttcaggttatgcatttgaaatcatgtatgactaatgcatagaacagagatatagaatatagggtagttatgctcaaaggagaggaataataacttgccttgctccaacgcaaataa

SEQ ID NO: 58332 - DNA, 9437 bp, Oryza sativa
aattcctgcagccctaatcaaatcaaatcggattcgaatttctctttcctaatcaaacgctaatccttccatgtcgccgccggcttgccatagccctccccggtgcctcttgacccatataaaaggaccccctgggactcctctacccctcatcacctccaccttcgcccgccgccccctctagcgccgttcccgcgtcgtcttttgcgccgccgccgccggagctgcttcagctgagcgccgccgtagcctcggtcgccgcagtcgcacggggttcacgtccacgggttcgcgtgaccgtcgccgacatcgtcccgccctccgtttgtgccgcaacccgccggagcaccatcgccgccgactacccgaaggccgccgccgccaaaacctcgccgccgtcgccgttcgtcgtcaatctcggccgttctagccaccggtgagttcgccgcgttgtacttttcgcattagtgccctccgttcgcgcccttatgccctagatcgctggcgaacttcgtttcccgagccaccgtccttcatcctctttttccttttatttaatacattaataaattagtaaagtcttttctgtattaggcaaaaatcatattaaacttagaaaaatcatatctaattcattataactcggattaatgtgtttcaagttgctaaatttgtataaaatagagatctatattaaaattacttataaattgtgttgttaatctgtttaatccttttaaataggttttaattgtattaaatcttgtaaaattcataattaatccattggaagtcagaatgaggccgttcaagtctcataattcatctaaaatcatggtctacatgtttatttactttttacgtactgtttatttggagttccttagtttttttcctcgttttgcgtattagtttgtcgttttcgtcgtttggaaggatcatgagtgcatcggaagtgatccagaagactaattgaaattattgcaaggcaagtcacacagatactaaacacaatcctttgagcatgttgaacatataattaaattctctttttatttcaaatatgcatttattttcgaatgtcattgggtggtgagccttttccctatattatggccgaagatttattttcctgtgttataatttgactagcttgggccttatatattggttcagctagatattagatataattgcttagccatgcttagaagtattagttaactattggggataactaatgcttcattattacttaatgattgctatttaatgtttgcacacggtggtcaatcgtgtttggttaattaattaattgccaattaaaacttgattaatggtgggttgtgagcacatggttttggtggtcgtgctcatgacaattaaggaccggttcgcgagctactgttgtgaaacattaaccatgccaaccacaagccagcgtgggcaacagctttaccttttgtatagcatagtttattacggggcaagagactgagaagtggtggagataagcccacgggggtcactgaggagtccatgccttgttttataaaggggtgactacgatccaggaacggtgcgctgtggtgagttgtgttgtatggggtgtattgtcacagctcctttcctaggtaccatgatggtattgacgcacatggtgggtacggtggtacatctctgtccagagtaaaattattcgaatagccgtgcccgcggttatgggcgggttgagcaatgtttttcgtgattagtcccacactactcactaatgtgaataatgtgatacttgatgattattaagaatgctaggtcttttgctgtgtgttactctactcttggattattttaacccctatatagaccttgatgtacacaactaatatataaattattagtataattctctcttatcatatcttccattgggattaaatacgataccttagaatacttccgggtgaaatgctacaatggtacattcgtgcgcttgcggatcatatctgtaaccatagtataccgggattatttctagtgctattgctgagaattatatttccagtactgtcgctaagaaataccaacaagcatttctagcgctgttgtcggggaagataaatcattcagagtttactacttgctaataattttatatttacctctgtataatcactatcctatgtaggcaaaccttgtatgttttctcttttatgtgaaaacagggtagtacaagactagttctgatctgccaaccaatttcaatcttgagtcacttgtggagcgagcctcgaccccgtgttgtccctcctcaagttactctatcagcaaccagaccatccattttcgtgccactagagtttaacgatatggctgggaagatcctccgcaagttcgcagctccctccgccgacaatgtgcccgttggaccctaagtcagcatgggagatggtaactttgaagaccagcctaatcacgatggcgcaggtttaccggttctgtggcaatcctaacgaggatgcaagtgctcatatgcaggaattgctgaaaatctgtagcacggagtcactccagacactatcaggctccgactgttcctgttctccctcctcgggaaagcgaaacagtggttctacgccaactgtgcaattgtgaatatccggaataattgctcaacgacattcctctcaaaattcttcccgatgggtaagaccaacgctcttcgtggaagaatatccagctttcagcagccgaaggatgaaacaactcctgaagcttgggaaaggctgcaggaatatgtcaccgcccatcctcatcatgggatggacgagtggctcatcctgtagagttttttcaatggattaaccccctcatcttgggatcacctagacactgctattggaaagacattcttcttaaagacggtcagaggtaccaccgagctgattgagaagatggtctcaaatatgggttggagcgaggaacgactccgaatccgtcaatacggtatgcacaccgtcaagaggacggaaatgctggccactcagttggatcttcttattaagagactggacaacaatgagaaggacgccaagcagggtgctgttaaggccctggactcacatgacatgtgaggtccgtggcaatgccagtcacactgggatggatcatccgaaaacccgtaaggactcatgctcacgagagcaacaacgggtatcgtccataaggagatcaaggatggagcattgctccatggggaagatcaagtacggaccaaacccacaaggaggtcaaggtctaccccgaaagacggacagtttcagcaatttcatgatgaatttcctaaagatcaagaagaaatgaggatccgtcgataccttaggctggcacccaagaagccaggaacacaggtcggtcaacctgcgttcccagtttcgaagaagccattgaccgcaccaaaaacaaaggaggtatggcaggttaaagagaagacacctgttcctgtacctttgaaactgggctgtcacgccctaaaaatcgcctaaattaaaaatgcattgtttaaatgatttttagaaaatattttaaaagcctacaagctaaaacctaattatctaggaaaattttcaacataaaagtgagctagataaaattttattaaatactatgcttgctcttctattttctagaattttctgggaattatttgagcaagggaagtatttttttaataattgaaacaacatttcacaaattattttatttaaaaagttcaaaaacccctcctttaagttgttgggccgttttcggcccaacactccctctttcccgcgcggccgaaccggcccaagccggcccagccgacgccgcccgcccctcctcccctcagccgccgacaggtgggacccacctgtcgggtgtgtccctaacctccggccggcataggccgagcccgagccgcccgagccgccgccttgccgcctcaaatccgcacccaatccggccccgtttcttccggatttttgaggggttttgatcctctcgttctcctctatctttcccctcaagaatcggagcaaatcgttgggtattttatctgaatcaaactcgttttcgagtttatctccaaaaccgagtttttgatttctcggaccgatttcttgcgggaggagtccgatctcttcaatccaaggctataaataggaccacctcgtcgccctctttcgtttgccccctctctcgtggtctctagtgctccgtagcgccgccgccgcgcgtgacaagacgccgccgccgccggccggagctcagccgcgccgcgccgccgcttgcgtcatcgccgccgccttttctcgccgccattaggtgcataggagcaaggagtagctcggccgccctttccccttcgtcgccggccgccgtagctcgccgccgtcggtcaacccgagccgccgctcgttccccgtcgtcgccggaagtcgtccgacgtcgtttgtcgttgtggtgagtaccgttgggttcgtctcgtcgtcctctacgtgttcttgccctccaattccgcagccggccgctctatctccggcgaggtcgccatcgtggttcggccgccttgggtgatgtcagcatgacgtcatcggtttttctttttcccgattttctaatagattaaatcttcggaaaatcataactaaataaccgtagatccgttttaggtggttcaagttgttaaatttttctaaaatcaagatttacatgttaaaaatatccacatgtactgtttatgcttgtttttgtactgttttgttgatttttgtttaattgctttagtttctgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggttataatttgattagcatgaaccttatatattggattggttcagctaaatgctatatgtaagtttgcttagccatgcctagaaacatagctaattaaagggattaattataaactatgttatattaatgttttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcagactgagaagtggcgagaagtccacgggggtcgctggggagtccatgccttgtttataaggggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcattaatggtaataatgtggtaattaatttgactcctggtttggaatggataattcctggtttggaggtttaatttgttcaactggggttggttgttcaaatgtggttgggcctatgcaacatgggtgtgttgtatggtgtttatttaatattgattaattattacaactgttttactattctcttaaatattcgttaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttctggttaggatgcgtgtggagtggagtcgccatagctgttccgtagtttgttatagttttattttccgctgcgtagaatgttattctttgagaggaactatctacctctgtaataatttattatttgcgaatattaaatagttatttatttgtactctattatcaatttgttattgtgtgcctcagttgattcctggacgagggtttaacacacatgtaagcgttcggaattttggatagattttccgggcgtgacagtttcagcaatttcatgatgaatttcctaaagatcaagaagaaatgaggatccgttgataccttaggctggcacccaagaagccaggaacacaagtcggtcaacctgcgttcccagtttcgaagaagccattgaccgcaccaaaaacaaaggaggtatggcaggttaaagagaagacacctgttcctgtacctttgaaactgggcacctcataaagctaagacaccagaggtacggttttgatgccgatttttctccatttatggcccattctctgcagagggttagtgaaccaagtactagtagtttttattttattattacactatatgcattgcaagcataactagttcttttattctagtaatattgacggacgtaactgatcgataacgaccgtcaacaaaaccccccaagcttgaacctttgctcgtctcgagtaaaggacaaaaggaaacaaaacttgattgttgatcaggagttgctactatgctgtatattctcaaatgtacaagtgcaaggtagatatactctctcaaatcaaataattttgacacgtgtcttacccttacaactgattcccgcgagacattgctttaccttgtcttgtgcggttggaagatagaacagcaatcaagcactagtcacccattatttattcaaccttttattccggaagttttcaaatgatctttcaaaagaaatccaagttcctcaaatgaccctctcgatcactcagagtgtatataaatgaattcctcaccaaagtagcctagttgattcctactctaaggtttagtatgtggagcttggtaggtatcaaacatagcatacttgcatttattactaagtcaaaactttagactagagcagatgactagacatactcaagatcaagatcgtgcataaagtgtgtgtgctatatggtggaaatagaatgtggaaaaaaaaaggaaatacttctcctttgtgctttctttcttctcccaagatcattcatttctttttttggagggggcatggctactcatttttttatcatgctcaatattttgaggagcaagactttattttcctaaccatgcctttccctctttttatctctttttggaaaggatattatattggaaggagaaagcatataattggagagcttgattttgggtgatagcatgatggatatagatggaatgaatgaatgctaacttctagtgcagaagtttgcatgtgcatatatgtgggtgtatgatcttgatcatagagtatcaaaagtatctacacaagtctcaagattttgacaaagttcaatggaagtacaagcgcccaaaatatatatggtttatcaaatatgaaaatttttggctctggtaggaatttttatcaaatgaggaacttttaagtttatcattttggaaaataaaacatccggaatttaagtcaaacttagaacaggatcatagcaactcttatcactatatcatctcgcgacaacctagacttagttcggcaagtgcagcccacttacctcaggttcccggataatatgtggctactatttattcaatctttcagagcgtacttaaccgtgaacccatatataagagatataaaacagagaaactattcatcatctcaacaagagaactagttgtcttacctagcataataaactctaacctatatttttggtattttctattttgcaaatttttttatgtcatttttagtttataggatgcaatgtggaaatccaaatatgcaattggaaaggaattgagcccttcacttaggtccctggtagggattgaacccttggaagcgaaagtatgcttgaagatcagcctgctattgttgcatcaggttattgatgttgacgaactgagcatcagcattttgctgccattctcacccgcctgcatataaagggtgtccagcctcatcgtgagaaacccaagtcccgagaggaactcgagcgccaccagttggaagcaggaggcatcccacttgatccagaggaacgggtgtgcgcgttcccccagtgtacgtcgtgcggtgcttgccagcgattctcattggcactgtgccaggaagaaccaccggtgctgtgccgtggtgcctgggtccaaccgggtgcatctcccgttggctcccagtccgcctcgtacatctgcacaggtatcgatgaggatgactcctcatgctcttgccttggtctgttgcgtgtcttcctgtaagatgtacctgcacaagattcttctatggtctgtaggggaatggttagttcctgacagttgtacaaatgataccccgcattgggtaatgggatttcatttgtacaaccggggaaaaagtatatcaatgagccatcgtctccatgcttaagtatatgcccttgtactaagtatgtttcatcctcatagggacggacagtggatatatactcgatctgatcggtggtaataactccaaggccattcgctatacgggtgatcaaagaagtacactcaacaggggcagtatacttaatactttctaactgtcacgtcctgataaattcatcccgaaataaaaattattttctaaaaggaataatagaattaattaaaattcgaaaagaaattggcaaacactaaaatacgtataagaaaaattcaaatgtggcccggagattttttgttaaattctccttggtctaaaaggagccctcaaattttagtggaattctcagagcacaaataataattattaagaaataaacaaagttaaaatgattttataaaaagaaaaatcctaaaaagtcttctttttcccccttcccctcttgggccggctcggcccatctccctcccctccctctcctctccccgcggcccactcggcctctccccgcgcgcgcgccgctgacgggcgggcccgcccgccaccctcgctgacaggtggggcccgcctgtcatccctatcctcgcgccgctcccgccgcccgcccgtgccctagcgccgccgccgccgccgcggattccgccgcatcccgccgtccccgcgcgcaataaagtggggggaatcattccccgtgattccctctcccttttcccccacttttccctctctct

SEQ ID NO: 58333 - DNA, 672 bp, Oryza sativa
gagagaaaagaggagagcttcaagctcggatgtcggggataaacagagggggttcctcctcttatataggcgatgaaaggcggttgtggaggcggtcgtcaactcggtcacggtgatgctagcgtgaaggaagaaaagacggcgccggcttgattccttagcggcgacgtttgcggcggcatttgcggcggcgtgcgcgtgtggaacacgcgcactgggaggaggagggaggcggctgggttgtgggctgacttgggccggctcggcttagctgggccggaagcccaagaggaaggaggaaaatagaaagaaaaaggattgggccaaaaggaagaaagaacggagtttcggcccgatgacaaaaagaaagaagtctaatttatatatttgatttggataactaggttttgcgaagaatttgaattcggagagaattcacaaaagagattttctaatttatttgagtgcaatatttagaggtggagtttgagggaatttatttggaagcactcaaatagaaaaggaaattaatagtattcctcaaaatatttttgggaatatggtaggaaaataggtggaggcaaaaggataggatttgaaccctaatatatatggcataggtttcaaggaattgtttgaggctaaaaggaaatttaggtgacaaggatataa

SEQ ID NO: 58334 - DNA, 6710 bp, Oryza sativa
attcctgcagcccattgtcgtcgatggaagaagttgtgtctctccccgacctactccaggccgagcaaagggcaatcaacctccggagggcgataccaagcagaagaccgtcatccgcttcaacccacaatcagaaggaagcttctcctgtgaatgatagcaatatgcagtcctatcacatcatcacagaactaatcaaggatgcagtcactagaacaatgccagctatatctctccagaatcaaaatgagcagccatatttgtggttttcagttcgctacctatcattgtgtaatcgaaagtttgcagcaatcatgtaatacataaatatattcatgtctataaacagtgagcttgctatgcttatggatgattcatgttgaagatacaatgtaccgatgttaagcaccttccctttttgtttaaggcagtgcctcgtattcttgtaatatgggagaaatgtgtaataaagacaagttctatgaggactctttcagaagatgctgatatgggattatgtgtataattgtttactgtcaaaggagacctagggtctcatttcagaggaactatgttctaacctcgagttaataaccaacctgttgatggaaaagaaaatcaattaaactgtgttgggttaaaaggccaatgagacagtagttggggataggagtttggatacgccttttacagatcaagataaggattgttggatgaaacccataagggtacccgccatgcctctacattgataagttcgcatatacctgcaaacagttaagaagacccaggagacatcaatatttgagagcatagtagtcgatggttggtaattagtctatcaagtatcagaaaagggtcaaaggtgatatggcagaagaacaatttggattctccccatctcgaggaagcactaaagatgatcatcggcaattaaaccctagtggcatagatacagatagcaagcaatgtatttccctgaaggtagtcagtgcagcttttgacgaaccacatcaaggtttcactgaaaggcagcaagccaaaggacctcatcgtccccagaagcgtccgcaatccacattaaagaataccacctgttagagataagccgaaagatgattgataaaagagattggcaaagatgttctccagcatgaaagaagtaggccgaaaggtgattgataaacagaaacatgctctgcatcgctcgaaggaagacccctgatagtaattgccccgcaacagtcaccttgtcattaagtaagcaagatgacctaggtaaaagtgtttctatgaaggcaaggagtgaaatcttcaactcagtatcagatgctacacggagtgaaaagtgcaagcaccggttaccaggtaatgccatgtcttgggagatgatccaatgggaaagaacacatcaaggttaaaggtgtaaaggaatacgttgaatgctaactgaggacaacctgaagataataatgggaagtaaactgaatgtaaagaaagtgaatccgagctgcttgttcgtgggagctattcccagttatgaaccaagtgatatgttcgaagatagtctacagaggtcagattaaaatcacctctaacaacgaagcttcagatttggcaggatcacgatcagacaataacaagtccagcagcaaagtcattcgggaagacgtcaaagcatgtcaagggggataaattggttctcttgggaagcataacttatagttaaagtggttgacccttgcatcgaatagcagaagtacctagcaccggagaccaggaaagctaatatgagatagttaatggcaagttgtcaatcatggtatccttagtaagcgggatatcatagtctaaagcatatggtggtaagctggaaggaaacgccaagcatggtattctcatgatgacaagcatggtatcctagtaatgacaagctagtgttgacgcatgagatgaagtggtaacttgtatgaggttgactccgaagatatgaatcatgagaagttctggaacggaagcatcattaaactaccgcaacctagtctgagtcagctaaaaggtgcaccctggttcaagtcaggagaagagaagattccatccgcaacaggagatcgagccaagcagtccagagtggagaagttttgctaggcaagttcgttatagaagacgcgacggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtataagaaaaattcaaatgtggcccggagattttttgttaaattctccttggtctaaaaggagccctcaaattttagtggaattctcagagcacaaataataattattaagaaataaacaaagttaaaatgattttataaaaagaaaaatcctaaaaagtcttctttttcccccttcccctcttgggccggctcggcccatctccctcccctccctctcctctccccgcggcccactcggcctctccccgcgcgcgcgccgctgacgggcgggcccgcccgccaccctcgctgacaggtggggcccgcctgtcatccctatcctcgcgccgctcccgccgcccgcccgtgccctagcgccgccgccgccgccgcggattccgccgcatcccgccgtccccgcgcgcaataaagtggggggaatcattccccgtgattccctctcccttttcccccacttttccctctctctctccctcggattcgctcggaatctttcccctaaacctcgtcggcatcaatggcggccgcatctttcgcggccgtttccccctcgcccggccgctctctccccctcccgacgctatttaatcgttccccgtgcctccctcctccgtttccgccgctcgccgctcactctccccttcggaatcgagcccgcgccgtcgtcctctctctccgccgtcgccgccgagctccggttcgccgctgtcgtcgccccggacctcctctcgtctcggcgtctcctcctttggcttcgccgcgtcctcgtcgacctcgtccgctcctccgtttcgcccgccgaccgccggagcaccgccgtcctcgtcgacccgaaccgcgccgccgccttcctccacttcggtcgccgtttccgtcgccgccgtcgacccggggtgagccgaagaccgccgcttcacttccctcttctctcctctctctcgggcgccgctccgccgcgccggtggtcgccggcagtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccagccgcgtgcacccggtccaccgtggaccgagaggctgccgcgtgggtcccactcccgtggacccggtccgcgcgccctctctcccggctgacgcaataattcgattttaaattaaaatttaaatgaagaaattcgcaaatatccatttaaagaacatataaacttcaaatgggcataacttggccatttgaactcggaattggaccgttcaagtctctaatttttccttaagaagtcaagaacccatttttgtgctttgtttctgctgttatgtggaatttattagcgtaaaagccttttcttttccgttggtcgtgtagacgctgcagctttggaagatccgctcttcgtggaagttgaagccggcgtttgggaaagtgagcaaggcaagtcacatcatccttgaacatattgaatcccagtttataaaattattttgatttaaattattgcattatcgctttatttaaattcccgcgttatcacggttttactaagccatgcctatttacctttgttatgaccgtattattgttgttattgttattattaccttgtccaccctagattaaacaaaaccccaactagtggatactctactcatggtaccactagtatgattttaggtagatgcttcgctgtttaattagacaatattaggtggttttataactttagacttggggaattctcatatcacttggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtactttcacatgtctagtgggtaaggcttagtttgtggctcagtcaagttataaacaaaagtacacggattggaggtggatgaagtcgggggtcgatggacattctccagggcaaatgaaggctacacgagctgcggcccggtagtcgagatgtcatggtacagggttggtgccctgctgctgggggctcagtcctgcctgcctgtcccggaggttccggccgtaggtgggattgggtcggtactcttctctatggctaggatgggttggaaactatgtcgcgtcttccgcctgtataccgtggtggtatgtggcacgtggttgcacgtgaggaagatgtgtcttgtgggtaaagttgtacacctctgatcagagtataatctattcgaatagccgcgccctcggttatgggcaagccgagcaatgtacccaagttagcgttttaattcctaaaatttgcttaacaactaaaatatggaatggttggcctgggttggcttgggacgagctgggacccagggtcgggttgctagttcggtctgaatcatcgtaggccttgggttaaggcaggttcgtgtgggttcacggccttgattaataacactgtgtaactctaggatcgtctttataaaatggctttgggcaactaagtgacttttaaatgctgtttactgcaaaacttaacccctattattatccccttgtacccccttgcattaatcatgcatctgccggtgtgacttgctgagtactgtggttgtactcattcttgctcaatctttcccctcttcagtaagagaagctttggagaagaagtcttaggtggagtcctggcttataccccagttgagcgcctgtgaagatggagcagtaggcccgctagtccgctgctgtttatttttgattgtcaggccttaagtgcctttgtaataatgtaaatattatcgatataatacagatgtgtcttttatatcatgtttgtatggtgtaccccggcttttcctgggacggggattaatacactagcgttcgggaaaatgcaattttctcggtcgcgacactaaccattgcctaatcatacatttaacaggagcaattttaatttttctaaccatggcaaacatgataatcaattcatctccttgaatgggtcaaagatcacctctaggaaacaaagtgtaacaccctgaaaattcgaccgacaaaatcaaaactctaaaaatacggattttcaaaaactttttaaactaattacatcatgccgatcttattcgtctattttatctgaatttgatatcgaagattattaatcgtgagtaaagaatagttaattaggaataaaccttaaaaacaaattggtaaaataaatacaaaataaagattaggtgggatagaaataaataaaatattatcgcgaccatatttggatcaattaaatttaaatacgatggaataagaattaaccctaattaaaactcaaataaattacataaaaataaaatatgagtaatattaatctagggtgaattcattagttaagataacacaaatattgagtaaaatgcatatatgcaaaattaagaattgtggaatcaaatttatacggaaattacactaaaatcgggttaattagaaaacggcactgttcattgcacctaaagtgttcgacggggtcccctaacccagctcctcctttttccccctgtctctgtcgccaccgtcaccgcgcgttgccgcctcgcgccccgagccgccgcgcaccgtcgccatcgtcgctagccgccgcgcgccgtcgccctcgtcgcctgccgccgcgccaccgtcgccatcgccatctcatcgccgcggccgcgccgtcgccgtcgcgtcccgccccgcgctgcgcgtgcatcccatcgccgcctcgtgccgcgcgccacctttgccgcgccgtcgccgtcgccatcccgtcgccgcgtgcgcgttccatcgccgcctcgagccgtgccattgccgcgctgcgtgccgtctcgtcgcctcgcgccgcgagcccgccgcctcgcgccccgtgccgcgctgcttccccgagccccgtgccgccgctgctaccgcgccgcgccgcccgttccatcgcctcgcgccgtcgccgttcggccgtcgcgtcgccgctgccgctcctcgcgtcccgcgccctgccaccccgccgacaccatgaggccgccgcccctcttccctcttccctattatctctttccccttcccttatataatccccccctactcccactctttccctccatcctcacctcctctcctctacccaccccaccacgccgcctccacgccgccgcgtcgtcgcatagagctgccgc

SEQ ID NO: 58335 - DNA, 9050 bp, Oryza sativa
tctacatgggtcttaggttaggaaattttttggttggtccggggtagatacacccatactttctatcctctaactccaaattactccctctatccataaaagttagacatatttcacatttgagttcttccaaataagttgttcctatttgtggtctttatgcattcatgacttaaatgatgagataaattaaatgtttgattagaacccaatgagtcatctaaatactcgttggttgcatgcttgcattcactacttgattttataacatccaagatgatttaatttctccttagttgtcacaccctgaaaattcaaaatatataaattgttgtttaattggaatttttagaaataattttaaaagtcttgaaaagaaaatctaattttaattaataaattccaatataaaatggggccagataaaatttcattaaatacttggcttaattctataattcctagatttttctgggatttatttgagctaaggaagtatttttaataaatgaaattgcatttaaggaataatttaaattgaaaaaggttttaaaaagtctcttttggctttgggccgaaagtcggcccaaaaccgctctctctctcctcggcccagttcggcccagtccgcagccgccgcgcgcgcgcgttcggtcgctgacaggtgggtcccacctgtcggacccatcgtctaccttcgtccgccgccgcccgaaaccctagcgcgccgccgccgccgttcctttccaaatccggccgttcctttccttctccggccgaattgtttgagggaaaacaatctccgggatctcctctaccttttctcctttggaatctttggctaaatcgttttggaagttcgtggaatcgagttcgtttcggatcggtttccctctctccaagccgagctttccttcgccgttgccgccgccatgggccttcgccgccgcctctgagcccctttaaaaggacccccggtgtctcctctacccgtcgccaccttcgccttcgcctctcgtcgtcggaaaagccctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcgccagagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcatcttggtgccctccgtttgcgtcctcgcgccgccgttcgccggcgagcgtgcgccgttcgagccgtctcctccaccgagccgccgccgctgtcggtgatgtcaccgctgacgtcatcggggtcgtccgccgtgagccgccgtggacccgatcgatctcggccgtccattttggattggttcgatctcggccgtccgttcgtgtgaaccgccgcccgtgcgcccggtccaccaaaccctagcccgctgacgcaataaaccctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacatttatgggataactaatgattcactattatttcatgatggcttaatgatagttcacgatggtcgatcgtgattagttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgtggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgtttagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggagtggaggaataggtgtagctttggtcaagctgcctgtggagtggagccgtctgcgccgtttatttattttccgctgcttagatccttattgattgagaggaactatctacctctgtaatgacattttattcgcttattaattagagtaataattgtactctattatcaatttgttattgtgtgcctcggctgattcctggacgagggttcacacacatttaagcgtttggaattttggatagaaattccgggcgtgacaagttggtatcagagccaggttgaccctaggttatgccaaatggttatccatagaagccctctaaaaatattggaaaagtagaactggtctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactacctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgctaccacgaagcatttggttgagatgttgtgggctatggatgaaagtcgtgcggagactgtgttagccgctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaggatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgtgagtctttagtttgtaataatgaaactcagttaagatcaataaaagttaaagtaattctctgtcctaagtagtttccccggtttctcttcttgtgccctgcccatgccagatggtgaacactcgcagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacaggggaataatcagaagccgcgtcttactttaggaccccagcccatgccacagggaggttcttcgtctgttgttcgtccgcagcgtcatttcttcaacaacaatgctggcaacaacatccgtaatcaagctccacgtcctgttgcagctccagcacagcaacaacctgccaagagggagcaaggcagcaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccaaataactttggaagagattcctatagtccgggagtatcccgatgtgttcccagatgatttacctggtatgccgcctaaaagggatatagagttcacaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccatgatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcggaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttctaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatttgtgtccccgacaacaaagatctaaaagatgcagttctgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagccattgaagattcctgaatggaaatgggaagaaataggtatggattttattactggtttacccagaacgtcatcaggccatgactctatttgggtgatagtcgacagacttaccaaagtggctcattttattccggtaaagacaacctattccggaagtcgcttggcggaattgtacatggcaaggattgtgtgtttgcatggcgtccctaagaagatagtgtctgatcgaggcagtcagtttacttcaaatttttggaagaaacttcaggaagagatgggttctaagctgaactttagtactgcttatcatccacagacagacggacaaaccgaaagggtgaatcagattttggaagacatgttgagagcttgtgctttagatttcggtggaagttgggataagaatctaccttatgcagaattttcatacaacaacagttatcaagctagtttacagatggctccttacgaagcactgtatggtcggaagtgccgcactccgcttttgtgggatcaaacgggagaacgtcaggttttcgggacggatatcctaagggaagcagaagaaaaggtaaaggtcattcaagaaagattgcgagtggctcagtctcgacataagagttatgccgacaatcgccgtagagatttgagttttgaagaaggagattatgtgtatcttcgtgtcacgcctcttcgaggagttcatcgttttcacaccaaaggaaaattggcaccgcgttatggggaccttataagattgtcagtagaagaggagaggttgcttatcagttagaattacctcaatctttggcaggagtccataatgtgttccatgtgtcgcaattgaagaagtgtttaagagtacctaccgaagaagctaatcttg

SEQ ID NO: 58336 - DNA, 2604 bp, Oryza sativa
aatctttcccctcttcagtaagagaagctttggagaagaagtcttaggtggagtcctggcttataccccagttgagcgcctgtgaagatggagcagtaggcccgctagtccgctgctgtttatttttgattgtcaggccttaagtgcctttgtaataatgtaaatattatcgatataatacagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagaggataaaacctaaggacatattttataaataaaattatttgcgaaagttccttttttctccttcccctgtgctatttgcaaaacgtttactctttcttccttcttcaaatttcaactagtactagatggtcggctttgtggagaagaagatgttgtcaattgtctgccgaagctccggaagactgcaggatccgctagtaaagtgaaggaagcagtgaagccagctgtgaagcaggagcgaagatcttggagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacgttggtacctcaagctcccgagtgaacgaagcaccagacaccagttgtgtgacactggtccaacacctgattaaccagaaccgattgcttatagagatactgcagcagcatcagacgccaattctgaacctgagtcagatacaacctcaagtgcagttggaggcagtccaagcacccacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagagaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagacgagaagtctccccaaggtttcaaccaggataaaatggaacgtaaggcatgctctcgttgtggagaaatcggtcatgttgccagctcgtgtgccactacatgcattcattgtgaggaagaccatccacccgacaggtgtccaacgagcaggatcacttgtttcttttgtgaaggaactgatcatgtaccaaaagattgtcaattcagttttctgttgacgaagaagatggccaaccaacctgccagttccaacggagagaagcatcaaggccacacaaatcctcaccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccgaagcagtcctatagcccgcggtgcaacagctccaactccagctagtgcattaccacaaggtgtcaatgctcaatttcagccgcagccaccagttgacaagacagaggccagtatcggcattgtacctttggatgttccagcacagcagccaagaaatcaagtacaagatgaagaacccgagcgtaagaaagttattgtcggttacaactgtagtacctgttaaggaaacagacatgccaatcgccaagtggtcactggagcaaatgcagtacctgttaagcctagcgctagtcagaagcaaccataatactcttatatcagtgttcaaatacttttgttttatagttgttccccgtcaatcatgtaataacagagaaacatgagataatgaatgagtttgataagtttatgaaggatccatgttaagattgcaagagctgtgagttgtgtacattttgttgttgattagggggacctagggtctcatttccgtaagctcataatctattatgaatcaaataacctagcgattgatggcgaagaaaatcaagtgatcaaccaaagagacatttgtttggactaagagtttcagatatgtcttcttcggatcaaaggcatgcacccgttgtggagaaattggacacgttgctagcatgtgtctcacactctgcactcactaggaagaagaccatccaccaggggag

SEQ ID NO: 58337 - DNA, 2299 bp, Oryza sativa
ggtctctgggcagtcattcccagaatgtcccgtgttgccacagacttagcacgtgatgtgcgagtccaaggccttgacggtgcattggggcttcttgtcgtgttcgtcaagtcgtttcattaggaggtcgagttttgcagcgagtatttccgtctccttggcagtgtgcattcctcgctgacgggattggagccgttcctcgctccaacccatgttagagactatcttctctatgaggtcgatggctcctctgaccatcttagagaagaaagctcctccagctgccgcatccaggtggttgcgggacgtgggagtgagtccattgtaaaacttttgcaggatcagccagtcgtacattccatgatgaggacagacggccacgtattcctgcaaacgttcccatgcttccggaatggactcatcccgcatctgctagaagcccgaaattcacccacgaagggcattaatcttgcccatcgggaagaactttgacaagaatgctgtcgaacatttttcccaagagtttatcacagcacgattggcatagaatcacttcttcgctttcccgaggagggaaaatgggaacagcctcagcctgacgatatcaggactgacgcccttcacagtgtacgtgctgcaaatctccagaaattgttgcaggtgtgcattagcatcctcgttcggcttgcgacagaatgggctagcctgcgccatcgtaatgaggctggacttcagatcaaagtccatgtctcccaaattgagctgcggcccagtggccacattcttagaggagggagcagcgaactcgcgaagagtcttgtcagccatggtcttgaaagttggtggcgctagtacgtttggcttctttgtcggaagagtcttctgcgggggaacaacccgcagttttatgcttcagaagaagacttatggattttcctggaagttttccggcaggtcaaaaacaattatacactaccctattttcacaacaaagggtgaaaacaacaaggttaacctgcaaaggatattgactatacagaggtaaatataagatattagttttaggaatctcttcttataaatcttccccagcaacggcgccagaaatgcttgttggtatttcctaacgacattactagaaatataattcccagcagtggcgccagaaatagtcaaggtatattatggttacagagattatccgcaagcgcacggatataccattgtagcatttcacctgagagttttccaagggtatcgtatttgtttatcccgtgggaagattataatagagagaactaaactaatatttatatgttacttgtactagtcgtgcctaagaaggggtaaagataattccagggtagaatgacacacaagctcaagctactcattcctatattaaatctctaagctaagtggaaagaatatagaaaagaatctattcctatacttctagtatacatagtgtacatacatcctaaatatatgattaactagctattaccccctttctgatgccctcctggtacttcgagaagccacccctgaccgccgagttccttacgacagcccgtcatgaccatacaaccagggctaaatacggaggagtaccctccccagggaattaacttaggattatatacacgcaaggaggaatacccgtagcgagctgtcaccatcagcggcccacctctcatccgcagcatataaccccaaataatgatacctagtaatctagacaccacgtctaaactaccagatactactctaatatcatcgtcatgacatagagtaattgcatatgcaaacattatacccgtaccaatgcatctcctagaaaagctagcagtataatcataatatctcggacatattgtaaagctggtattcatatattcggaaaatattacaatactagagtcgtatatagaggaatattctaaattaaatactagtcttgcaaaagaagaaaggaaagctactagaggccatacccgaactcttccaaagacttccagactccgactactattctattcctactccactagcttaagaacactaaactaaacttgagagagagtgagagcttcgatgcttggagtgtgtgaagaaatggagggagtgaatgccttaaataggctgccaatgacggttatggcagttggaattgtcaggattgccctctaaccgtcattggggagtgatccaagccgtccacttggatcgaacggccgtgagggaggttcggccgaaccctgggctaggccaaaccagcccattttcggctggcggg

SEQ ID NO: 58338 - DNA, 4079 bp, Oryza sativa
cctgttcatgataatgagatgattattatatatgccatggttcattagattagagtttctcctgtgcaacccatgattaggcagtgggtagagagcatagaggtctccgctcctataaaatgcacttctttgatcacttgtatagcaagagggcttggggttattacaaatgatcaaattgcttatatctcagtctctcgtgtttatataaatgaatcataactagtgcaaggtcatactttgaaacatggagcagatgtgaccttagtattcttccaacccggttgtagaaatgaaatcctgttacctaacccggggtatcatttgtataactgttatgcactaaccattcccctgcagacgatagaggaatcccgtgcaggtgcgacacataggagtaaccgcagaatggcagcagatgaacaggaggattcaacgtactcaccacccggtcatgcttatgagagtggctggaaatcagctagagatgcctccggctgggcccaagccctacgtcatagcactggaggatctgcctagccgagtgccggcagttcctagtggcagatgcctcatgaggtgcgctgggggcacaccaactcagcaggctcaagtggcgtgcctccaacctccagctggtggtgctcgagttcctctcgctgggacaacagtccctcgaaggacacgtgatccaggcgcaggagtagcagcaaagtgttgatgcacagttctcaaatatcaacaatatgatgcaacaacaacaagctgatctgcaagcctacttccgccatcaaggattcaatgcttactctggaccatgagcaaggagcaagcttggggggagaagtctctcccccgcaaaggtgacttgtatctgcatttatcttgcatatttcctttcttgcatgtttcaattcttgcatttgcatttataactcaaaaacataaaaatttgcaaaatagaaaataccaaaaatataggatagattttaccatgctaggtaagaaaacctagttctccacattgaaatgatgaatatttgctctgctttatatctctaatgtatctgtacatagttaagtactctctcaagttttaaataatgattagccaaccattatccgggaacctgagagatgtgagttgcacactgcgtgatttaagcctaagctgttgtgagatatgatatagtgaaatagagttgcttaaatcttgatccaagcttgatttaaattttggatgatttgtttttcaaaatgataaatttcaaagttcctcatttgatatatttattcctaccacagccaaatataatttgcacttgaaaaccttatataatatttggttacttgtagttccattgaactttgtcaaattttgtgacttgtgtagatatctttcatactttatgaacaagatcatacacccacatatgcacacatgctaagcttctacactggaagttagcattcatctcactcatatccatgtcatcatcgacaaataaagctctccattcatgcattcttctccaaagaaaaatcttttgcaaaaagaaaagaaaaagggagagaaaggtgtggctataaaaaaatgatgaataaagtcttgctctatcaaaatatggagcgtgatgaaaatatatagccataccctctccatgaaaaacaaaggataatttggaggagaagtataagcacaaaggagaagcattttctttatccaaattttattttccaccacacattccacacactttgcatgatcttgatctaagtatgatttgctatctgctttagtctagatttttgacttagtaatttatgagaatacaagtatgcctcatttgatccaaccaagctccacatattcaaccttagagtaggattcaaatagggcattatctttcgtgaggaataaaatatctatacactttgagtgatcaagagaatcatttgaggaacatagtttttatttgcaaaaatccttgaaaaccatccgggatgaaaactgagcaaggaaaaagaaaatggtgctctatgatctgttctatctctcaattgcctaaggtggtgagaagcgtgtgttccacaaatgttaggcataagggtaagccactatgcatatttacttaacatgagagagagtactcaaactgtgcacttctacattctagatatacaccatagtagcaactcctgatcaacaaccaagtctttgtttcctttcgtcctttactcgggacgagcaaaggtttaagcttggggggtttgttgacagtcgttatcaaccaatttcgaccgtcaatatttcccaattactgaagactagctatgcttgcaatgcataaattccaaataaaatgtctatttccactatgtactatgctactaacatatacgcaggagaagcacatataaatagaggagaatcgacagaaagcaaacgaacgatcactcgaaagctatcgagaagcaaacttgtgaaaagatgggccaataacacaaaatacgcacgagtaaacaagcccaataattcacatcactggattgatgaatcaacaagaagtccacctgcaaagttgtgggctgattgggcctagttcggctgaaccagtagctagcccaattagcctaattcttcaccagctggtagttatccatgtcccaagacggttatgaccagttaaactgaagaaaccatcgctggacacatgtcacaaggagatgaagctaaggagaatatgctccttggatgcttggagcatctccactctcccaaatgcaactcatggcctataaatagctcctcctctcattcattcccagcaaagatcaaagcttctctacaagtttagtgttagtatagtgctagtggagtagaattggaatagctctgctagtcctcggagccttcagaaggagttcggtaaagtctcttgtatcttttcctcttcttttgtaagacttctactttcaatagaataatcttctttatataattcaggtgctttattccaatcttagaatatgcgtaccgactttatagtattcatgaatagtataatctgtgtagctaaatcttctgggaattgcattggtgcgggtataatgtctgattattcggttgctcaacataaattgctaactgaatatttggttgctctatagatatagatgagggagagagagacagaggaagacatggagaaagagagagtggctgtcaagaaaatgagagctggcacctggtcaggctggtagtgtgcaacaagggtttgcaaaaccaccggtgaccatggttacagtggtaatagaaaaaccacggtaatctccttaaattcaaataaatttaaaaaataatttgaaattttgataaattttgcatggtttcgtatggtttgccacggttaccgcgcggtaaccgtgcttaccgtcggggcacggtaaccccgtccccggcggtttgggaaaccctgtgtgcaacagaatttggtatgatctccttgctattttacttttttaatattaacataaaaaccatcaattcttaacttcaatatttaatgagaaaaaaaccataaattttaacaaaaaaagttataaaggtttcaaaaaagaaaaataaaatgcaaacgaataacaccaattttcacaattctgacgtgtgtcgtcggtttaactccacgtattttcttcaggtatcaacacatactatattctcatagttaaagtggataaattaccacaaaattccatttattttttttagacttacctacttaaaagatatcaatatttccgttcatcacataaaatttccatccgtcgccttctgtgcaaacacaatcgcattgttcttccgaacgttcttccaacgctgcaaccatccagacaacatgtcaaaggcatcattcacatcccgcacatgtagggaaaattttacccagtgtgacgcactggcatttaggtaaggctttcgggttttttgtcagtcttttttccccttattttccttttttttcacccgctttttattcgttgccttttttagtccgtctttttttcgtttttccctt

SEQ ID NO: 58339 - DNA, 718 bp, Oryza sativa
tctctttaatgcatataggcaataaaaatatgcttattttgtagtattacttttggaaccatcaattttaaaaatgttattgaaaagtacaataaattgtcataaacaagattagcataaattaattattttattccttgagttagacaccgttgatatttgaatatatgtctgaccattcatcttatttaagatttttatgcaaatatataaacatatagtcatattcaaaataacattagtaacaatataaataaaaaaaataaattataacaatatatttttttaaacaagattaacgatcaaatgcagatttaaacgcaaacataaaaaatagagttaaatgtacaatataaacatatccagaaatagacagcctataaataaagcgcgtcatacggcgtgcttattaattttctagtctaggaggaaagtcaatttatgtctccaacattggaaaaagtttacctgaggtccccctttttgttaagttacgaaccagattttagctaacatggcaactgagttagacccacatgtcggggcatttcagtccaatacatttctgttggcatcagtggtggtcactggcgagaacttgctgagaaaaggcgaaagcatggtggagtggggagaggaggcggcgaaggagcaaaggtattaccacctcctctgcgggcttggccggtgggacacgaaatttttttattttttatac

SEQ ID NO: 58340 - DNA, 949 bp, Oryza sativa
tacatctcgtggctcaacgaggcctgcgcccaactcgatggcattggtaagcgtatcgacgaggccttgaagcaagagtgttgtcgagcgagccgatatgccggaggacatgtgctggcttgcatacgagatcactgcccacgcatggatcttgaatttctccgcaaaggttttggtcgttctcggagggatccggcggagatagaccatctcgcgagatcgatgtcgccgttggccgagaagattttccaatcaatggactggcgttggccttcttggtaggattcgtaccctgcaacaagatatcttgggaaaagatgtaatgtgacaaaatatttatgtacaaattgtaaggaatattttgtgaataaagaaatctatctttaacaaatgtttcttactcagggtgtcgtgtgtaaggccgtgttctcagttaacgaccttagttagccgtttgagttgtacactctccctagcccccagccttgtcgtcggagggatgtcctcgggtggcaaggctcttggacccctggcctgtcttggttgaataagctctgatcctagcccccagccgtgaagttggaaagattggtttccgattacacggtttggttaatacgcacggcgagaactcttacacgaccagatcttacatggtctttcgtctctgaaggatctgacaaggccttatcggctctgggcatctccagccgaagatcccttgggttcctcggaggccttgtcgagacggtgtaaacggacataaggacaggtttcaacgctaggcgtcgtcagagtgaggagttgttgggtgaaaacactttggtcattatatgagaccaagaagtagtctttattgatactgtaagggtgcttacaggtacaatggtattgaatcttacatagaatttaaggaagttgggcaatgttccatgaatttgttaattcg

SEQ ID NO: 58341 - DNA, 1578 bp, Oryza sativa
cagcatataaccccaaataatgatacccagtaatctaagcaccacgcctaaactaccaaatattactctaatatcaccatcgtgacatagagtatttgcatatgcaaacattatacccgtaccaatgcatctcctagataagctagcagtataatcataatatctcggacatagtgtaaagctggtatttatataatcggaaagtattacaattccatagtcgtatacagaagaatattctaaattaaatactagtcttacaaaagaacaaaggaaagtaactagagccatacccgaactcttccgaagacttccggactccgactactattctgttcttactccactagcttgagagcactaaactaaacttgagagagtatgagaagcttgcttgcttgaggtgtgttggaaatggagggagtgaaggccttttatagctgaacaatgatggttggaaatgtcggtaatatcctccaaccgccatagggaagccatccacaccgtctatccaaaacctggatccaatggtgcttcggttggttctgccgaacccagcccaaactcggtcagtggcctcctcttgctctccttcacccagacttatgaattttggtccaatttgatcgtgtcaattatggtttcatggcccatctttctataagtctatttctcggcatcgtccgattgattgatcgatggttttgatgccgattcttctccatttattgctcattctctgcaagaggttagtaaaccaagcaatagtggactttattttattataacttagacgtggtgtctagtttagatattacctttgtttgttgtgtatcccatggatttgtcagaggtaggcgacaggtggtgacagccctgaatcgcgtcctagtaatcttccacattcagatacatcatagagctatagccagaaccacgctggcagaccagcaggggtcggtgcctgaagcaatagattggaaattacttcaactcagtctagataactaaaacacttagaaagtcctctctagcctagcctagcttgcttaccattagttgttgtccttagatagtcttagatttatgtagattacacacgttccctgtgttcgatatcctttaggggtcacccgaagatgaagtactacagcggtattccgtgtgcttgcagatttatctatggtcttaaggaataccaacaagcatttctagcgtcgttgccggggaacggttgctaatttttccgagtctaggtcatcctcgtatctttttttatttcttcttcttttatccctttccttgatggagcaacccacaattcaaaacctttctgctcctcaggctgatctttgtgagccatctcgttcttcaaaaccaatcctttcataaggctacgaaatcagtcctggctttatagccatgattcaagagcaaaccttctctggtggtattagtgaaagcccatacctccatcttcgggactttgagctagtgtgttcatgcctatcgatcgtaggaatggcacatgaaactttgaagtgaaaattgtttcctttttctcttagagatgaagtg

SEQ ID NO: 58342 - DNA, 2340 bp, Oryza sativa
cgctatattgtttttaaaaaagagatgctgctgaaatttctttgttttggcacttttatagggttctttagtggcatcccagacttgtggagatttctagggtgttacaggctgtatctagctacacccagtctctctcttgagcttatgtgtcgccttggtttagctttcatccactcctagtggtgcacaacttctcgctcccgcagcatctacacttatacaagcaagaggagatgccctcttctttttctaggcggcgtttgctccagttcgcagttgcacatttgccaataaaaaagagatgcttcctacatctctacaatattgtgccaacggatcataccttcaaggcaaaaggttcttgcacccgacgtgtgtgcatgactaaaccgctcgcctgagttggcatggtcgaggtgccttcctccgctataatccgcaacgagatggaggagaaatctacaatcaaatgtgaccatgcaactgccccaaagattccaatatatccatcatgttggcggtaagtacactcaggtatgcgaaagataaaacaaggttcaccaagcatttactcaataatatcaccatgtgaatatggcttgatcatacatgattatgtttaccttgtctattttcatatactctggtttgggtatttccatagactttttaaattaagcatggtgcttaggttaaaattgtttgctttaatcaaattagacatggagttgagattgattaatgaaccatcagagttaatatgttcatcgacattggatatatatcttctgtggactaacccctacaggaaagttttcaaactgacaggtgagtcctcaagttcaattctcattggaggtaagtcagggcccgggaaacaaatcagtaaattgctaacatgcaaaggaggagcacaccatcttttgattatgttcatgcaattttacatcagccctgtatgagattttgcttaaacaaaaatttggtgaacaaaaaaaattaaaaaaaaatgttttcaagaacaaaagaagtgtctctcaaaaaaaaataaatggcaaacttttgggctcgacgcttcttaagttttgaatacaatttctctttagcgtggatgtgaacaactaatcttgaggctatgataaaatcttttcaattatttatagtctctcgggtatttactgtccactaaccgtttgtagggaataaaatgacaatcaacagcagtgtacaataagttcaaacacatatatcacgctccttggcctcataggaaagagatgcacatggaaccaaacagaacaaatgcaaaacttgttgcattcgattcggttctaagcttggtaagatatatttggtaagaatcccaaacatcttgtgtatcctcgcctcatatatccatcctgctacgatacccaccatatccattgtggccataaaataaaaaaaagataaaaaataaaaataaaataacataaaataaatttggctccttagtcttccaaccaagtgagtcatttttgcttcactcttgtctttgtttttcttttttgtgtccaacaaagagtcccatgtacaaagagaagtgtgggggtgatcttgcacatcaacgccgtaatcaaagcaagatcaccccagaagtgatgagccatgacaaaccacacaaggaaaattgacgcagtcagacccaataaggggtcaaccaaacctccagttcggctgaactacctctaacatgaatcgtcctctgttttttacagagcgcaagtttgcacattattcatttggacatccattctatcttgagtttagtttgattatcaattctaacatatcgaagataattaaactcaagctagggatggtacaattagagtttatggtctctctgaaaatgacatgcaagcctattattcttagctcattacttgttgcttgtggtgatatatccaatagggaccccatgccatctaggtaattgatgaatgagatatagtctaatgatagaaatcctgctcttcatgttgcacacttgggaattttataaaaaaaaacataacgatgctaaactcatcattgatattttttttattcccactagagccataggttgatcattcatgattggcttgctacatatgctgcttgttattacattgagcgttgtcaagttttgtgacccttgtgaaatgcttatcatacattcatggtcaagatcacgcacactccacatacacgcacttatgctaaatttctacactggaagttagcattcatcatttgtcattcatttcatccattatccacaaaataaatactccatgtcatttatgcctcttc

SEQ ID NO: 58343 - DNA, 1537 bp, Oryza sativa
ccatacgcatagaaaccatctagaagtcaaatccccgaaggaaatattcaaatccgacaaaacaactcgaaaccaaaacaaactggaacctgcctgtaataccctgaaaagaaacattttagtgtcggcttcgggatggtttataatatcatggtagcatttagttaaataaataatgtcttaggagtgggccaagccaacctgggccaaagcccatgaacccaatcactcctctcccatctaaaaccctagaggaggaggggccggattccctcttccccctcgcggcgcctcttccccctccactcctctcctgtgcgtactttcttctccctctcctctccatcaaaccttgctgtccgtagatctgcaccttcatagcttggatcaagaagcgaagtggaaaaacggaacgaggaggaggagaagagaagaatgatgggttagatcggagtttccccgccgtttcccacgggatatgaaaggaaaaccctatgtgaggtttaccccccctgttgtatcagttgttctagggtgattttagtggtttaattcgtggtaaacaaaggttagagaagggtttttgtttgttgtggctcggtttggtagttctcctccgttggcagatttgcattgtttcggtttttttgttgtttcgggggtctaaatgatgttttctacgaaagtgtataactaggaagttgtagaaaattcatagacctatcttctgaccagagggcgcaattttatctttagttgtttaggatatatgaatttttgagtatgactgttgtttttatgtcataatctggacattagtagattgaactgcaattgggggatccaaaaaattttcaaaaagcaatacaattgttcttttcttccaaccactgtcgagagaatcacgcctttcggcgtgacatagttgtccattcgacaacagctggagccatccgtggggacctccgaccgaaacactgagagtgagtgaaaccactgatgccaccgaagaagatcgtcagtgtcacgtcccaaaacgatcctaaaatatatcctttaaattatgcctagaataattaaatttctagtgaaagcctccaaaattaaaatgtgcaaagttaaaagtcaaacaaggcttagaggatttttgtatatttcctaaaagcctaaaatgtgtaatcaaattttagtggaattttcagagcacaaataataattattaagaaataaacaaagttaaaatgattttataaaaagaaaaaccctaaaatcccttcccctctcttgggtcaaatccggcccaactccctcccccatctctcctctccccgcggcccactcggcctccccctccctccccgcgcgagcgccgctgatgtgtgggcccgtccgccaccctcgctgacgggcgggacccacccatcatccccctcctcccgccgctccctccgcccctgcccgcgcctagcgccggctccgccgccaaatccgcagtgcctagccgcccccgcgtgaaattgaatgggggaaatattcc

SEQ ID NO: 58344 - DNA, 1124 bp, Oryza sativa
cccaagccaatgaaagaaacctcttggatcccatggtacctttagtcctttaggctgcaaaaactttgcttccagcagataactaattgttgatataaaagctgcattccttggtaaaatctgaatttgctctgtgataagataaaaaaaaatgcatgtttgatagattgcagaggctctgaaatcaccatcttagtctgaaagcttgcccaatggttgccactgaaatcttcatcttgtttcttgactaccaaacgatttctagcctccacatcccaaattaagttggcagctattgatttaatcacctggagcatggaaattgattcacatatagagagcttgagtgtgcgcctatatccttgtgcaactcttctatggtacagtagagctgcagcattaaggaactgaagcagaaccccgccagagtccaaatgcacctccaagttccatgtcagatcaaaccgaaccattatgtctgaacactgggacaagcttaatgacttgatatgctcttgcttagtgaaggaaagggcatttggaatagagtgaacttgtagcttggatagcaatgacctcaaagatccatcatgaattaatgcttttgggttaatacacatcttcccaggacttgcaccttcaaatatacattgcagctctttgttgctcaactgtctttccttcataatacgagcaagttctttagatataatacgagcaagttccatagattggctattcatatgatgcccctgcattgcaagaccatagacctctcttccctccatcccccatgccaaagaacttactagacttggtggaggccatggtttcaacccagccatctcctgtgttaaaatcacggttccaatgactaaaactccaatatcaaaaggctcccatgccaggaagcttactccagccggtggtggccatgggggcatcaatggtaaaccttccaaatataatttggatcctggccaatgcaaaggttgcaactcccatcgtctaatcactccacccaaccaagaaggtggccatgaatttctcttagcattccccattagcagcttcttgtctttgggacatttcatcgaacacccagtgggcagcaatggaataag

SEQ ID NO: 58345 - DNA, 2854 bp, Oryza sativa
ccaaaagagaaaaggtagaggagatcccgaagattgtttcccctcaatcaatttcaccggatcgggaaagacgcggccgaatttagaaggagacaacggcggcgcggcgctagggtttcgggcggcggcggccggaggtagatgacgggtccgacaggtgggccccacctgtcagcgggcggacgcgcgcgcgcgagcggctgcggctgcgggctgggccgacttgggctggggggagagagagagggttttgggccgatggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaataaaattttatctggccccattttatattggaatttattaattaaaattagctcttctcttctaggcttttaaaataaattctaataattccaattaaacaacaatttatacatttaggatttttagggtgtgacaccatgtaatacaacaacacacgttcaacaacaatctcggcgcatcgccactcttttactttcgttttgtttcgacgagttcttgctttcgggttgagctgcatcggtttcgatcttcaactaagaggtaaaacttgttatggcggcttgcgttctcgggattagtgcttacatctttatgatactctaatcttgttcatgtaagttgtcgagttatcatatatcttatataatctctgacaatatcgctatctaacctctagtcggctaatatctatcgctagggagcagccgattatgttacatatcgacgttggcttagattatataggatatctaccactctatgaagcttccaatagcttgattgtctagatattgtctttcttttcatacttatggctgcatcagttgtgtttgacctcataagtcgtgtttagaactatggtttctagcctgcttcttggttgttgattagagtagcatcggggtttcagctgatcttacctggtttagccttatatttcatgtgcttaattgatatgctagatctgccctttatgttgagatcttattgctttttagatatgttaagcttcttgtttgatatattttactcgctttaatgtcttaatatagagtggtatcggagtattagccgatacacgctatatctatctgatcggctatgctatgaacatatataatttcgttgttaatatatatttcgatctaagtgatttatactatctcggcatggcgaccgatctatcccaatcacttgatttatgtatatatcgacataaagattatatattgttaataattacagccgatcgaatagatttagtccttccttatttattcatgactgcggatcgatgcaaagatgcaaagatgacatcggctcaaagataaatgatacgtcatcggcggctggcagatcggctatcatttacggtttaactgcgttttctttgtctttatttcttgttgattgcagtatcaaatcaactggcacgcctgcgaacctaaaggcaagctttttggacctgcactggagttaagcagatctcccaggcctcgtgtttctacatcaacacgggagggcattggaaagagggtattagctagtatatcggttaactaggatgtatgtatactatgtatattagaagtataggaatagattatctttctcttttcttcccacctagcttagataatatattatgagattgagtattaatgcttgtgtgtcactctacccttgaattatcttaacccctacttagaatatgattatcacaagcaatgtataaattattagtctagttctctctacatgatcttcccacggaataaaataaatacgatacccttggaatactctcgggtgaaatgctacaatggtatatctgtgcacttatggatgaactctgtaaccataatataccagaactatttatgtgccattgctgggaattatatttgtagtaatatcgttaagaaataccaacaagcatttctggcgccgttgccggggaagattcataatagagattacttgaactaatattttatatttgcctctatataatcattttcctttgcaggctaaccttggttgttttcacttttgttgtggaaacagggtagtgcatgactggtttcaacctgccggaaaacttcaaagaaaatccagaagctttcttccggagcgtccgaccgcgagtcgttgctccgcagaaaactctaccgacagataaaccagccgtatcagtgccaccaatcttcaagactatggctagcaagactcaccgcgagttcactgctccctctgctgacaatgtggccattgggccgcggatcaacatgggagacgtggacttgaagtctagcctcatcacgatggcgcaggctagcccgttctgtggcaagcctaatgaggatgccaatgctcatctgcaacagttcctggagatttgtagcacgtacaccatcaagggcgtcagtcccgacgccgtcaggctaaggctgtttccgttctcccttctcgggagagcgaagcagtgattctatgccaaccgtgctgctgtcaacacctgggacaaatgctctacggcattcctttcgaaattcttccaatgagcaaaaccaacgcccttcgtggacgaatttcaagtttccagcaaacgagggacgagtctattccggaagcgtaggaacgtctgcaggagtatgcggccgcctgtcctcatcatgggatggacgaccgactgatcgtgcagaatttttataatggactcaccccg

SEQ ID NO: 58346 - DNA, 956 bp, Oryza sativa
atcgattgcccaacttcccagtcagaccgcactaccaacacctcactatcagactgccaaaacctagaaaaatacaaatcaaaaactcttaaaagtaaataaatttatttcttataattgtgtttataaagtacaacaacaacactcctctcaatttttgactaaattcaaattctaagctaaaccataatttttcttaaaattattctcttataaaatcaataccaagaggcctcagcccctcttctatttatatcataagatagtatcctaaaaaccacgaattctactcaaataaatactcctaatcccatagaaaacctacgcatacaagtataaagcttatctttttacaattcaaacttcaatcttttcaaatttagaccctatccaaatttaactccacttttcatacgcacacaatccctctgcatatcgaatcttcaccaccacatgcgttactttttagcctaagtatcccgtatgatctcctaatcgtttgatcatcaacttctcccaagttgactcccgatccatcaccggcaacactctcccgaggcattaagacacaactgcacatgaataaacaagaaacatatctgagcacaagtcctttcccaacttaactcaacattagcatataacagtatagcataaattagaattcataaacatgaaataatcacgagtgttcaaagaaacaacccgaaactaactccaatcaggagccagtcgatcagatcgatgggctagccggtcttaccgcaagcatcatactaaaaccctatttttcgtacaatcatgttcattgtattttccccggtctgaccagcatgcatagaccggtcagaccgatcctaactacaaaccaccactccacaaataaaacaccaaatatcaaaaccaatataaatcaaacatctcatgctaattggtcatcacaaaataatagtgaa

SEQ ID NO: 58347 - DNA, 6428 bp, Oryza sativa
aacataaatgtcaaattagatggctttgcttccgcttttcaaaattagctgagctttaataaaatgatagaaatccagttagctcagttggcatctttagtccccgcaaatgaaactaggaggattccggggcaacccgactcctccattgaaaatgtcaaggcgatcacgacgaagggaggtaagtccactcgtgatccgccatatcctaaccctgcaggaacaactgggatatcaaaagaagcgccatctaatgattcggctgacaaggaagttcagccagaaaagatagtgtcgcaggagtactgtgacacacgattgctgcattccgtcaacagagtagaagaccgtcagtggacgagcaatttgctcattttgttgaagtaatccagaaaatccacatcaatgtgccattgttggacgctatgcaggtgccaacatacgcccgttatctaaaggatatactcaacaacaagagactgctcccaataacggaggtggtcaagctgacgaaacaatacagcaacatcatactccacaagctcccggagaagaaatattcggggtgtcccatgatcacctgctcgatcggggcacagcaattcgaccaggtcttgtgcgaccttggagccagcgttagcgtcatgccaaaggacgttttcgacaagctcaacttcatggtgttggcaccaacaccgatgcgcctacaactggctgactcgttagtccgttacccggcagggatagcggaggatgtgccagtcaagatacgggatttcttcatcccggttgatttcgtggtgctgaacatggagtcgggaaaggtgacgccgctcatcctggggcgtccgttccttagcatcgcgggagccaatattgacgtgggaacggggagtatccgattccatatcaatgggaaggagaagaagtttaagttccaaccgaggacggaacaatgctccatggtcagaataaagtacgggccgaacccgcagaatattgaagaggtcgaagtggagccacccaagacggacagcctagtgaaattcatgcagaatttcctggagaaggaaacaacgatgcctaggaaccgttactggaggctaccggtaaaaccaccaataccggctaagaagttagagcagctggctcagaagaagccgccatccccacctaagccaaagaaggtgtggagggagaagccaaagacgcccgctccatcacctccggagacgagtggaaaatccatgaactgaattggaaggaggtacagtcttgcacgtcggactttaaatgacgcgaccttcgccaacaggtaaattggtatgtatccgcatgtttgctttcaacaaatttgaatttttcatcatcacatatttgattttcaaaattgcatttaggacttttgaattttgaggaaattcttcaaatgaatttttcagagcaaaccaaaataaaattttccacgaaatgcactgtgccatgaccacactaaccgttggaatccaacagccgaaagtggggccggttgggcccaccaagggttcggttgaaccggccaggtaacggttccctgccacttttggcagggtaacggctagtgggtcccacatgtcatttttgaccgttgtgggtaccctataagagccagtcggccgagagagggaattccaccccatttcaatacattttcattccctctaaaagtttgctctcaaattcattcaagctttgatagtttccctcaaattcgaatacttagttacatatatacaagttgctttggtgaaactaaccggtaggtgaaatctttgtcattcctaacccccgccgagttagtccgtttttgctccattgtgcagaatgaggaggcgattgtctcgtctgttcaagggatccggctcttcatcaagtcatcatgacgagtctagtactcgttcatcagccgatatcatgatggaagaagccgaagcttcacgacaactcctgaacccgctgaccttgaccttgtcggtgatcgggagagacaagcctactacatgctggccgaccgggagtatgctcacacgcgagagtactcactggagttgctgaaaaagataggtatggatactgaatttcgttctatttggaaagctgttggttggcagaaatttgctgtggtatatgagcctggttctcatttgcttactttgcaatttctgtgcactttgaaagaaatggaagatggaatttccttttgctttttccatgaggagtttacacttacatggaaaggcctaagcacacttcttggttttcacgatacctgtaaaatcgatctccagaaaggaatttctgggttcgagaaaaataggttttgggaagatatttctggtgctccaatttgcaagaaacctaggacgaatgatatctataatcctacacttaggctcatgcacaaatggattgctatgactctatttcctagaggtgatctgagacccataaggggagatgaactaattatcatgtttgccatagttagaaaaatcaaaattgctcctgtaaaatgtatgatacggcaatggttagaaagtatcaagttcttttctcctgttgagtgcacttctctgattactcggatagcaaaagtgctaggggtcgttagcgaccaaattgcttttgtctcagccgctcgtccgcgtattgatgaagtttatctagtgcaagggcatatcttgaaacatggagtagatggatctttaatttactttttcccctgttgtacaaatgaaatcccattgccaaatgcggggtatcatttgtacaactgtcgtgaactaaccatacctctgcagaccatagaagaatctcgtgcaggtggaatatacagggagacgcgcaacatgacaagaaatgaacgagaaagttcatcatcctcaacactcgtgcagatgcatgaggcaggttgggcaccaactggggatgcacctggatagacctaagctccacgccacagcatcggagtctcaggctgggcaagtgctagtgaggaccgatggcgtgcgcctcatgacatacattggggggacaaccaaccctccagatcaagtggtgtgtctccatctccaagtgaatggcgctcaagttcctctcgttgggacttgggtgaaatcactaggagattggacacccttgatgtgcagacgacggagatccagtacaacctctcggaacacatagcacaaacacaagaatggcaacaatctgttgatgctcagttcgccaacatcaacaacatgatgcagcaatagcacgatgaccttcaagcatactttcgctttcaagagttcaatccttatcaaggaccctgagcgaaagcctagcttggggggagagacatctctccccgcactgaggtaacttgtatcacattgcatatttccctttccaattgtatatttccctttccaattgcatattttctttccaactacatcttataaaatttgaaaacaacataaaaatttgccaaatagaaaataccaaaaagaatggataggtttgcgtcatgttaggtaagacaagctagttatctttgttgaaatgatgaatagttgctctgctttatatctcttacatatgggttcttcgtaaatactctctcaaagattaaatataagtagccaacaattatccgggaacctaaggtaaatgagctgcacttgctgatctaagtctaagatgttgcgagatatgagatagtaaatatgagttgctacgatcctgatactagtttgacttgaattccggatgttttgtttttcaaaatgataaaactgaaagttcctcatttgataaaaattcctaccagagccaaaaatgtgctatcttgatgaaaccatttacattttggttatttgccattccactgaactttgtcaaactcttgtgacttgtgtagatacttctcatgctctatgatcaagatcatacacccacatatgtgcacgtgctaaactccaacactgggagctaagcaatgttccattccatttccatattaccaccaaaataaattctccatgctttcatgtgctttcttctcctaaaaagaaaaatccttttgaaaaaaagggaaaagaagaggatggaaaggcatggttaaaaaaaaggggttatgctccatcaaacatgagcatgatgttgaaaaaaaaatgtaatcatgccctctcctaatcaataaaagaaggatttttgggagaagaaagtaagcacaaaggagaagcattttctttatttttcttcatacaccatttccactatatatcacacactttgcacgatcttgatcttgagtatgttcagttatctgctttagtctaagtttttgacttagtaataaatgtgaatgcaagtatatcatgtttgatccctaccgaactccacatatcaaagccttagagaaggaatcaaaaaggcaataattggtgaggaattcatttttgatacacttggagagactgagtgaatcatttaacaaacttggttatctttttcaaaatcatttgaaaactttcggaataagagttggatgaatattgggtgaatggtgctctaattgttgttctgtctttcaactacccaaggcaaggagaagtagtgtcttgtgggaatcaggggtaaggataagccaccgtgccaaagattatttaatctgagagagagtacatgtaccttgcacctatatctttgagatatgcagcatagtagcaactcctgatcaacaaccaagtctttgtttcctttcgtcctttactcgggacgagcaatggttcaagcttggggggttttgttgacggtcgttatcgatcagtttcgaccgtcaatactaccaaaataggagagaactagtgatgcttacaatgcataaattttttagagtaataatattccactagtattaggtatactaacctttttgtagagaatgacaataacgtggaggagaatcgacatcaatgcaaacgataaatcaataggacgatatcgagaaccagacttatgaataaatgggccaagaactcagaactaacacgacaaactgggccaaaattcacaagtctgcaaagaagaacaacggaggagaccgcgagctgaaattgggctggattgggccggcccaggttcggccgaacctggtggttcggccgaaccaccctcgcctccgttggatctaagttttggctggacggttgagatgaagctccaatgacggttggagggtattgccaaccattccaaccgtcacaaccgtcattacctgcctatataaggacttcacctcctcacttcacatacacacctcaagcaattaactctcttatttctctcaagtttagtttagtagcatctagctggtagaatagaaatagagtagaaatcggagtctggaagccttcggagcagtttgggtatggctctagcagcttttctcttatcttttgtaagctttgtcctattattagaatactcttctaaatacatttatggtattgaaatactttccgagtatatgagtacctactttacattatgtttttgttatactgaatatatggctagcttatctgggagatgctttggtgcaggtataatgtttgcttgtgcaattactctatgtcatgacgatgatattagagtagtatttggtagtttagacgtggtgtctagactacgggatatcattatttggggttatatattgcggatgagaggtgggccgctgatggtgatagctcagtacgggtattcctccttgcctatatataatcctaggttaattccttggggagggtattcctccgtatttagccccagttgtatggtcatgacgggctgtcctaaggaactcggcaatcaggggtggcttctcgaagtaccaggagggcatcagaaagagggtattacctagtatatcggttaactaggatgtatgtatactatatatattagaagtgtaggaatagattatctttctcttttcttcccacctagcttagataatatattatgagattgaatagttaatgcttgtgtgtcactctaccctagaattatcttaacccctgcttagaatatgattatcacaagcaatgtataaattattagtccagttctctctacatgatcttcccacgggataaaataaatacgatacccttgtgtggatgcgaaaaagacaaactggcctgagagatctgttcatctccagtgcaggtccaaagtttgatgagatgcgggcgtgccagttagtttgatcctgcaactaacaagatatgtaaaccgtagattaaatagccgatcggctgacaaggcgatggagtagttccagccgatgccaataatagccgatgccgatactagccgatagcgataggatttaa

SEQ ID NO: 58348 - DNA, 757 bp, Oryza sativa
tcgacaccgttgatagtaccaaggtgatgcccgccagctgttcgacggttggccttgatgtcaagggtggcgcagaccataccagggtcacgtgtcggaccatgatgggtgtgcccgagggcgttctagtacctgatgcatcatccaaagtcttctcgccatggttgatggctgaaatggatcttattccattgctgcccactgggtgttcgatgaaatgtcccaaagacaagaagctgctaatggggaatgctaagagaaattcatggccaccttcttggttgggtggagtgattagacgatgggagttgcaacctttgcattggccaggatccaaattatatttggaaggtttaccattgatgcccccatggccaccaccggctggagtaagcttcctggcatgggagccttttgatattggagttttagtcattggaaccgtgattttaacacaggagatggctgggttgaaaccatggcctccaccaagtctagtaagttctttggcatgggggatggagggaagagaggtctatggtcttgcaatgcaggggcatcatatgaatagccaatctatggaacttgctcgtattatatctaaagaacttgctcgtattatgaaggaaagacagttgagcaacaaagagctgcaatgtatatttgaaggtgcaagtcctgggaagatgtgtattaacccaaaagcattaattcatgatggatctttgaggtcattgctatccaagctacaagttaa

SEQ ID NO: 58349 - DNA, 668 bp, Oryza sativa
tggtgtatgtctttgggagatctagacctttactgttcttaaaaaaaaaatctctagtgtagtactagctactgttcgtcccttcgcatatccatgcacacttaacagttgaaatgtccttttgtataattaattgaaatgtccttttgtcagttgttaagggactgaaatttttaaacagatatattcatctatctggcacaatacagtgacgcatatcgggggtgtttggatggggctaaaaatttttcagtacacgtcatatcggatgtttgatactaattagaagtattaaatatagtctactgacaaaacctatttcataactctggactaattcgcaagatgaatctattgagcataattaatccatgattagcccgcgtgatgctacagtaaacattctctaattataaattaattaggcttaaaaaaattgtctcgcgaattagctctcatttatgtaattagttttgcatgtagtctatgtctattactctaaattaattatcaaacatccgataggacagggacagtttagtccatgatccaagtaccaccgggggtgtctggatgatgacaacatacagagtatatgtaagacaccgctagcgcttaccgctttggcgcacctcccctgcagttgcacagcatgcccatgaagcccg

SEQ ID NO: 58350 - DNA, 1465 bp, Oryza sativa
tgctttcccccaatgagacagctttccctcacacagcagacaagaaactacctatgggtaaccttcacacctatcatctagttactgccagtagtagtgccaagactcggaatcatactagttcaggtattctcataagaacaaatgcctgtatggtaggctcacataaatggcttatgaagtgaagtcctcaattgatagggcaacttaccaaactacaatagcacacgacattggtagtatcatatatttataattaaggacacacagttgtcactttgagcaactaaatagcacacagcttgacagtaggctcacacatataccatacccggtaatgatcacataggtacattaccaccgaacccaggttcacacataaccacccatcaccctgatccaaaacgttttatccgcccgttgtttattacacaacaacacgtgctatcgaaaagatagtacacagtcacacggttcatatacaaataattataaatatatgattaatcaaaattatattttgcttcaaaacaaccttgagcagagctaagcataactactctaccttgaaatgagcccaatgttcaactcagaaaaactaggatgacaaggtatcataggtaatcaataattataaaaggcaaggtataatagcaattaggtcaccctacccatcgatagcatataaataaaagaatgcatgtgttcaaaaaaatatttataaattgggtccaatatgttcacttgccttcctccaagtatcattcctgcattgtgccttctgcagcgaaccactcctctactccaacgtctacacaatcacaaacgaaaaacaaataaacaaaagaaaagactaactaaataacatcaaataaaataaaccaatgaaccaggaatttgagctcgattttacaagaatttagtaggggtaaaaatggagcggattcggatggatagtggtattttaagcggattcagagtggatgcggatgtagaacggattgttttggatgtcggaattggtgtggactcagttcggaaactgattaaatttgtcagatgctatgtgtgtatgcaagcaatacaccattgagttagcaatgcaaaggacaacaacgcaataatcaatgaacggaccatcgtaataattatgtacttaagtactaaataacatgaatacatgatatccacaatataaaaaacaactaagcaagtgttagttagacggtgaaagccctggactaacgaatctaggttaattgatgaattgggccattagatgtgccaactcatgttatatgcaacagattgaatggttacataagttgataatttcggattatgcggcaaatagcctatcggatagtccgcatctgttgtattttagagatatcttgtccgcatctgcatccatatccatcggatttctaaaaactcataccatatcatcgtttcagatggattc

SEQ ID NO: 58351 - DNA, 9448 bp, Oryza sativa
acgccgacgtagatgacagattcaccagggcccgacggaacataggacttaccccttcgcaggagatcaaaagccgatgcagccccgcgtcaggtgccaagttccaccggaagacaagtaaaaacctcggtaaagagggtggcgatgcgccgagagtagttgtattgatcaatagattgatagattacatagaccccgggtgtacatatttatacccatgagttgatacaagtccttatcggacactaaacatactttcctaaagataaaaggaaactaacaaactattcctaattaatagataaactgtcataccgcatcctccttgaacttggactcttctaaataagcttccttcgattgatccgactccaccaagaacacgatagcatggcgacttgacgactcccatcggctgtttctagaactctaaaaccgatattgactttcagccgatgatgactttgggcttaccaaatttcgtcgttaacacatgccccccagtttagagtatgagtactcatgcttcaaaattatcttctgtctggtcttgataactccaaaactgatcttcatttgcgtcttgcaatcggctttcgtgagctgatactgtttgcattagatgagctagactgtcaaacccgtggcaaaagaatctatctctgattggtgctgacaatccttggaatgcaagatctgctagttgctcatcacttaggttcaaactataacattggctgcggacattatgaaatctcttaatatattccatagccgattctccctcttgctgctcaacggatattaaatctgcaagcttcaactcactgattccagcaaagaagtaatcatgaaattgcttctcaagatcggcccatccttggatagaatctgatggtagcgatgaaaaccatgtgaaagccgatccagtcaaagacaatggaaaaaatctaactttcaaagcttctttagctgatgcctccccacattgtgctaagaatcggctgatgtgttccattgtagatgtatcatcctgccctgaaaacttggagaaatctggaactttgtatcggtgcggcaatggcaccctatcaaaccactcaagatatggcagccgatacacagaagtatgttccttaggtttgattccaaactgctcctctattatctttgcaattctatcggccgaatcattgttatattgatattcttcatcatgcccatattgacaaagttcttctggccgatattgatatgcttgccccccgagctgattcttttgagtaactattttaggaactatcttcttgatcacatcttgtagtgtactcatcaaaactccagactgatcaaacaatgtgcgatgaactgcttcatcaactgtatcttgaagtatttcaactatcggcttggggaatcgagtcttctgaattggcccttctggtgtcatgatgaaacattgaagacaacgcatttgaaaatcagttaaaaactgctccatctgttgcctctgttcgtccgctaaattctccaccgtgaccatgatcttggcattgacttcttcttcagacatgtggatataaaatccgtggtcccaccaggcgtgccaaaaatgtgttgatgcgaaaaacacacactggcctgggacatctgcttagctccagtgcaggtccaaaggttgatgaggtgcgggcatgccagtcagtttgatcctgcaactgacaagatatgtaaaccgtagatcaaatagccgatcggttgacaagccgatggagtagttccagccgatgcaaataatagccgatgccgataccagccaatagcgatagggtttaagcaatcggctatatgtccaatatagataatgatagaaatgcaatcggctaatgatgatgtaataaaataacaatataatctagtataaaccaatcggctagcaatacaatatgatagaataagcattgatccgaaggttaaagcatacatcgactgaaggtccgatgtcataaaatccaaaagattagtttaaacagtgaaacctttgttgcaatcggctaaacccaacttgtatgtaatccttataagccgatgcaacgtccagataacttatcggctagcaccccgataaaacattagcatgaacctatcggcttagcaagacttatattatcaacaacaatctagtaggtcgaacctaaccgatacagcacgagattgtatatgataatctaatacttgatgagccgatagatctgtctaatgtgatggatataacaaatctatttagaacaacattgtaattatagagatatatcggctaaggtagaagatccgacctaaccgagacaattccaactaaaccgatgtgtctctaaacacaatgcaattagagatagaattgagatatcaggtaggcaaatcaatcaaccaaaccagagagatccaagaagtcgtagcgatgcagccgtgaacgacgccgacgtagatgacagattcaccagggcccaatggaatgtaggacttaccccttcgccggagatcgaaagccgatgcagccccgtgtcaggtgccaatttccgccggaagataagtaaaaacctcggtaaagagggtggcgatgcaccgagagtagttgtattgatcgatagattgatatattacatagaccccgggtgtacatatttatacccatgagttgatacaagtccttatcggacactaaacacactttcctaaagataaaaggaaactaacaaactattcctaattaatagataaactgccatgccgcatcctccttgaactcggactcttctagataagtttccttcgattgatccgactccaccaagaacacgatagcatggcgacttgacgactcccatcggctgtttctagaactctgaaaccgatattgactttcagccgatgatgactttgggcttaccaaatttcgtcgttaacaccttggaatactctcgggtgaaatgctacaatagtatatcagtgcgctcgtggatgaactctgcaaccataatataccagaaatatttctgcgcctttgctgggaattatatttctagtaatgtcgttatgaaataccaacagccggccgcttcctgcgtccactcggagaacgcgaacgctgttccgccatcacccagggcgccctccgcacgcgcgccaaggtcactaagcaccaaccaaagggtatagcaggcttgtttggtggattccgtcaccggcgcaaggacctcagcagcagcttcggatgaggcaagtcgagcctcaagagaccggatcttctcctcggccgcagcaagccgaagttcttgatcaacggacttcttgttcacccccttcaggttagcgtgaagagatttattctcccctatgagggatttgctctgcgctttcgccttcttcagggcgtccgccacgaccctacgttcgtcatctttatggcgaaggtcttcttcggccttccgaaggcagaatctataccagtcaagccgctccatagcagaccgcttcccgctcaagtgcgctgcgagaccctagatttagaaaattgaaaaccctgttagtacggctcgacggaagtgcaggacaggcgaaagtgagaaaagcccttacccgaaggaacaaactttccgcggcttaacaactctcgccaaactcgttgagttcgataaagagattgaggccgtcggacggcgcaatgatctggcaaaccccatcgacgaagggggcgatctccgatcgggtggtgaggtccgcagaaacaaagtgcggggcagtgagtgtcacatcagacacaatcatttcaaccgcttgggcttccccctgtcgcccccggagatgttcgccccaactgccggtgccgaagcacttccccctgtcggtgcttcggcgtcgctagcaggcgggggcgacagacgtttcccccatgggggaacgcgccactgggccggcgaagtgggcgtcccatcagtctcctcactatccaaaaaaccgcgagcaacctgcaccacccccttcttctccttcttcctagcgatcgctcctggtttcgctgcagagctagagatcgccagaagattgtttgcgccaacaacgtcttgcggacgcacaggcgaaacgtgggagcctgccccacacttcggccgagtcggactgggggtatagccgtgtgacccgtcatcctcgtcagacctggtgtaacatacccgaattctaggtcttaaaaatttcttgtcaaaatagttagaaactaacttttccaatgttgagagacaaaaattttcactttaacctaggtgaggtcaacttaacttgtacttagataaaatttgaggacaaactaaaaacttttcattttcagcctaggacaaaaatgcaaacaaaaatgtgtgcatgcatatgcatttagcattagtttgatttgagtcttttatgcgcgtttggattttggtttgcatatcatgttaggttcatgaacataaataaaaggataacttcactagacaaacccatggtcattattgtgaaataattataagtacatgaaagtgaagtcaaataataacaactcagttcaagtcaagtcctaatataagtctttacaaacatttagatgcatttatataatgagaacacttatataaataaacgtcttgcgaattattgaaaataattcgtgcaaggtaaaatcatggaaaaattcatgtagtctgtaatcaacacgtacaattcactgtaattttggtcaaattttaatacttaggatgatacctcaaataaatcagtcaaaccaattaaatgatagactaattataatccttaatcggctaaaacctactctcaccataatgtgcatgaaactgcatagaagtgtataggggaaacaatttattcaaatactaggttatttataatgaataaatatattttttcagaatttatatactctatttaaatctcctaaaaattcaaacaaagttctaacgagcccattttctccaattttctgagggcaaaccacataaaatttttgagagcaactacagaaaatggaaactaggtatcttcatctacgtccagaaaattccacatgaatttatcgtgcccacaaattaaactatagattaacaagagaggagagagatttaaatcctgaaaatcgtccaaaatcgataacacccaatctcctaccctcctctctcactccagacttgttcccttcgcccttgacccactttcagcctcacaagctcgctccacctgagtacatgatgccctatgttaggtactctaacgatttctccctcaaatttactggacaattgttcacgcatacaagtatcgatccacaggatcgttctgccgccgcctacgccaccacgtatccagttaatcaccttctaacatccacctatgttttttatatacagttaggacaacaccacacggctctccctctctcacatgacagcttggctacttggcccactgattgccgaagtagcgtgggttgggcctccgacgtcttgggccgatgcttggcgccgtttcctgtatcggcacgatcccctcctcgcctccagcatcttgttctgcttctccagcgccttgtccctcctcctggattccttccaccgtgccatcgtcttgttcatcagcggtttgatcggcagtcttcccgtccagttcatgatcgtcaggcttcctgtggttgtggcagtcttgagtcttcagaggaggcctgacaagcccccatgcttggaaatcggcttgcccccaagccggtgcatgagggaaccttgagtgaagatcttgcatatcctcccatgtggcgtcagtagctgctcccatgtggcgtcagtagctgcacttcctgtccaatgagttagtaactgaataatgggacagtttttggtgtgagatacgcgatagtgaagaaactgctggggaacttgaaatttggaaagagcagtaggaagttcagcttgcataggacaagaaaatccccgagcccccttcaattgagaaacatgaagcaccggatggatctgactagctgctggcagaagcaacttgtaagcaacagcgccaacccggtgcagtatctggtaagggccatagtagcgaaacgccaacttgtgattagccctgacagccactgaagactgaacatatggttgtagtttaagataaacccagtctccaacttggaattccctgaagcttctctttttgtcagccatgtgtttcatttgctgttgagctcggttcaaatgatgctgcaagagttgctgcataagcttcctctgttggaaccactgattcagatcaggaatggagcagtcattcagactaatgccaaaatgcccaggacagtacccatatagaacttcaaaaggagttttgttcaacgcagagtggtaggttgtattgtaccagaactctgctaagtaaagccaggatgaccacttggtgggagtagcatgaacaaagcaccccaaataaatttccagacattgtttaaccctctcggtctgacaatcagtttgtgggtgataggccgagctcatatgcaattttgtaccagatctcacaaagagttgctcctagaattggctagtaaaaatcttgtctcgatcagaaatgatgatttggggcagaccatgaagtttgtacacatgtttcataaattcaagtgctacactgctagcagtgaaagggtgagacaatgggaagaaatgagcatattttgaaaacttatcctctatcaccaatatgcagttctaatgatttgatttaggtagcccctcaataaaatccaaagaaatagtttgccacgctccagcagttacaggtaagggttcaagcaaacctggatacttggctcgatctggtttggcttgcaaacaaatttgacagttttgcaccctggactgtaccttctttttcattcctgtccaagcaaataaactcttaacccgctggtaagttgctggaaatcctgaatggcctcccattggtgagtcatgaagagcatcaatcaacttatcctgcaattctgttagatcccccacccaaatacgtcccttatatttaatgactccttgttggagagtaaagtgaggtcgagctgtagggcagatagcaagctcaatgagtagctggatggcatgagcatccttgttataactctggatgatttcctgcatccaagttggtacacattcagatacagaatttagctcagctgagtcttctttcctagaaagtgcatctgctgctgagttagtgactcccttcctatagcagatttgatactgtaagcccagcaatttagaatatgctttctgctgccaaggcgtgtgcagcctctgttcattcaagtgtttgagactatagtggtcagttaatataatgaattccacctctgaaaaagcggattccaatccccgatccggaatttcacggccaaatcaagagaatggaaggaaatctgagtggaattgtggttctgataccaggtgttaggtactctaacgatttctccctcaaattaactggacaattgttcacgcatacaagtatcaatccacaggatcgttccgccgccgcctacgccaccgcgtatccagttaatcgccttctaacatccacctatgtttctttatatacagttaggacaacactacacggctctccctctctcacatgacagcttggctacctggcccactgattgctgaagtagcgtgggttgggcctccgacgtcttgggccgatgcttggcgccgtctcctatagctttgttcggcatgatcccctccttgcctccagcatcttgttttgcttctccagcgccttgtccctcctcctggattccttccgccgtgccatcgtcttgttcatcagcggtttgatcggcagtcttcccttccagttcatgatcgtcaggcttcctgtcgttgtggcagtcttgagtcttcagaggaggcctcacaccctactgctccagccatccgagagggagaccgagagcgagagaaaacggagccgaccgtggtctggacagcaccgacgcgtgtcccagctcgcctactcctttcccagcatcgccgtctcccatcactctccactccactgccaaggaaccaaagctgagagctccatctcgccctcctcgccttcctctccatcgtcggccaccgggaaggacgcgttgccgttcgtcgtcgagctgcgcttgccgtcatatcctccatgttccttatttatctcatcataccgaaggttttaccttttgaccttaccctctctcgtgcagcggatcattgggaacgccatcgtgcccacgggagctgcagagcgcgcccggagcgccgccgccacgacctcgtcgctgtcccggcttctgtggagcgaatccggccgagctgtcgcgccaacatcttcccctcgaggtcctctccaaatgccctcaggaatccccaagatccgagcttcgaggagagagatcgagctattcttctccaactccggccgccgagctccatctttaattcctctttcaccggtgagccccaagtcgattccgtgaacacatagatttcctaggacctctttaacatgggagacatgcatgcatggcagttcttgtagtaagtcaagccgacgccgttcatccgagaaggagcgccgtcgccgagccgttccgaacgccgtcgtcggcgacaaagcttcgccaacctcgtacaatactactgtgagcaccctggagcttctagagttgcatgcatgcattttatccacctagatccggcctctaacgtgacatgcatcactaccccgagacccaccgccgctcgtgccgccgtcgccattgattccggtaaccacagatcaccataagacaatcattggattcgaaaagaacccctcttccttttctcttttggtttcatgccgagatcttccaccgttcgctgccggcaagctcgagaacgagctcagccatggctagctctgtttcagctcaaaccagggacctctgtggagaagaaacaaaactctaggtactacgttctaaaaactacctcacacatagaacagtcataggactgcggattgattgcctgaaaatccagggacctttttgcatattgatatctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagtaggatgaactttaatatggaaacataaaacttggcacttgcagtataaatttcacctctaaaatttatctaagaaaaaactatacataaagcatgcagggct

SEQ ID NO: 58352 - DNA, 5721 bp, Oryza sativa
caatatagattagatagatagtttaagtctatagcaaaacactagagttgagtcatcgtatagcttctactgtaatagttagccacaagtttgtaaataccctatcattttatgtaaaggaatctcctttaaaaccttgatcaaatgtatgcaatgaagatccagatcgttgaacctgtatcaatctactgatccaggtcttgatacagtctaaacatgtcggttttcgaatcattagttttgggacccgacaataaagcactgtcaagtagacttggaggaattcttctgggtcggtgctcccatcatacttttcaatagctccgggtcggaatctctcaggccatcggacatcacgtagggaacgaccgaaagccctgcacccagcgcttggagcggcgggttgtcggcggtcgcgtgaccttcgtggatcttggtctgacgatgaagaggactcggatgatgatgatgatgacgatgggtcgcttggttccggcgtacgattacgagggtgacgacctggatctcgggaatcttgtcttcgtctctcgctgttgtctcgacgccgatcttcttcatcttcgtcattacggcgacggccatgaccaatgctgtccggcccccgccggtcgcgatcgtcgtagtctcggtcctcgtttggacgacttcttcgatcatggtgtcgtgaggagacatgacgccgggagtggttcacgtcatcccgtgctcgccgtgcttctcgacgaccattgatttgatctcgaagatcgccagtaccacgaggtggaggggtagcttgtcgaggtgattctctccgttctagaatttcaccgttagcatcgccgacgggagatcggttttgttgggctgcggtggcggcttcttcgaacgcgttgctgaggttagtcaccgatgcccgtagttgttccgtccaacgctcgaggtcgtcgtttagaacaggatcgtaaggtgtttccctcagtatggcctaaacagccctgatgtgttgggctggggtagtcgattgattcgccgtctccgcgttggcttgtgctgacgtgccaacgccatcgatagccaacacctcccgcgccgcgtctgatatcgatgaccccaacgaatcgatctggggccggagtcgctccttgttccttgccgttatccctgacggggacgtatgacttaggagacggagttttcatagcgccgagtagaactttgcaactcgagaggtcgtgattctttgtcttatgaataggacaatagacgtcccgagttggagaagtacgttgaattccacgttctttgcaggcgcggatttcagcatggacgttgatgaatacccagcaatcttgaagagtatgtttcttggttttatggataggacaccaagacctggtagtttcggaagtcatctttgttggcccgtgattttcgtcggggggacaaggcttggccgcatcagaatccttcacgagtttgggtgtagtcggtaatccgttctctgtttcaacgggtggatttttcgacatgtaggcgtctcggttcgtagccactgcgttctcgttgccagttattgggggcccggttgagatcggcatagtggtgtaaaccgggtagacgatttcgccgacttgagtccataccagcattgttgaagtaggaagaacttcaccgaagctggtgttggcattgttgtcatcgaagcttcatggcatagtagtagaaccttgaataccaggcccccctacctggcgcgccactgtcgacgggggatacccgtagaccggatatagagggtattggggtacgctggtataaggatctacgtagtatgacatcgagcaattaaaagacaagaattatactggttcaggccccttgataggtaatagccctaatccagttgatatgggattatatggtggaaaacacagattacaaaggaaaagacggaactcaggggatttggcgagattgtagtcgagatgattcgactagctctcgtcgacttggctccttgcaggctccgacttcgtaggctgtgtggggtgtgttggctctgagattcgatgatctatgccctccccggggggtcccttttataccgtaggttgggtgctctccgagtaggactcgaacataccagacctggcacgatacgtaggtaacccaattcttgtccgaggaggtctctcttcgtccattgactttacgaagagtttccttagacgccaaaggatttatccatgcacatgtgaataggccttgtcaatatgtgacgtatgtcgaggggtagagggtatgcctgactcgtaaccctgatagtagcccccgacttttgctcaaaaatgaactcgcgcgactgtttgcgatttcaggtgtcgagaacgttgtcattccaggtgcgagaaccacgcagatgacgtgtagtcgagcacaccgtttgaagcccaacggtcacgagtgaattttgaactgaagtccaaaaaccgccatgcacaacggacctagaaatctccgacggagatttctcttatttccttggaattcgcaccgtcaggagtgcgcttatttaaagggattttgggtgtgagttttgaggtccgcctacttcaccaagcaaacactgctcattagtgctcctcgccttcttcgccaccgcaaagaaccctaacctcgccaatccttgtccgtctccggcgatcctccagcggcgatggatcttggcaagtcaacttccaccaccgcgaccctgaagaagctccaggaggagggcgccctccctggccgcgacaaggcggagagggaagcaggaggtactaatccacagcccctcttaggtcgcatggttgcgatcgaagattacattgtctgcggatttcttcctcccccctctgaattccttgtactagtcttgaatttctatgggctttcacttttgcacttgaatcccaactccattgctttccttagcgtttttgtgcatctttgtgaggcctacattggggtagagccctttctcgatctgtttcgcttctattatgagttgcgctggatgaaatccaataaggtgtctggctgtgtcgggttccgacttcgagatggtatgaagttgcgctatgtccccttccagtgtccctcttctcgcagcaaatggcggaacagatggttctatcttgaaatcaaagatttgaatcctgtcctcgttgttcctgaggagcaaccggacaagattccggtttggaccgccaagccccctttgaccccctctctgcaatcgtttatcgacatcatcgatgatctccgagaacggggcttatcgggatatgaagttgttgcagacttcgtcggtaggcggatccagccgctccaggctcgggcccacccggcatataactattccgggccagatgacgcgacccgggtttctcctcggggtatccttctcgtattcactttgatacatttgtattcacgttccatttgacttatcaagaattgattctttcttgacaggtctgagcagtgaagtcatggagcggtgcgctggtcaagtgatgatcagcgacccatcagcgacgagcaacattccaaaacccctctgcgataaggatgcggcggaacgcgatgaagcaatcaatgtgagtttatttgaatgtctttttccttccctgtttgaaatcagcttatgatcggacttagcgtagccccttcccttgactgacgtcgtcggaccactcgcggatcatcaagtggcggcttccctgaaggagaaggtcgtcgaggaggcgtccgacattgccaccggtagtggtggcaaggctccgaccaagccgaggaaattctcgtctgtgctcggacatcgccgcaaagcggagacttcctcggtaactttcaccttgtcattatgctaagtagtgaggaaggtttctgacgcgtctcctccacctgcgcgtcgtcaacgcattgtgacgatccgcgagaagtaagtcaggggacttttagattctcatgtcttctatttgagtggaattttgatctgctgaagctgatagggaggcgcgtgttggcaactttttgtgacaagtcgacaagcacgatcgcagcacctaaacgccttgcggtgatcctagagtcgccaaccacctcgatctagctaaagggccaaatcaagatgggttttgttgaaaaacagctaaaccagctagcagagccgatttagagataaaatcagcctctaggccaatttagatcaatatgaggataactacccgtctcgtgggcaaaacggaaggttttcaggacaaacctacaaagaggtgtcgcactcttgcagcggcggcggacggtttacggcgcaaaccgacaaagatggactaaactagggtaaaatagaaaacatagtaaaagaacgattcaagtagattgtattcgggggttttacaatgaaccggccttgtcccttatataggggttggtcttgccctctacaggcccttctccacgtccaactcgggatagaaactaaaggaaacacgaaacatgccttcccgagcaaggaaacccgagacccgacgaaaatagagtcggactcggaccctgacagtttgaccgcccacatacctgcggtcagaccggccctactagccggtcagaccgcccacatacctgtggtctgaccggccctagcgaaggaaacccggcactttccaaactttggcaatttttccctatttcgttcataggtgccaaatttggatgtaaacacatgcccccgtgcctttttggtgaacatacgtgaacctaaaagcatagaacatgttatctcagggcgataatccaattaccggccataggacttcctaagcatcttaccaaatgctcgggaagtatttcttcaagcatctcccattaattgctctctaaaaacaccgtcttgaagtgtcttcatctccttcaaagtcttcaaacacttgtcgatgacgtcttcaaaattgcttctcatcaaggtcttgtaatcttcaatcgacaagtcgtcttgcttaaaataccgaagaaagccaagatttatctcaactggcaaaacgccaatttcaacaatgttttattactcgattcggcttatccattagcccgagcgtagtagagggaaggactcaacaacttaatatcataaaattcggcaaaacttctcatctccttagacataaaagaagctcctttaatgtttgaggaataccgaatctatgaacgatatgcttcgaaataaagccaattacctccgtgtaattaatattttcgaacggcatggcttcggcctacttagtgaagtaatccgttacatctagcatgaaccgatgcccgtttgatgacgaaggataaatttgaccaatgaaatccaaagcccaacttcggaacggccatattttaatgataggattcaacacagcggtaggagctaattgaacattgccgatccgctaacaagctcactccctctatagaatttgaaacaatcataaattattttcggccaatgaaaccccactctcgtaagcaaccaatttatcttacgggccgattgatgaattccacaaatcccttcatgtactactctcctagcaactttagattgatcattatctaagtaatactccatctatttttcggcgatataatatttgaacgcttgccgccgaatcttccgatcaaccttaa

SEQ ID NO: 58353 - DNA, 15798 bp, Oryza sativa
aaaattcatattacttcctttttgagtaaactcaagttctgtagaatcatcaagtctaggacttcaaagatataaaataaaaatatacacttacagtgcaataaaatcccctaaatatttataaaaggaataaacaacttagagcacccttcaacttgtaaaatttctagagaattcatctttagtctaaatgtaatgaaccaagtttctatagaaccagcaagtaatgaacattaattaggtaaaataaaatgtggaaccttctatactaaatatgtcactaaactttaaatagataacttaagtgctagtcacatggtatatattggctaagcaatacatatgtataaataggcaatccatatgtataaatgtatatataaatgcactctagctctaactaaccaaaataaaacttgatggaccagagaggtcatagttccatccctaaccaccaaaaacttagcacacttagctcatatatcaatttctaggttggtatgttaagtaactaacatagaacgctcccctagcttataaaatgtgtagtagcgtaatataatctctaaaattgtgaactaagattatattggttaataaaattagtcattttatacatctcaaacaatatgaaacatgtcctggacataaaactccgaaaccatgtacacatagaagctatatacctacaacacattataacttgtaaaacacataagaaattcataataactccaaaagttgtgaaaccaaatgttttagtcttagaaaacacatctctacatccctgatatgttaaacctaataagaatcagttcgcaaaaatatttcataacactactaagtgaataccaccctataccgagtaaacttctgaaattcataactcacaaataaaaagagataaaatagaaattctttcacctaaactcatcttataccagtacctacccactgtgcacaaatcatgcattttagagcattttggatttttacctatttccgtgcataaacggtgaagaagtgaattaggtgctaacatttcccaggaacaaggcaagttttctcctcccaatctttgatcacattgaatcccatgttttgaggaatgaaaatatttgtttgcaaagttgcatatgaatttagactataacggtatttgaaacttggttatggtagctatgacctaattgctgcatttacttccttgaataattgtgatcctcactgattgtaaccttagaaatggttagagtactttcaaagtgcttaaatgggtttatacatgcttacttaatagccatacgcttagccatgcctagtagttgctaaataacttcatgatcactttttaaatgagaatttggggaatattttcactgctggatagaggtgaatatctctgatatttgtgagctaaaatgtgtaaaaatgtgatgttagacctgggcggcaagtggtatgcatatggtgttagttgcataccgatagggggagtgctcgccctagtcaattaaggaccgaactttgtgtcaccatctaaagtataccgtgcaaccacatgtgctaggaatgggacggcattagcttattaaattgtttaatgtctaaccttgcattgggaggccgtagtagtatgaactagtcggaatgatggtttataggagctacctagtgcggttgtgcctaggcgtctaagcgtgtccaatataacggttaagtgcctcgtggaggaacggatgtgttcgctgccatggcgctagggatggcgagggccccccgacctagcggcacttgggttgctcctcgtgtggataaacacttgccgtgctcgtgcaaggttaggcattaggcaatgtaaaggcttcgttatgacctctagaccacattcaacgtgaagaatgtggtagagtcttgcaaactcaaaacaaactagagtgtttatatcatgtgggtaaagctgtacaaactctgcagagttctttaaaactaatcgattagccgtgctcacggtcatgagcgctttggtgatgtgtcatgagtatagtcttgtgttttaaaattgtgtttatgaaacttgggattgaaatggaagaattgtgttgagttgtgcgagtgatgatgattataagacttgttgctatggaagacaacaagagtatgcttatgatgatatgatgttaattatgatgaacttacaaatttgttttgttaattgaatcattaactcctttgcaaaagatttgtgaaccaagtcggtgtgcttgtggttgggtagtcaagcttctgctgttctctgttatctatctatatttggccggtcggcatatgtaactataaagtagttgtaaatttgaatcgctttcatcttatttgtatttgctatgcataacaatgcttaagatgaaaatgtgaatctagtgcacatcttgggaactagattcacatgaatatgagttaaggatatttgatatatcatagatctttagccattttgtcaagtcacctgaatatgtaacacatctggtcgctgccttcgtgtggtttgacgggcacatctcaggctgaagttgactggcaggctaaaggcccggcaatgtctctagtatccttctctcgaggcgtcggatgtttcattatgtttgtttgatgacttgaattattcacttcatacctcaaatataatgagaggtccggagagcctacgacacctggcctccctatcgtcatcatcatcatcctcatcagcatcggtttcggccgcgtcctacgcagcacgacgagttcgcacctggccgctcttcgcgacggctcgcttgtgcttcctcgacatcccaacgtcgtcgtcgccagccttggaagggatcgatcggttggccaattcgccgccatgaacccggttcacctgaccgtcagcctggcgctgaagcaggcgggcgaattcggcagtagtacgaactaaaaaaaacaacgaattaggccgaagcgcatctccgtaaaggaaatagatgtcaaaaagcgaaagcaaaactcacgttcggtcccggcggggagaacaaggcgaggaagcccaagcaccacctcgcccttgttgatggaaaccccccagtcgcaagcaaggggggaaatccgaagaaggcaaaactcctcgcaaaggtcgtgggtacttaatcgccgcagaaccttgcgaaggaggatgagccgggactcgagggtgccatcgatctccacgttcggcttcacgacaatggagacggcaagacgccaaaaacggagccagttcgccttgtcatcctcggcggggtaaggattgttgatgtagaaccacttctgcatccagttccactcccacttcaccatagacgcaggcaccggccaggcgtccgaacgctccggccgaagcatgaagttgacgcagccgaaaactgtcttcctcggcccggctggcatgttcacgtctttggttgtggcgcacgccgtaaacaagatggcgaacaattcggtggtaggatcgaaaccacacgttcggcacatccatgcgaagacggccaacttcgggaatgctgacgggctaagctcaggaagcctgacctcatatatcgccagcacagacatctagaaattgtcgcatgggaggcgaagtccagcaacaaggaaggcagcaaaaatgactgttcgcctgtcgcctggcgaagggacggtggcttcgcccgcacagttcacttggccctctgcaagagcaccggagaggacgaactcagccaagtcaggctccttgacaagggacttgccaaggtagcacgaccacccttcgccagggttttcgccggttgacccggctgtcacgccctgataaattcatcccgaaataaaaatcattctctaaaaggaataatagaattaattaaaattcgaaaagaaattggcaaaccttaaaatgcgtacaagaaaaattcgaatgtggcctagagaatttttgttaaattccccttgctctaaaaggagccctcaaattttactataaattttagaacaccagaaataattattaagcaacaacaacctttagcaaagtttattaaaaaaaaacttaaaaataatcctccttcttcctttgggccaagtcttgcccaaagcctccctctctctccctcggcccgcggccgaagtccttctatgctccctctctttttccttccctctctccctcgggccgcccctcctatccctccttccctctcggcccagccgctcggcccaagccgagctgcagccctcccacgcgctcacatgtgctgactgcgccagaccacgtgggtcccaccctcggtcatcgtcctcctcccgcacggcctcctctctctctcccgtgaaccctagctcctttcctcccttaaatccatacgaatcaattcccttcatttcaaattgaggctttgttcgctagctgtgggaattaatccccgggtaaagcctcccacgtggggtttgggttgtccccacaccccacacccaatccctccctggctccctgcgaatcccccacctctcatccctctcacgttagactgttcggacagaggtgggattagaagggatcactaccattcactacacttcaaattcagaaaatgagtaaaacatgttggaaaattcggataaaataaaaaaaatggaagaaaggtcacgaacgtcaaaatattttagaaatgataaggaaaaaattgatcatgaaaacaaaacaaaaattaaacgtggaaaataattctaaaaatcccaaaaaaataaaattgtagaattaccacagatgcactctaaaaatagtccagaatttttaaacaaccgtaattttggatagattaaattctacaagcagtaaaacatccaaataatcacaagttttccatagatatgctaggaaccaacttaacattgatactacaaaaatctctctttgttttcaaagaatctaactttcaaaatcagtctagaactgaccactcttaacattgtactcgcatacaatttctattgaaggggcactgcactattgcaacaatcaaaattcagtgaaaacagctttgtacaaatcagatctctctcactgagctaactgaaagaataaaagttccaattgccattgtgcaaagcaagacaaaaattggttcttggaacttaataaatctctgtccaatcaaaatcaataatatatctctgtctgatcaaacaagtgataattctgtagaaaaaattggttcctgcaaccataatagctacatgaattaagaagcagttaaggaaaaattgtccttcacccatcgcatttcacgattaaggagtctctaagaactatcttgcaaaacaatccttccaatgggcacagctagcaaatgggccatggaaccctgtaattacacatccaaaaagaaacaagtgttagacactagacaatggtgattgctaatatgtaaactaattaagcaacaggtaaaatgaacttgaaaacaatccttccaatgggcacagctagcaaatgggccatggaaccctgtaattacacatccaaaaagaaacaagtgttagacactagacaatggtgattgctaatatgtaaactaattaagcaacaggtaaaatgaacttgaatcaaatcagataaatatgcagaagatggttacttatactcaagtcagcaaatccataacattgtacctacaatctctctctccaacttcaaattacttctgttactctagtaaatatgcaggggcaagattaaatgcttcatatcaggcaaatgtaagtacaactgtatttagttttttctcaaataccttggataatatcaactccttcagctttacttttgccaaccccacacgcctgtgcctcgcctgaaatttaattcagcacaacagattatatttttgtcattcaatagccatttatatagctttgtatgatatgacctctagtaaaatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaaataccaaaactagaatgtatactacagtgtccacctgaccacctgatagcatgactttaaaattttttgcatcttcttgctcattcaattggcatatagtattggtcgttcaatctgaagctcaaatgaccttggccaaaagcaaagtgatgcattctagacagcaacaacagagtgcactagtttttatttttcaggtgtgctcccactgcatctacaataattcctggagaatcaacaaaccaggtttctccctcacaaaaaaagaaaagaaagaagagagcccatgttcagaaatataggatctgccaattgaaatatatatttccttgattacagagcaactgataggcaagatttgcacacacacatagagagatgtgcatggaattttctgtggtttcaggttctactactacaaaccacatcacccctccttctaagcagaacatgactgatacttcaatccatacagccactcaattcatcaactagcaacaaattcatccactagataagtcacaaaatcttttctgagtgggaaaagaggagatcaagaatcagacctgcttcttagtgtccgggctgttgccctcgacctcgccctctcccgcaactggtgaatccgaagcgaggaaggagagatggcgagcgccggcaactgggcgggatggagagcgggaaggagagcggcggcggctgaaacgggatggagaccgtcggcggctgaggacgggatggacaccggcggcggctgaagcgggatggagaccagcggcaaccgacggcgggatggagagcggcggcggctggagatatgctgctctcggatctccaccctagagccgcctcttggacctcgcgccgcctccaaaccctagcgcagcgaggagtcgaggaggccgagcgctgcggctggcttggaaaagaaaaatcgtctccgaggcgatttttctctccccgtggaattggtgtggattgggtggagaattgctccgaccccagcccaggcgaacgcatacatgggccacggaagaaaattcgacccggccgggatggcacacggggattttggcccattccccccccccctcaaacccagccgaaaagaacaaggcctgaggggggaattaatcccctttccctcctctctctttcccccttaattctaccttgattcgtgcttttaatcgctcggaacggctgcgcctttcccggccaccttccatggccgccggccgccattcccgcctccgttccgccctctcctgtggccggctccctccctgcgcctataaaatggaaccccctttgtgcgttctctcgtttttgcctcttcccgagctccccgtggccacaccgcctctccccgccaccgtcctctctctcccgtgccacgggccacctccagccgcctctcccttctcgcccatgcaccggcaggccaagccgtctcctccctcggcgtcgcagctgcctcccctccaccggcgtcgcctccgtttcgcgcggagaccatcggaggcgcgtttccgccactgtaccgcctccagtctccctgatcgctgcgccagagcgccggccgacgtcgccgtctcctccttcggtaccgcggcatcgacctccaccccggccgctcctcggtttcgttcggaagtcgccggatcaccgccgtcgcgccaacctttgcatccaccttgccggcgcaactccggctacctctgtttgtctcctttgcaaagcatcggctagctacaccaccaccacctttggcatcgcagtggcatggtcgccctcggtctcacctcccctcctcccgaaccctgccggtcttcatcgtcgtcatcgttcgtccttgttgacgtctcctctggtcggccgttcctcctcaccggcttgtcatctcgcggcgctgcctctatcgtcggcatcgcaacggcatgttccacgccgtccttgcctccgtgcagctgctgccggctgccctcgtcgcctcctcgccggccccggtcgtcgtggcgttcgtccctctgtcaagccaatcacgttcgccgcccgtatttcgtcaagtgtgctgctgccccgtcgtcatcttcgtcctcggctccatgtcgtcaagccctgagtcggccgcatctcgccttcgtccaaggatcgcaaccgaagtgtcatctgttcgtctccgttgcgcccgttcgtcaccgtcgttcccacgcctcatcgcgtggtggtaaggatccccctctcgctgccccgtcctcatccttttggtgtcgccctgtgcctgttgtgcggttgtcgaccccggtacccgtgtaccggtgtcggtagtcgttcgtgtgtgcgtgtggtgaccatgttagtgtgcccgctcggtagccgcgtggtttccacgtgtgctgcctgcatggtgtctagtggagtccgtttgtcagccactcacctcggttgacacatggggtccgcttccgtcgacccgtggaccgtctctgtgtacccagtccaccgtggtcctttaggttgacatatggggtcctcatgtcaacagcgcagccttcctatcttttccaggctagcgcttccacatgttttatagttacaaaaccttattataataatcagtaaatctccatataacagcattaaacttcggatgaccatatcttggtcatacgaattccgaatcgacccattcaagtctcctaatgtttgttataacctaaagaaccctatgcaatctttttatgtactgttattgcttctttataggcttgtagctttgattgtgtgctttgcgtagctttcgtcattctggaggttcccgaagcgtggtccgctatcgtcgccgaaggttcggaaggtcgttctctcttagcaaggcaagtcacatcacccttgagcatattgaatcccagtttataaaattattttattttaaattattgcattaccgctttatttaaattcccgcgttatcactgtttttatttagcacttcctattaatccttgttatagccttatcattgctattgtttattatcaccttgttcaccctaggaaaataaaaccccaactagtgggtaatccattcatggttccactagtatgaatttaggtagatgcttcgctgattaattaggcaacactaggtggttttataactttagactttgggagttctcatatcatttggacattatggaatggttggcttgtgatggaattgaacacacacctcccccttctctacaaaactcccaaaatggttttaggctgggcttaaggtgcatggttttgttagagaaccttggccaccataagtgtcacatcctgattttcgtttcaggatttataaattatttaataaattattaatagaatttatattaagtgttctttaatttacaagtgaagttaaatgtgggaaataaaatttcttaaatttaaagcatggatggatttaatttttgttaaattctccatggttaattatactctctgaaattttctcggatttttcagagctcaattcttaaataatacaaagaacagttcagtaattatttgatcattaatgatctaattataattgttaagagcttttcttgtttaaaaatccttaaattataaattgttgtttaaaaaggaattattcgaaatgatcttaaaagcttagaagagaagatctaattttaatttgttaaatctcaacataaaattgggctagataaaattttgttaaatactttgcttaattctttaattcctagatttttctgggatttatttgagctaaggaagtatttttaataaatggaattgcatttcatgaataatttaaattgaaaaaggttttaaaaagtcttcttttggctttgggccgaaagccggcccaaaaccctctctctctctttccctcggcccagccggcccagtccgccaagccgccgctctcctctctctctcagccgctgacaggtggaccccacctgtcaggttcgtcttcctcgagccgccgccgcccgcaaaccctagccgagagccgccgccgtctccttccaaattcgaccgcgtctttccttctccagtgaaatcttttgaggggaaataatcttctcgatctcctcttccttttctcttatagaaactccggtcaatttcctttggaaataggcggattcgagattgcttcggattcgttttcccccgatctttccttctcgtcgccggcagccgtgggccttcgccgccgcctccttgcccctttaaaaggatccccgagctctcctctacccgccgccaccctcgccttcgtctctagtcgtctgtagcgccctagcgccgtgccgcctcgcgccgccgtcgtcgccaccgctccagccgtgcgccgccgtcgctccagtcgtcgccgtcgttcgggaagaccgccgtcgtggtcgccaagtcgccgccgtcctcgtccgccccttcgccgccgccgaagaccgccggagctccgtcgccgccgccaacccgatctccgccgccgcttcttcctcgccgccggcgccgtccgttgcccttccgccgttgttttggtcaccggtgagttcgctgcgtcgccctctacccgttggtgccctccgttcgcatcgtcgagccgtcgttcgccggcgagcatgcgcgcccgagccgccgagtcgccgccggtgctgacgtcatcgctgacgtcatcgggatcgtccgccgtgagccggtcgtggaccgtttgatctcggccgtccgttttggatagggttgatctcggccgttcgtttccgtgaaccgctgccgtgcacccggtccaccgcaaaccctagccgctgacgcaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttattgaattctttttaaatgggctttaaatagatttaatcttgtaaaattcataataaattcatttgaagtcagaatgaggccgttcaagtctcacaattcatctaaaattatgatctacatgtttgtttactttttatgtactgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaacctattcctttgttatggcctgtttgcattgattactttattccttgataccttgggtgattataacttgactagttgagctatatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcacgagctactattgtgaaacattaaccgtgccaaccacaagccagcgtgggcaacggctttaccttttgtatagcatgattcattgcggagcactagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataattatggatgttataactggtaataatttgtttagctcctggtttggaatggtatattcctggtttggagattagatctgtacaaccgggtatggttgttcagaatggttgggcctgtgcagcatgggtgtgctgttcagtgttgattaaaatttctgattaattactccactattttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaattaacctcagttgaagaaaaaggattcagaagaagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattccgggacgaggattttatgcacaaataagttcggaaattactagtgaatttccgggcgtgacaataaggaccggttttcgggcctctgttgcaaagcactaccgtacttccacatgtctagtgggtaaggcgtacttcgtggctcagtctggtcatgggcaaaagtacacggatagagatggacgaagttggggctcgatggacatctctagggaaaatgaaggctacacgagctgcggcccggtagtcaagatgtcatggcacagggctggtgtcctgctgctaggggctcaaccttggttacctgtcccgggattccagccatagtcagggttgggtcggtactcttgtttatggctaggatgggttgggaactatgtcacgtcttccatccatatgccgtggtggtatgtggcacgtgattacacgtgaggaagacgtgtcttgtgggtaaagatgtacacctctgatcagagtataatctattcgaatagccgcgccctcggttatgggcaagcctagcaatgtacccaagttagtggtttaattcttaaaacttgcttaacaaccaaaatgtggaatggttgcttgggttggcttgggacgagctgggacctaggtcgggttgctagttcggtctgaatcatcgtaggccttgggttaaggcaggttcgtgtgggttcgcggccttgattaataatattatgtagccctaggatcgtgcttgtaaaataactttgagcgactaagtgtcttttaaatgctgtttactgcaaaatctaacccctattattatccccttgtacccccttgcattaatcatgcatctcccggtgtggcttgctgagtactgtcgttgtactcattcttgctctatcttccccccctcagtaagagaagctttggagaagaagtcctaggtggagtcctggcttataccccagttgagctcctgtgaagatggagccgtaggcccgctagtccgctgttgtttattttttattgtcagacctgaagtgcctttgtaataatgcaaatattatcgatataataaagatgtgcctttgtatcatgtttatgtggtgtaccccggcttatcgtgggacggggattaatacactagtgttcgagaaaaggtaatttttccgggcgtgacaccggcctaggcgagcttgcaaggagccaccgaacccgcggcaaaagcagaagtctaaagacgagaggggggggggaaagagtcaagagagcaagcgcaggagcgcagagatggtgaaaagctaagagcacaggtagagaaggaaagcgcggcggtagtaaaaagtgaagagcgggggggaaggtggtaacccgcggcagggttatatagactcgccaagcgacagttcgactatagaccaatcaaaacccgccacgtgtccaagggtagacgaaacagtaaattcccatcgggcagaggccgaacagtaaaaggccgaatgcaagattgaaaaggcccacggggcccattactattcataatagtataaaaaataatccaaccttttcgccactcgttggagaacataggtaggaaattttcctcaagatttttttgtcaacgcgaaagcaagttatttattttgcaggtacgcagcatgggtttcgacaggaacatcggctgaaagggggcacgtcgtggtacaccatttgacttgcgcggtctcggtcgaggctccctactcacccttgcccgtgaggggcttgttggaggtataccacgaagggccttcggtcggacctgccgaaatcaagaacttaggcaacaagctcagatcagaggaaagcggcgaaggtctagaaggaaaccatatgggcgaaggtcacaagatgaaagccgtggctcgggatatgccaacttcgccaagcaaagaccttgtcagagggccgcacgggtgaagatgatgaggtgaaagccttggcacaagggcatgggttttgccaaagtaccgaacctcgctgtcaggaggcccagcgggccgctacgccttctagggatttcggcaaatagatgggccaagccatttaagcccaataggggccatacatgtaaaagacattgagtgcccccaataacgtccctatcataagggtaaccatgtaaattcccccgtaaaatctaaaccctaaaggggggagcctgtaataggattataaatagccccctaaggccatgtaatagggggatccaaaaaattttcaaaaagcaatacaattgttcttgacttccaaccactgtcgagagaattacatgttatccgaatagcttgttaaagccatttgcttgttatccaaataaccactcaagcatatagaagaatatgtagaataccatattccaaattcaagagtctattgcaaatacctcatgatgcgtttgacagcttgacgatgtgaagcacgtggagaagcttgaaaacaagcacacaaacatacaacaaattgtatgtccggtcttgaagcagtgagatagagtaatgatccaatcatactcctatactccttttgatccacaacttcaccatcttcatccggatccaacacaggagtagatccaatgggtgtagacataggcttgcaatcctccatcttgaaacgccgtagaagatccttggtgtacttcgtttgatgcacaaatgtgccttgctttgtttgcttgatttgaagccccaaaaagtaagtcaattcgcccatcatgctcttctcaaattccatgcgcatagtctcagcaaactccacaaccaaagggtgagatgaacaaccaaagatgatatcatccacataaatctgaacaaaaagttgatcatcaccatgcttaagaacaaagagtgttttatccacttttcccattataaaacctttggcaagcaaaaagttttccaatctatcatgccatgcccttggagattgttttaaaccataca

SEQ ID NO: 58354 - DNA, 2536 bp, Oryza sativa
atgcctgacccgtaaccctgacaaaatcgaagttcgaacggataagttaagacctcgagaagttcaaattcagagaaaatctaatgacagaaagaaaaggaatattccaggaatatcctatggatattaattctttaaattgaattatttttaataagaaaattatagtggggcccactgattagtggctcaggttttggtggactcggtgtatgatgggtcggctggcgtggatgcctcgtggtgacacgtgtatagagatagatgacatggcaatgacgtgggtggatctagggctgatgtgccgagggaaggagttatggtaatctgactctaaagatttaagcaaggagatcaaatggctgtatgttcctcatgtttgatacccttggaatactctaagggaaagtgctaccgcggtattctgtgcgcctcagatttatctgtgatcgtatcacataccaataattgcattatagcggaattatagctagatattactgttatattcatataaatttagcctaaattaattcactttcactaaattatggatagttaaaaagagataatgaatatagatttcgacttgtcacgatgtgttaaaacatattagaaattcaatataataatactttaagagatattgtggccgggagatttgctaagaagcaaacggagactggagaccatactgaaggacgcacatttcgttgaggtgattttctcatggaactgaacccccatatacctgaaatgctatattctattttgggtttttttttccttatatataccatttacccaaaatacaatattctattttggggttttttccttactagcaatagtgtctgtgcgttgcaacgggaaaaacaccgtttgatagtgtgacaccttgaaaacctcgaatctgtaaaaatcttgatatattaatcaattcgacggcccgcaagctgagcagttgagcgcggcccacatatgcggggacggtccgatgcacttccgcagcccattgggcgcagcgtaatcaacggcggcgacagcccgacgctaggcgaatctgagccgtccgatctaatggacggctccaatcgtacccgcgctggatgaagcgccgatcggggagaggggcaaaaccctggctcccaaatccctctctcctgataccatttatctccggagacgagcgagcaaaacgatggcggtccggcaagctggtgcgcgcgtgcagcgacgaccgccgagcggctcctgcttcgccggctgggggccgcacccgagggcagcgcaaagccatgccacgacgtcggcggtccggttaggtggtcgtgcaaacggcgacgagcgctgagcggcttggacctcgtcggtggtaggggcgacaccaagccgacacttcccgtcttcggcaaaggacggtggaggggtgctccaggacagcgtgcgcaggaaacccgacacgactgcgagaaggtgaaggtgcggtggtgccgcttcccagaaagctccagtgagctcaggggcttcaagtctggtaagtaacccgaacccttagcttaattgatttggatttgactcttatggttcttacccgaaattagggttgttcgaatttagagaattttgtcgggaaatttcaatctattttattccctcttttcgagttaggggtgtttcaatatcgtttattctcttttaatttcgggaacttcaatctagtttatccctttgctcaattttgtttttttagcttgcgtttcatcgcgcaagcggggatggagggcgccgctcgtccccacggaaagattgaatcggactttcttttatttgttttaatgtttttttggtcctttttttcgttattacggacaacagaaacatttttaattttttaagcagtagagatagagaagatagagatatatagtaccgtgtcaaatataataggattcgatttttttaccgcgtcacgtataattcttttttttttggaatcggacatatttgttttttttattttttttttctcctttctttttacagcgtccacacggattcttttttttttggccggtcttttttttcacctgttttttttttcgcctgtttttttagaatcggacagattcctttttttttctttttgccctttttttttactgcggaatcggattcagttttcttttccctttttccgcccgtttttttattcttttttcgtccggttttttttgcccgttttgttttggatataggattgcatcggttatagtcggtttcgatggtagggattaatgtagggacaaacctacttttaaagcagattgcttttctcatattcaaccttttccacatgtggtaggtgttgtgtaattgtcttgagagatggacccctaattggttgctgcaattattgtctgtgcatgtactatttatcatatttatacaaaagatattgtacggcttgattcatactgctttcgtttttttaatagatgacgccgttgattttcttctcacatgtttgaccatt

SEQ ID NO: 58355 - DNA, 3260 bp, Oryza sativa
ggcgcccgatctctgtgatgtagtttttttccctgatccgtgtgatatgtgcggtcgatctgtgggatgtcgattttttttcgatctgtgtgatgtgtgatgtgtaaatgaatatgtggagatgttttttgaatgatctgcgatgtatttggagataaaaatgcagcttgatgtatttggggatttttgtgaatgatacgtgatgtatttgggtttaaaaatgtagctggatgtatagggggattttgggaaggatatgtggcgttaaaatgatttgtgaataatatgaatggtggtgcctcgaaatcatgaaaagcatgaaaaaaaaaagaaagaacattagtcccggtgttaactctaaccgggactaaatctttagtcccggtttttaacactaaccgggacaaaagatggatcttttgtcccggttatttcaaccgggactaaaaataggcatctttagtcccggattcgtagtcccgtttgtataaccgggactatagggggttgcgaaccggtattaaaaagggtttgtccaccagtgtcatctccctgccagctgcttcccctacctctcttcccccaccccttctcccgcccctccccctcatgatgggttcccctttatctctccttcagcatttgttcccctaccatttgttcccctaccccgattcctcatgttgttgagacatcagcgacttccaccacttctctatagatttatccaggttttgcgttgaattttttttggaatttgaagaaggttgattgaaagtttaggctttcactgcttcgatgaaagttctatgatttttgagatgaaagttttgtgattttgagatgaaagttcaagttttcaatcaaaaatattttcagatgaaagtttcagatttttaattaaaagttttgtgattttgggataaaagtttcaattaaaagtttcttttttgagatgaaagttttgggtttctaatttaaatttttataattttcagacaaaagtttcatttgagtcgtttttttcaattttgatatggaagttttagattttgagttaaaagctttttaaatttgtgataaaagttttagcattcttgtggtcaggtggcatcaaggaagaagaacaagctctcgcctttgaatcaatggggagtggggctgaaacatgcgcacgacagcgggcctcatgggcatgcttgtgcacctgcagcggagctgcgccaaagcgctaagcgctagcggtgtcttgacatatactctgtatgttgtcatcatccaaacacccccggtggtacttggatcatggactaaactgtccctgtcctatcggatgtttgaaaattaatttagagtaataaacatagactacatacaaaactaattacataaatgagagctaattcgcgagacaatttttttaagcctaattaatttataattagagaatgtttactgtagcatcacgcgggctaatcatggattaattatgctcaatagattcatcttgcgaattagtccagagttatgaaataggttttgtcagtagactatatttaatacttctaattagtatcaaacatccgatatgacgtgtactgaaaaatttttagccccatccaaacacccccgatatgcgtcactgtattgtgccagatagatgaatatatctgtttaaaaatttcagtcccttaacaactgacaaaaggacatttcaattaattatacaaaaggacatttcaactgttaagtgtgcatggatatgcgaagggacgaacagtagctagtactacactagagattttttttttaagtacagtaaaggtctagatctttgaaagacatacaccacaccataaatagagcacggtaccaagctaatgagtactgagcagtcgagctagtgcccagccttgcgttgaacatcacattacgtacgtttcagcaagcaggtgctcgatcgatcggccatggcaccggccacggtgctcaactccggcgagcccgacgcccgacgccgcgagcggccgcacgtcgtcttcatcccgagcgccggcatgggccacctcctcccgttcttccgcttcatcggcgcgctgtcctcccacgaagtagacatctcagtcgtcaccgtcctccccaccgtgtcggccgccgaggccgaccacttcgcccgcctcttccacgacttccccagcatccgccgcgtcgacttcaacctgctgccgctcgacgcctccgagttccccggcgccgacccgttcctgctccggtgggaggccctgcgccgctccatgcacctcctcgccccggccatcgccggcgtcgccccgcgcgccacggccgtcgtcaccgacgtcacgctggtgtcccacgtgaaccccatcgccaaggaccttcgcctccagtgccacgtgctgttcatctcatccgtgaccatgcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccaaccgggactaaagatgatctttagtcccggttcgaatgctgtcagggtctgtcaggccctcccggtatctttagtcccggttgataacaccaaccgggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaa

SEQ ID NO: 58356 - DNA, 1060 bp, Oryza sativa
agagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaa

SEQ ID NO: 58357 - DNA, 3076 bp, Oryza sativa
tatacacatataccttggacggtgattcaaaacaatttttctcttaaattacttatccaatctacaatccgatcacaccgttgtattcgttgtaattaaatctttacaacaagatgtcacatgattatattctaattaaaaataatcatatgtttcaatccattaacactctttgtttcatacgcgatagtaatatgtttcaatatgtctcttcagcatgtttcacaaatttcgtggaactacatctcactactctctctcctctctccacctcatgcatgcatgcattttagcgggcttcaaaacaacttttctcataaactaattatccaatctatgatccgaacacatcggtgtattcgttgtaattaaatctttacaacaagatatcacatgattatattttgatgaaagaaaaacatatgttttaatccgttaacactagttgtttcatatgtgatagcgatatgtttcaacgtgtatctttatcatgtttcataaaatttttaaatgtttcagttgctgattttttgtttcaccatatataatttgatgtttcactcattggtcaactagaacatttgaccaaccaattttctttgggacataggacgttagatgggaagcttcctcatgattgaggagtgaagaatgaagtacagcaatatacacatacacatacgctcgctgcttggctggacgtccgatatttggtgagatatcggacgtccgagccgtagcgctctccgaaacttttgacacgtaagaaattttttattttccatttcagacaaatgctttttgttttattgaaaccgacatttcagacaaatggtactacaggcgtacagctgctataaaaagacacatatgccaacgctcttatcagtcgagcattcacccagcattagccggtttcacaacagcatcataaagcagctgctcggccatggcaccaccgcctgcggtgctcagctccggtgagctcggcgcgcgagggcacacacggccgcacgtcgtgttcgtcccgagcgccggcatgggccacctcctccagttcttccgcttcatcggcgcgctgtccgcccacgacgtcgacatctccgtcgtcaccgtcttcccgaccgtgtccgccgccgaggccgaccacttcgccgccctcttcagggactatcccagcgtccgccgcctcgacttcgacctgctgccgttcgacgcgtccgagttccccggcggcgacccgttcctgctccggtgggaggccctgcgccgctccttgcacctcctcggcccggtcatcgccggcgtcaccccgcgcgtcacggccaccgtcaccgacgtcacgctggtgtcccacgtcaaccccatcgccaaggacctgggcgtccagtgccacgtgctgtacgtctcctccgcggccatgatgtccctctgctcctacttccctatctacctcgacaacaaggatgccggggccgacgtcggcgacgtcgacatccccggtgtgcgtcgcctcaagaggtcctggctgccgcagccattgctcgacctgaacaagctcttcacgaagcagttcatcgagaacggccgggagatggtcaagaccgacggcgttctgatcaacacgttcgacgcgctggagccggtggcgctcgccgccctccgcgacggcaaggtcgtccgcgggttcccgccggtgttcgccgtcggcccgcacagctccctggcgagcgaggcgacgaagggcgccgccgccgacgcagaggggtcgccgatggcatggctccgccagcagccggcgcggtcggtggtgtacgtcgccttcggcagccggtgcgccgtgagccacgagcagatccgggagatcgcggcggggctggaggcgagcggctcccgcttcctgtggatcctcaagaccacggtggtggaccgcgacgacgacgccggcatccgcgacgtgctcggcgacgggttcctggagcgcgtgcgggggcgcggcgtggtgaccaaggcgtgggtggaccaggacgcggtgctcagggacccggcggtgggcctgttcctgagccacagcgggtggaactcggtgatcgaggcggcgacggccggcgtgccgctgctggcgtggccgcggggcggcgaccaccgcgtggcggcgacggtggtggcgagcagcggcgtcggggtgtggatggagcagtggagctgggacggggaggagtgggtggtgagcggggaggagataggggggaaggtgaaggagatgatggccgacgccggcgtgcgggagaaggcggccaaggtcggcgaggaggtggccaaggcggtggccgtcggcggcacgagccacacgggcatcctggatttcgtcgccaagctcaaggctgcaacttaagcattctctctcgtgttcgtctgagaataaatatctactgctacataattcctccttcaatgtcacgtataagtgtacaagtgaaaggagggagtgtgataaataaaagcactctcgtgtgtgcggctatgcgtagtttgggattgaaaaaggccaatttccaattggcaccaccaaagctcctccttgttcccggttaggaacaaatttggttgttttcatttttcagtttgtttcagttgtgttgcaaatctattgtcttggattctcccccatcttctttcttttcacatgttcttttaggccattcacaatgcaacacgctggcattcgccctgagcggtccacgttggcgagtagcccaaattcaccgtcacgttatagcatgggcccacaaaactcaaacgcgtgtgaccaaagttggtcacccgttcttcggcacaatcgggactaggtggcatggggaaacgaggtcgcggcgcattgcggaggcatggcttcgccacaccgttcctcccgatgagatttctctccctctatccccaaattgtgtgacggcgcggcgcggcagcatgaaggcggtggaagagagaacggagagcggcggcgacagcaagaagggagaacgagagtggtggagaagaagaggagcctaccggcgacctgggagcaccacatcgg

SEQ ID NO: 58358 - DNA, 7296 bp, Oryza sativa
aaaacatgggccacaagcagctcgacggctactctttgccatctgcactttgcgtagccttaaaaataaggtacattagggagaaacccaatgtaaattttatcaaggagggtgaatgcattgtggagagtcaacagataacttacataaaagaaaaaaaagagaaatatcgtgagagagtatggccatctccaatgtggatgcttaagtatgtgcttataaagaaataactgttttgtcttgccacttagtataagagaggtgttaatcctgaagcatcgatgcttagcagagcagatgctcaactgtgtgagggcatctacaaataaatatagagtcaggtatgagctttattccatatagagactaacttcttacaacaaccgagattatatggtctttaaccattaatgcacctaaatatttttttcttactagtactcttttttcctttcttttatccttatgcaacaaaattttcttataaatgctaaaagttgtatctaagccgatgtcatacatagtaatcatgtttctccttcctcccctctttttcttctatgccattaaatttacttacatggcaataaaaaaaatccgctaataaagttgaccgttgtacatgccctatataaagcttacctcaagtcctcaactacttgatttataagcacatagaaggagatgtttgcattcaagagagttcttagacagatagtactacttaattacgtaactaaattaattaagcactcaatattgacgctttacattgaagacgctctaatacacaaatttaatttaatagtctatgggagtaatgagccgaaaaaatgtctcggatattagaccagtcccaacccaagatactagacatagtttctataaacttcacatcatcaagaaactagtaccaaacactactcttacaatgcaaatatcaattttacatacttaaattaaatgctacttatctcacatgatgtcttgaatgttatgtagaaaccatgtctcatgcaatacctggtttccttctctttcatcatttattcacttgccacatcatctttaattctaggtgacagtttatttaatgctatggcaatactggattggaaatggccttagtgtgcatgggtgcaacaaaactgaaagagccggttgcacttctatcaccatcttgcactaaatggccgtttcgttggatgccagaacttgtagaatttaattcgatatagttacactacgagtagtatttaggctgtgttctttcctgggtgattgtaagtcagtttgtttcgtttttcatgcatacgcttcccaaactactaaacggtgtgttttttgcaaaaaaaaatctatataaaagttgctttaaaaaatcatattaatctatttttgaagtttgaaatagttaatagtcaattaatcatgtactaatggctcatctcgttttacgtatctttccaatctcctctacgtcctcttctcaaacacagccttagttttctgttactcgttgcctgatgtgccacatttttcttcttacaagtttacatgccatgaaaaaaaaaattcaacgcaaaaatggtggcttgaaatttgcaatagtatcgacaaagaactgccaaagggtactccagtactcagggctcctttagaactgatgaattttgcataaatcttactactagtaaaagaaaataaattactcccgccatcttagtcgcttcgttcgttcccgggtgagaaaatatctcattttctgcacgcacgcttcccaaactactaaacggtgcgtttattgtaaaaaaattctatagaaaagttgctttaaaaatcatattaatccatttttaaaatttaaaatagttaatactcaactaatcatacgctaatggctcacctcgttttgcgtatcttcccaatcttctcaatcccctcctcctcaaacacaccctaaaactctatttctagccattgattaacaaattagtggcagggataaaagatcaaagtacctcttattataagaaataggaaaagatatgaattacacccctaaactatcatggtcgatcgaattatccccctaaactcgaataccggatattttacactctcaactatacaaaccagataaataacccccctagctcaatccaaagtggttttaatcctacgtggcagtctagtcagcaattttttttataaaaaatagtgtgggccccacctataagactctccctatctatctttctcctctcacatctcaatttctctctagtctctactctctcttcctcgatcccgatccacacacacacactctctctctctctctcctccctccttgcagcgagcggcagcggctggcagagtcggagctcgcacttgcgtgaaggtggcgacggcggtggtggagccgaagctcgcatgagtggctggggcggcggggcgtggctgggtgggtgctactgtcggcggtgtgcgcagtggggaaaggggaactagtcagcggtggacgcggctgggtggtgtcacaccccgaagttctttcccaagcctaaattgaagttataaatggtctcaagaaaataccagtgtaaagcaagagtagaccttaataaattaatgcaaataataatcggaattggcatgtggaattttttttgagttctacatgtcgaaattcgctaacaagatttttagtggaattttcagagctctcgaaataattttaaccaattaaaattgagcacatgcaattttaaatcccagggaaaatcttttcctccttttctttttcttttccctccttttcctcttcttgggccgtcggcccaatccaccccgccgccgcgcgcgccctcctccttgtgggccggcccaagccgcccctccctctctccccgggacgccgacaggtgggccccacctgtcggggtcgtccccttcctccggccgcccgccccacgttgccaccaccgccgaaaccgccgccgcgcccacatccccgcctcctccgagccacgtcggccacgcccgcgcatgcgccgcgcctcccgcacccactcctcctctctcccgctcgcgcccgcgcccgagatggccgggattcgaattccgaatcccgcctctctctccacctccacctccccacgtcggctggcgaatcccgcccttaccggccacgtccgagttcctcctcccctatttaagctccaccgccaccccctctctctttttacccatctcgccgaactctcccgagctctccatcgctcccgcgccgtgcacccatccgccaccgccgctcccgctactccggccgctgctagccgacgctaggctcgccgccacaccacgtcgtcgccaccgtcgggttcgcgtggccaaggtccaccccgtccaccccttctccgtcgaggttcgccgccggagcgccattcccgccatgcgacggtgagagccgccatgtccgccgccttcggccggcgttcccgccttctatggcccctctctccctctctaatctttttcttttcgttctttaggtcgtcccggaccccgtccgccgcttgtcgacctccctccgtcgctcctcgtcaccggtcgtcgccgcccctccggtgaggactccctcccctttcctttccttccccgtttccccgtgcgccgccgtcacccgcgctcgccgtcgccttcggtcgtcaccgccgccggggcgccgtccgctgccgccgccctcgccgccgcttgccatcgccggtggtcgcgtgcgcgcgccgccgcccttgccatggccggccggccggctttgtgccgagccgagccgagccaggccgccgccgcaccgtccgatcggccccgggccgatctgggccgtcgatcccgtggactggcggtggaccatccgcgtggtcctggtccacggtagaccgaccacccgtgctccactgacatgcgggccccgcctgtcgacgccgacccccccccccgggatgacgttagccctggggcttattgcgcaataaatgatttaaggacttttgttatagtaataaacacattgaatcttctaaaattcataactaattcatctgtgctccgtttaagcccattcaagtctcagtaaatcaagaaaaatgtgtagaatccattaaaaatggttttgttctctgtttcaatagtcttatagcctgtttgtattgtttgctttgtatgtcgcttagattccggttcttccgacgctccggtgtacttccaaatagtcgccgaggttcctccagcagcagagcaaggcaagtcatgcttgtcacttgaacatgttgatcctatattgcaaatgctctattgtttttcttcaaatactgtattgttttataatgttactatgggatgtttacctactgtcatagccgtactattttgtaccatgttcctttgttagcttgggatataacatgactagagattagactagggattgcttagccatgcttagttcaactagcacacaatgagggagatcctattaatgtttagacggtaggttctaatggtaatgttggattagtgacaccgcttcggtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctgggcttgtagtgtagcttttctctagccgacgcatccaggcaagggtgggcgtgatggagtttggatgggccctgcgacggcctatgcggcttccggattcacctaggcaagagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagtcgtgcccgcggttatgggcagtcaaccagattcaccgtgattagtctcaccctagtttagtctaatgaaattggatagtataggtggatggttgggcctgtcgcaacgtggtatagcgttggacagtggatggataatattgattaattattacaactgtttaattctttcaacttctgtttataaatgctcgccttatgcaaatgaaccactctagctctcctttgataattccctgcatcatacccctattccggtatgacttgctgagtacagtgggtagtactcagtcttgctctattttccccaaccccagagtacaagtatgtgtcagatggtggtttctccgaggagtaggcttcgtccgtgccgtcgaggatgcctgtggagtggtgttcccgctgcagttcaagtcaaggcttagctccagttatctttcgtttttccgctgcatttatgtaagacttttatgatgtttgtaagacgtggatctgaatgtaaacattgtcgtttgtgtacctcggccggtcctggacggggattttaatgcacattctgcttggaattctattcaggaatttctgggcgtgacaggtgggtgctccggttggcggcaggcgccgcggcaaaaggggaaccagttggtggcgagcggcggtgggcgcggatgggagggtgctccagtcggcagcgcgtcgggtccaggcgtcctctccctcccctctaggaggcaccactatgaggcgagctactcggccaaggagccgaggtccgagtcgaggaaggcgttggtggcgtaaatgacacagtggtgcagcccgaaccgtgccaccccacccgacagcgcgtacagcaggtgggagggtgctccaggcggcggcgggagcgacgaggagggggcttcggtcggcagcgagcaacgataggccgaccggccgtcgccgcgctcttcagttctaggagggaagctagagagagatttggggaagagagagattgagagaggtgagaggagagagatagggagagtcttataggtggggcccacactattttttttttaaaaaaaattgctaactggactgccacgtaggattaaaaccactttgattgagctagggggttatttatccggtttgtatagttgaggggtgtaaaatatccggtattcgagtttaggggggtaatttgatcgaccgtgatagtttaagggtataattcgtactttttcataagaaataataatactgtgaagtgataggtcagagagaaaacatactgatttatggaccagaagtaaataaggtagaaatgatttttttaaaaaataaaatttaagtgcttaagagctccattgtttcatttatacttatgcttacaaacaaaattttgaattttaaacttaatgttatagttgattttgtgattttttttatcgtatgttatttacatcatttacttttgaatctccaagaacacatataaaagtgttactcataaattatttttaaattgctaataaacggttcgcataagcacaagcataagtgaaacaataaagccttaagtctttttgaacggagggaatacatttcatgtgaaaatcatacagtattttttttctgaaagaagaaaatcgtacagtagaaaactacagcgttcaaaggaaccatgagcatctttcagattttaactgtcagatttaggtttttttggttagtaggaggagtaactgcttacccagagcggcagcttacctcccgccgttaagcgcgccgcgtgctgccatagagagtgccatgccattgccactggaagcgtaggcgcatagcttcgcatgtggccgcagcgccggcagccacaggcacctcaacgcaccagcgcacggaaggccacatgctgcacgcatgcacgcatgacactgcacgcacaaacaccattatcttaaaaaaaatattacacaaacaaacatctcactcctgcagttctgttccccacatttctctctctacccccttctatttcttcagagtaaaaacgaagaatgcccacttcttatttcttcagaaaaagaattgaagaattaacgcaaatttcatccattgattattgaccattaagctgaagcaagaaagcgctccttcctatcaaaaatatttgatgtttaagataaaaatcagttaaacttttaaaattccgataatcaatagcttcttaaatgcttagtgtaaaaacaatagaatg

SEQ ID NO: 58359 - DNA, 758 bp, Oryza sativa
tatatatatgtatatatatatatatatatatatatatatatatatatatatatgtatatatatatatatatatatgtatatacacatatatatatatgtatatatgtacatatatatatgtatatatatatatatacatatatatataccactttattattaactttattattcagaaatatatatgtgctgaattcactactattcactactattcttagtgctgaattcactgttatgagtacagaattactgtttacaggttactgttcactcgaaaattttctttaaatttttaggatctttgcagggtggcgaatccaaaaacagccggcgcttgatttagaaattttaaagtcctactcggtactagccgtatgcctcacttatctgcctatttaagcaaccaacttcaggtatccctagtcatatttgaactagctaagcgtttaccgtctccccaggcagttccacccgaggggaacacttctctacggatactggttctccagacgcctatgcaagatgcaggctaaaaacgagaacaaccgagaggtttctcctatagggtccctagcataaacgcttatctagagcaaacaaacggggaaacttaaagaaaattacttcatattaagcaaataggcttacatacggttttcctttcgggaaccccgaaggtagatacaaacaagtttttctcaccttacaaacctttatattacaactccttgcttcaatatatattatgcaaggta

SEQ ID NO: 58360 - DNA, 631 bp, Oryza sativa
tcagaattgggtcacagcccatgggcagtaaaaaagggtcttctttatgggagaacccccgccggtagaagctcggcgactggattggcggcaaccgcccgccgccgccttgagaggccttctccccctccgattctgcttcctcctctccctccccgtcgcgatcctccgttgctgtcccgatccctgtccgcgagcgcatacgctccgtccttcccatccagatcgcgccacccagtccgccggcgcgtcgtacgcctccaccagctgtcggtcctccgcctcccggtcaagatccggcaccgcgccgccgtcctccgtcgcctccgcctcctgttcgagatccacagcaccgtgcaaccctttctctgcaagtcggtttctgcaaccaaggtttgttttctttgctacaggcattgctatttttgttcttggtttcggtgcagcagattagattgctctgctaacatctgaatgaagcaaatctttatcacatgttgaaattgttgatccagctagggattgcttatttgtttgccgattccagtacaaacttgtaaaaagctattaggattagattagacattgaatataatgtataagcttgtatagagagatcataggattctct

SEQ ID NO: 58361 - DNA, 5876 bp, Oryza sativa
aagaatttcaaagaacttgattatcctttgtttcaatcctttttgtgagggtcaatcctttgttccaaacaactttgtatgaactttttccatagaattcaaatgtttaatagcaatccctaccttttcttctttgtttcagagcagacctacctaaacagcaatttctaggttcaaccccatgttagatttcttacagattttttttttgaaaggatcctaattaatcctacaacatccctcaaattttttttttacagcgcgctccgagtactttgtttccatgtactagcactgaagtttttcaaaatgtgagctgcagcaaaggtgtacaatatcttcctactacggtgtctgtatctactgtctgtgcgacactgtttgtgatgcactgaacagcagctcgctgcgtcggcctctctataatctgtactgtacaggttttcagtgtcacgtcgctgcctgggctggccatggcctcgtgggtgtgtcatgtgtgcatgcatgacatgcaaagtaagcttgtgtatagaacattcaggaccggatgaacagaataatgtgctttcagaggatttaccgctgccaatcaaacctgttcgtagattggacattggagtacttcagttcaatttcactcatttcagtcaaccgatccctcgccacagttaaaatttggagatgatatggcatgtgaagatccatcctgcatccgagaaaagaatacattaagcttacaaaaagaagagaagatagaatacaggggcacattcaacataaactacagttagcattgacacaatgcggaggaacaatgtggcacatgaaacaattcagttaagaactaaccctacaacagcaccaccattgcatgattgcatctgcatcactgcatgccaacgacttccacaagcttggctaggttggttcaaactaactgaacacatgttctctctctctctctctctctctctctctctctctctctctctctgtgaagtctgaagatcatgcatactccagcatgagtaggggatggcattaaaacaggttggtcaggtggtgaccggagacgctattcgagttattactactacccggtgcctgcctcattctaacaaacaaaccccatagatagccatcttcttgcgccccaacatggcagattttggcagaccaggcccccccaaccacgaggccacatgggcaacacaaggtgaccactgtggctacgcattggaaacaggtattccttcacatatcttcacatcaacctcctctcctcctggcttggtgacaagacagagaacaaaatggttggcaaagttattagagacagttggaaggataacctgtccttcccatttaaggacactgccacccttttgcaagccacaggggaaaagaaaacacacacacacaacaaagatcctggcatctctccagtaatcctcctcctgctgcctcagctcctcttctgtaatcccctcctttcctatgcttatctatgagaaggaagatggctgggtgtcagaggcttcttcaatgttctcctcctcaggttgagggtattcaaggagggagcacaaacaagaagagagcaagagcaatgtcttctttaatgttgcattgatgaggggtccagaagagaagcataaataaagaaggaagctagccatatattcttcccagccagtgttcctagtatccattctctctcaaactcaaagctccctcctccaactatctcaccttccttctattctattctattccctctggcttagcttgtttttatcagttcttacctttcttgattctcctctcctctcctctgccatggagtcatcccatatcactggggatgatggcgagggctgcaacagcagcgagtccgggtggacaatgtaccttgcctctcccatgcacggcgacgatgacggcggcggcaaaaggagcggcagcgaaggaagcaatgttgatgatggctatggctacatcagcggtcggggaagccgcaaggagtatgaagacgacggcgatggcgacgacgacgattccctcgcctccgatgcttcaaccggtccggccaaagtgaaggtgccttccgcaccggacggcgatgacgccggcggccgtcggaagcacgacggcgacgaagacggcggcggcaagggggaggaggaggaggaagaagatcatggcttgcacaccaaattctcgatgagctccggcaagaaagccggcaagacggagaaaggaggagaagggaagtcctccaagaaaggccagaacaagagaggaagctcatcaagaacaagattcttttggtaatggctttctaaaatgcattagaatcgctgtactaggaatctctcttttcagtttcttggtaagattgaatccttgctaggagtatgcatgcatggagaaaggaaggctttttttggatccttgtttttgccttccatagagcttctcccatggttgaccacccagtagtaggttaactgttgccgccatgtaaatctactgtaaccttcggttattcttcaatgccctgcctttaatgtcgcttgcagagcttgcaatcttctcctatgtttctactaagatattaatgaacactgctcctactctgaaagtttctgtccaggtagatttcctctcacacggtttgaagcattgaagcatttgcaataacagtaaagagagaagaagatgctaggtcaattaatttaattctcctctgcttcccagtgtctagaaagtcagaagcgttcatgcatattttattacaactttattagaaatatatggtacatacggcacacatgtttatctttctgctaagaaaatcgcacgcatcatatttcgacaaagaaaaatcaccccacttttatctttctgcccaatgccacaatgattcatgactagtacctaaacccaatccaatgataaaagaaatggtaacatgtaccagaggcagacattgaggatactactagttttctgaaacttttgcttgccaactcacattctttagcattgcgctaagcagatgctgagagcaggtgacttggcttgaactaatttgttcgatgcccatcatgtggtaagtatataacaatgcaccagaagaattatgtgacctaaacactccagaagaggggaatatttgtctaaccacaccactcatgcagcattaaggcagcaattgctgcacatgttctagacagggtggaaacaatgatttgtccatctcacagagcggtctaattaatagccataaacagaacaacaatgatgtaagctggcttatgtactaaaaccagctctccctcattttctctcctccccctagctataaaccaaaccagaaaattaggatcacgttctggaagaatatatgaaaatgggcaacatgagtacagctaatgcaccacttttgcaccaaaccatagcaatgagctgctatactttagcacaagaattaaacaatggcaggacgctgcatcttctatatgtggtggcaataacatgctgcatttaagccccaggccaatgatttgccaccggaaatcttcatcatcgaaacgtataagtataatcatgtaggtgtgcgtgaaacaataaacaaagcacagcagaagatgtaaacaagtgagtccagctatcacctgctaatagcatgtatcattccttcgaatccagcagccgtctaaaagcagctttggcactgtttggatcattcctgttgggaaacgatacagagaaagtaccaatctccctttcctgggaaagaaagaacaattatacatgaagggcctgttcacttcgatgccaaaaaaaaccttaccaaaattttggcaggatttcttatataattatcaaattttggtagcaaactaaatgtagccacttttttttgcaactttaccaaaatttgataaggttaaaaatagcatcaaagtgaacagacccgaactttttgacaagacgctgtaaagaatattaactgaaatgttcagtcttcagatagaaatggaacagtattaaaaaaaacagaaccggtcgaagttgatcaagacactgtaaagaatattaactgaaatgttcagttttcagatagaaatggaacagtataaaaaataaacagatccggttgaagttcatcagtagtttaggacttcttccgtttaacaatgcaagactttctgcaattgccctgtactaattttgatctaagaaaattacgcgatatgggtgatggcgccctgttccttatcctaacctagcacatttgagtaaactaatctcggaggcttagcgtctaacaccaaaacacacggattctgtcgcgagatactcaactcgcgcacatggctctacccccttgtcggcgcgcacgacgaaccagacgggctgcgggattgctgttgccgtcgttgttagcttacccgagagcggggatggaggcggcggagcagggtgagatcgcggcggagagagcggcgcgagcccacgggaggcgcaccggagggagcagcggcggcgggagcggcggtggcgatcgatcacatgggggggaagagacgggcgacgctaacctaccaagcgacggccacgtcgcggatggtggaaagggaggcaggggttgggccttgggcgcgtcgtgtgggctgcgggcagtaaaggcccatggggctgaactaccggatgggctgctagtcgtgggctcgaagcaatttttgtaggaataagttcatctgaggtcccttaacttgtcaacgagtccgattttcgtacttcaaccataaaaccagatacaacagatccctcaactgtcaaaaccggtgcaatataggtctcatggcggtttggacggcggttttagctgacgtggcgcctacgtggcaaagttgacccggtcttcatctgacgtggcattgatgtggcattgacatggcaatttaatttgtaaaataataaaaactgtgaccccacatgtcatgttcactaaaagaatgaattaaaaatggtggggcccacgtgggccccacatgtcattctcaccccctcctctctctctcccctctcctctctccagcctccaggcgccacgggaggtcaaggggaggtccggcgggggcggccggtaacgcgacggcgggaacgctgggggaggggctccgcgcgcggggcgcctcccgccccgagaagctgctcctcatcttcgcccgcagcgtcggtgcagaccccacgcgttgactcgaggaagagttcgaggccatggcgccgcccgtctccgacgagatggagctcgcgccctgtacttgtcaaagtcgacggcggcgatgaagaggaggaggtggagtagtggtggtgatggcggcggggagtagcagctgcagcagcggcgccgattcttctccacgtcgttgtgctccatcttgctactgctgctgctggtgtggcagctgcctgctgcttttgtgcttgtgcttttcttcctgctcttcatctcaccaattgcttcttcctttgagtcatttaaattctcaactttcaaggacgcaggcaaaagtacgtttcttgatctcagcttctcttaatcgtgaataagtgagcgaattaaagagaagggatggatggacctagaataaaatggagcgagtagcagttgggttacggctacacgagaaaggggagggatgaagagctggggatggatggagacgaggagcagcttctcgaggcgggcgcgccccgcgcgcggagcccctccccccagcgctcccgtcgccgcgtgatggcggggttgtcgcaggcgttcccggctatcgggctgaacgagctgtgctacaaggagtcgc

SEQ ID NO: 58362 - DNA, 9894 bp, Oryza sativa
ccgcctttttgcctctccgtgcgcgctcgccggcgaggaaggatggccgggagggagaaagaaggaggcgccggtcgttcctctctcgtcgtccgtcgatagagatgatgggtcccactatttgtttttctttcgtccgactgacatgtgggccccacattttgtttttatttcaattttttttattttgctcctagtgccacgtcaccgccacataggatgaggaccaagtcaaaccagccacgtagacgccacatctgccaaaaccaccatcaaaaccgctgagagacctactttgcaccggttttgatagttgagggagccgttgtatctggttttctggttgaaggatgaaaatcggattcgttgacaagttaagggatctcaagtgaacttattccatttttgtacaacactatactactacttcctccgtcccataaaaagacaattctgacacatcctatttctatgaatatggacatatctctgtttagattctttgtaataggatgtgtcgcattcagctttagattcattttttggggacaaaaggagtagatgataactttttaacacaatatatacacatgctcgtataaaacgcgtgcacactcacccacacagataccatatctttataagcacctttaatgactaataaagcggcatattttgagattcacgaactttgcccccgtgagcacctatcgtagattaagccgacatattttgaaattcactcagtcatcacacactcagtcatcacaagtatatctcactactcatgagtaggtcacttatcactaaaagaataattagttgtaaatgtgagcttatatgctaaatttaaaacttaaatctgggtgaacatattccaccacaagaacacatgctgaaaacttaatgaatagaaattaagtctcattttatttatagttcaaaagtaattcaaatgtttcctcataggatccctatttattttttctttacatcattatattgtctatatagttattttgaagtaatttcgtctatatctaatccaaaaggaaatttgcacagtataacatcagggcatgtttgcgcgcctaaatttagttatgaagcatcttaaacccaactcaatggctctagcttattttgtaatatcacttcagtctgcttcattcccttttaaacgaagttaaaactatttggttaaacttaagctatactaaataggccctgagcgtaaaaaaaaaaacttagctgtgctcatctagagctctatttgttttttgagaaaaacaataatgttttaagaaaggctgtgtttagttcaagccaaaaatgtaagtttggttgaaattagaacgatgtgatataaaagttgaaaatttgtgtgtgtagaaaagttttgatgtgatggaaaagttggaagtttgaaaaaaaaagtttgaaacttttgcttttagtggttaaaaaaagcaattatttaaccaaccgccggatctgagatgaacaactcagatcgaactcccaaaacctcttctgcggcggccgctttcgttagtcatcgccggccttccaaatgccgtcctccccgtggatccccaccgccggcgctccgccgccgcgggcagcgccggccgtggtctactcctggctgtcggagcgccaccctgtcaaggtatcgtgccttcccctctcggaccagcggtaatctcccttcgtctcgccgccccagctcgctgaacctaacacctagggtttctcgtctcacccgcgcaggaggcaggagcaggagcaggcgcttccaacgcgcaggagtccaggccccgcgtttctccggcggagaactcgtaaaatgcctcttgcatgcccctctccccacctttttcttggccgtttctgattttctgcaatgcgtgctttgtgtttgttatatttttttgaggtaattgtgtttgttatattgtcgccacgaatgattatctctgcaatttagatatttcagtaagcgaatgtgagcgcaagaaccagccattgtattagcttcgagccttcgagtcgatagtgctggtcttttgcttaattgctcgtctgtgacacggatgaagtgggcagtagttggttcatggttgatgtggtcgacttattgcttggaacatattggcaataagcaagatgaagtacaacagttttacctgcataattcgttatcttgtgcaagcacctgggtgtggtacttgaaatcttgaacaatgctgtgaacaagaaggaatggttaataatgatgcttttcatctggttagagaaaatagaaatgtgttgagttcaaaataaaataggggttacataaaaaaaatgggggcgacctactttttttctgaacagaaatcacctcccttccaaatcagtttggtctatctggtcctctactgataactgccttctaaattcccatttccacctctcctctgaccacatcccattgacagtcctccccttcttcctgcttatgctatataacttgggaaacaacactttcagaggcactgctccacaccacacatcatcccagaattgggcatgattcccattcccaacctctctcacaactaacttacttacccactgattgcaaaccccacaagcagagcccctggccttgattttttgtattttgttttcaatagtaaccaactttatttgatctgctaaaatgaaaatgcatgtttccaattccaacaattgtgttgaattgttttgtatatcttcttcttggtcaaatgatttggagttgtgaacctgtatattcttaatttgtagttaagttcctgattagtgacctgggcaaataatggattcatatagtaaacattattgtattactttgcatagtgaagtggaaacccgagagcatgaagagaaggtcaacaaatatcaggctgtccttgcagctcgtttgaaggccaaatacttttctggcaaggcttttggtaaaggtaccagtgcactccaatcttatgacaatagtatggcatggcatattatggtttacagaagatttgcttgtttgttcaggcagtcagatatctgcctggttagattatcttttttttttttaaaaaaaactttgatatctaatagatcatttcctgcatgttagcttagaagaaagctcaactgtatggttcaacaattgacatggaatcttcaaatggtctgagtcatgatccactaaatcaacaaacacaattagtctgtgtcatgttttggccttgagatgcaacctgtcattactaaaagatatttatattattgaatccaagatatgctaagttgactatcctaacaatcatctcgaagaaatgcattaatatgccttccttactttgtaaggatagccagtgaccagatgtggtagtagagtttgcctttttgttttcttactaatgaattaacttcaagtgatagtttttttccccgtattgacaatgattttttttttaacgtttcaccatttggtggacagaaaatgtgtttgaagaaatgactatccagtctgagaccattctgttaagcaggtgagttgtcttcgctatttgtgtgtttttccaatattgttctaaaatttcatcataagaaccattttccttttgtttcctaggtgcccgttttcaagtttatttgcagatccagcaaaattttgccgggagaagagctgtactaaagaggacatttatccatctttgacaaatgcctcctttgccaagcataaccatttatctctagttcgtgaagactcgtcgaagtaattagcggacagtttgtctgcagaaaactcttaacacctgccaagtggcacctgtctatcaataccacctaatggatgagggttgggtagttacattattaactacatatgttatccttaaactaaatgaactgaaacatgtaaaatatcaacaggcctaatttaacttgagagtttagtttcttcttgtaggcctgttgagcatatagatagctatgaacttaactctatgcaaaacaatgctcatattgagattattcctctagggggatgtctccaacattttacctgtcaccatagtactcacatgcatgatctttgcatatttttttattgttccttttctacagagtgctgttattttgtagggtactagtatcttgaactttctatattccgtttgtagtaccaacattccagggcctccattgccgattattccggtgcatctgtcaacatacatggcaagcttcatctgcaagtgcccctggaatcatggtggacagatgtatgaccaaacacacctgaactgcatctgcagccattcttatcttcgtgcaactgtacctgctaacctgcaccaggtaaaatagctcctatgagcgacggtttgttgaggtgctcttgtactttccagttgtttcctcatatttgcaaaagagatctccattgccaccaccgtgagacattgcatggtgcactggtgcttcttccaccgtgcgccgcacaagggcaggggccatgcccttttaaccactgtttgcttgggtcctgcgatgtgagcgtccaactatggtggggcctttctccctcaggttcacacgtagtaccctggactggacatcctttggctgataccgcacttgcaatggcaaatgcatcaccggtctctagatttgttttttttagttctgatctggtgcacagctgccgttcctatcttcagcaacacaatttgcaatagaaatgtacctccttttcttttcctttactgtggaaaatgagttaatatatgtacgacatcctatgttaatatttgatattgggattctgtgagatcctgcacatctttgagaccgaaatgtttgtgtgaaattcatgtctgcataaacctcaaaaaatgtaagtcgacatcatgttcaattatatatatatatatatatatatatatatatatatatgctatgtttttgaatttgctcgtttgttttgatgaacactcacgtttatgtattgacaaaagcctagatttgtttcgtggcacatgttgccgggcttgtccttaagattctttggaatcctattcgataagcatctcaatgaataggaatatgtggttcagatcttgatgggaacattcatataggagtaccaaaattgtttgatacacatccagaaccttgtttgatacaactaggtaaaatagctaatgaactacagaacagagcagcagcagttgggttattatgggtaacttaacatcaagaaagtatgccatccattagcaatcccaaagcataatccattacaagttagttgaaccccgtgacatcattacatgaaaggcactattttttttaacttcatagttgcacaacgttttgacaagtagtctactacttttagagttgtacatgcctcttctaccccatcattttgtcttactagtgttctattaactgcagttttgcaacttgtaaatagaaataatatatatgatccattgatccatgttaatttaaccgcaggtataagtatataattagttgtaaaaatacacagcaaaaacctcctcgaaacagaaaaatcgatctcatggcgcatgcatgcatgcatgcctccatccccagtaattatccttgtttagttatacacgttttcttattgataaacatattattgttaatattattatcctctcaagtgaaaatttggtggataataataataataatgaataatataattcattcagcagcggtagtcgtagtgctgttcttgcatggctccgaggagcagctactctggtcgtcggcggcgttcttctccggcgccggctgccgcgggagcagcagctggagcttgccggcgagctcggccttctcgtcccggaggcgggagttctcgcggcggacgtcggcgcagcccctcaatgcgcggttgagctcgtcgaggaggcggcggttggcgccgcggaggtgctcgacctgcgcccacagctcgctgagctgccgctgcttgcgcatccgcgaccgccgcgccgactcccggttcgacaccatccgccgccgccgccgctcctcctccgccgccggagccacgccctgcaggccgtagcagcacccgtcggagcccgagctcggtgagccattgccgccgccgccgcccgcggcggccgcttcttccaggatgcgctccagctcaaacaccgccaacgcggcggtggcgtcgtcgccggcggcgagcgcagcagtggcttcttggaacggcggcggcggcgcggcggggacgaagtaggcctgaggcggcagcgccatgttgatgaggccgtggtggtggtggtggtggtgcgcggcggcgccgaagaagggagggtttggaggcgagaggaggtggaggctcgccacctcgccatggccgccatggtggtggtggtacatgatcgatcttgctctttgtctcttcttggctaattaaagctaattaaggttagcttatgatcactagctttgtagtagctaggtgtggtttggtcgagtgattgtgttttttttggctatggtgtgtgtgtgatcggatgaggagaaactgggttggtgatggcccttttatagtgtgccacagtgtagcttagctttggatgattcctttccatccctctccttgagtgagagagagagagaagactttagttcggtccaccgtattgaatttttattgatttgggccgagtttagttccaaactttttcttcaagattttaactttttcatcacattaaaactttcctacacacgtaaactttcaatttttccatcgcatcgtttcaatttcaacaaaacttctaattttgacgtgaactaaacacacccttggatcttgttgagctacattttcttctgaaaagactgttttgttagagttttgctttaccgtttctcgatctctctactagacgacaggggtggaacctggaaattctcaagtaaagggttgagttataacatgaccttaaatatttttcacgaattacatggtgttttcataagattttaatgggattatgaagctaggcctaggccgggcttaagcctaattaagtgccgtaggctggcctgtctctgcccctgctagatgtaaatttatataatcatgattaataagtaggcttaataatgtaaaaacatgcaacggacacgtacaaatacgattaagtaggcttaatgtaataaaacatgaacggacacgtataaatatgagttttgtctatttagttttttttcaaaacatattctacaaaataatggagttcccctaaatttaatttgttcagacatcatgatataagctcagtaagtcagaagtatcatgcacgaaggtgcatagattattgaaaacaccagaatgtacgtatatggctaatatattagtccatgcgagtagggcgatgaattaatcaagctaacttgacaaaaatgcaagggtggcatgtggtgaaatgatatagatcacctccacatttgtgtactttgtgtagggtttgggcattttgtatagccaaaggagatactaatggagaaatgatctttgctgtgtcatgcaaaaatcacattactcctggtttgagtagtgcgggactaaagaatatctttagtcctggttcaaaagccaggggtactttttgatctttagtctcaattggtaacaccaaccgagactaaagattatttttagtcccgattaaaaatgttattaggcatgtgtcgggcctcaaccatctttagttccggttgttaaataaccagacttgaaaaatagaaaatagcgcacgggagagagagagagcgcgcgccacacgttcgcgcccttaccctttttctctccctctctccttaagatctcctgcgctcccctctccagcccctgttttcctctcccactgtccttatctctggatcccctcttctcctctcctcctgatcccctctctccttggcaagccggtgatgaggaagggcggcagctgcgtccccaacaagaagcggtagccgccggccaacaccgtcattgttgtcgtcccggtaatcgtggcggtggcagacttggaggaggccaatgggcggcgggcgtgaggtgacccacggtaggcggtgggcggcggcccatggggggcagcgggcgggatgcggcgggcggccctctcctctgctggagggcctcggcaggcggcaacgccagaatttgtgattcattggatttgtgatgtaccttttttttttagaatttgtgatgttgttactttgatttggggatgtagggagcaactcgatttgtaatcaaaatgcaagcaacaaaaatacaatgaaaaaaataaaagaaaaaagtcctagttagtaacaccaaccgggccacatagcgctactatatatctttagtcccaattatattttgaccgggactaagatgaacatgggattcgggactaaagatgaacttcatctttagtcccggattcggggtcccggtttgcaacccgggaccggggttgcgaaccgagagtaaagatggggtttccagctgtgagaggggtatagctaggtttgccatttgtccatatttgttgcaagatttactatcaacaccaatatgtgtgatatttgcagttgagataaaatatttctaaggatgtaggtcggatttttagcttttttgcccctagacatgtataccatttgccaaattccgattcacgacgaattagttccacgcgaaaactagatatgcatatcatctttagccggcgttaacgtgccgatgtattgtcttatcatggtattggtatatatacttggtgcaagcatcagggcatgtgacacacatctcatccctttcacatatgtctgccaaagtgccaagtcatcttaacatatgtttaatcagctaaagtacgttgctcatgagttcaatatcgatcagctagctccttcatgcaactattagggtctggtagttactatatctatcccaaaaataagttaattttctatccatttagttactctcgattttcacaattcacgaagttttatcccttcaacacccttcactatccacccactggtacaatgactttcctattaataagggatgtattgggtccccccctcctctctctatatatatagtaatttgtatctcacttgccaagaatgatcttatttagggactaagggaaataagttttagtattgatcaaattctcaaacgtttaatgaattatagcaataggaaaagtttaatgcatgtaggtcatcttaaaaaaaaatcataatagataatgcacgtggctcatatatatagatcccttctccaagttatagctgatacctggatggttttattttatgattagcgtgacttgactcaagtcagtctctcatcgcgaaatgaattcaagtatatatccatgccaaactctagcttttacacattctcctactcagataccttgctttcggttgccaactcttaattgaacattgttcatggatcgagcataaatctttctgctagccagtaaattcacaggcttgcggataggcaccatgagattaattaaacaaagcaagaataggagcaaccagagagcaaaacggcgtcggattgtgccttttcacgcaccaacatcatatccatgctgcccactgcattttggctgagtgcacttggtgtagaagccggatgctttcatgtacttaatgaaatgccctttatccgaaaaagaagtgtacattaaggcctattttggaatattagctcaattcttgtaaaattccatttaaattcctccatatgaagtggagttccaaaaa

SEQ ID NO: 58363 - DNA, 2069 bp, Oryza sativa
gagtattccaagggtatcaaacatgaggaacatacagccatttgatctccttgcttaaatctttagagtcagattaccataactccttccctcggcacatcagccctagatccacccacgtcattgccatgtcatctatctctatacacgtgtcaccacgaggcatccacgccagccgacccatcatacaccgagtccaccaaaacctgagccactaatcagtgggccccactataattttcttattaaaaataattcaatttaaagaattaatatccataggatattcctggaatattccttttctttctgtcattagattttctctgaatttgaacttctcgaggtcttaacttatccgttcgaacttcgattttgtcagggttacgggtcaggcataccctctacccctcgacatacgtcacgtattgacaaggcctattcacatgtgcacggataaatcctttggcgtctaaggaaactcttcgtaaagtcaatggacgaagagagacctcctcggacaagaattgggttacctacgtatcgtgccaggtctggtatgttcgagtcctactcggagagcacccaacctacggtataaaagggaccccccggggagggcatagatcatcgaatctcagagccaacacaacccacacagcctacgaagtcggagcctgcaaggagccaagtcgacgagagctagtcgaatcatctcgactacaatctcgccaaatcccctgagttccgtcttttcctttgtaatctgtgttttccaccatataatcccatatcaactagattagggctattacctatcaaggagcctgaaccagtataattcttgtcttttgattgctcgatgtcgtactacgtagatccttataccagcgtaccccaataccctctatatccggtctacgggtatcccccgtcgacagatttgacatgctcttctttctaaattctaggggtaaaaacatatcagatattatctggtcctatccgcttcgaatccatctgaaacgatgatatggtatgagtttttagaaatccgatggatatggatgcagatgcggacaagatatctctaaaatacaacagatgcggactatccgataggctatttgccgcataatccgaaattatcaacttatgtaaccattcaatctgttgcatataacatgagttggcacatctaatggcccaattcatcaattaacctagattcgttagtccagggctttcaccgtctaactaacacttgcttagttgttttttatattgtggatatcatgtattcatgttatttagtacttaagtacataattattacgatggtccgttcattgattattgcgttgttgtcctttgcattgctaactcaatggtgtattgcttgcatacacacatagcatctgacaaatttaatcagtttccgaactgagtccacaccaattccgacatccaaaacaatccgttctacatccgcatccactctgaatccgcttaaaataccactatccatccgaatccgctccatttttacccctactaaattcttgtaaaatcgagctcaaattcctggttcattggtttattttatttgatgttatttagttagtcttttcttttgtttatttgtttttcgtttgtgattgtgtagacgttggagtacaggagtggttcgctgcagaaggcacaatgcaggaatgatacttggaggaaggcaagtgaacatattggacccaatttataaatatttttttgaacacatgcattcttttatttatatgctatcgatgggtagggtgacctaattgctattataccttgccttttataattattgattacctatgataccttgtcatcctagtttttctgagttgaacattgggctcatttcaaggtagagtagttatgtttagctctgctcaaggttgttttgaagcaaaatataattttgattaatcatatatttataattatttgtatatgaaccgtgtgactgtgaactatcttttcgatagcacgtgttgttgtgtaataaacaacgggcggataaa

SEQ ID NO: 58364 - DNA, 833 bp, Oryza sativa
ctgaatttaggcggttccaaaaacaaaaatttctatgctataacatcgaatgtttgatacatgcatagagtatttaatgtaggcaaaaagaaaaaatcattacacatattgcatataaattgcgggacggatattttaagcctaattgtatcatgatttgacaatatggtgctacagtaaatatttgctaatgacggattaattaggcttaataaattgttttgcagtttcctgacggaatctataatttattttgttattaggctacatttaatattttaaatatgtgtccgtatatccgatctaacaaccaaacccaaaaattttccccaactaaacaagcccttaggtggtgtttggatccagcgacttaattttagtctctgtatttagacactaatttagagtattaaatatagactacttacaaaactaattacataaatgaaagctaatttgcgagacaagtttttaagcctaattaatccataattagagaatgtttactgtagtatcacataggctaatcatggattaattaggctcaatagattcgtctcgtgaattagtctaagataatggatgggttttattaatagtctacgtttaatatttataattagtgtccaaacatccgatgtgatagggacttaaacacgttgaacggtactcccttcctcctaaaatagaaggaattttgggtgatgtgacatactatcctataccttataaatctgaacgcaaatcctttatattttgaggcggagaaagtattactaattagtactaatatttcgttgcggcaacatactgacatgtacatacgcagcccg

SEQ ID NO: 58365 - DNA, 2324 bp, Oryza sativa
attattggtatatgaaccgtgtgactgtgtactatcttttcgatagcacgtgttgttgtgtaataaacaacgggcggataaaacgttttggatcagggtgatgggtggttatgtgtgaacctgggttcggtggtaatgtacctatgtgatcattaccgggtatggtatatgtgtgagcctactgtcaagctgtgtgctatttagttgctcaaagtgacaactgtgtgtccttaattataaatatatgatactaccaatgtcgtgtgctattgtagtttggtaagttgccctatcaattgaggacttcacttcataagccatttatgtgagcctaccatacaaccatttgttcttatgagaataacctgaactagtatgattccgagtcttggcactactactggcagtaactagatgataggtgtgaaggttacccataggtagtttcttgtctgctgtgtgagggaaagctgtctcattgggggaaagcagtgttggggcggagtgtctaaagagcctccttacatattccttggctgcacataacctcaagtgtgacacttgcgcattgccgttaaaaggatgatgtatcttatgggtcaagctgtacaatatctgttgagtgttaaactaatctattcgaatagctgcgtcagtggtcatggacatgcttggtgatttctcatgaggggcagtttgtgaaaaccaggaatgagctgtgtgctggttaatgaatatagctatatggtcttgtgcagatagatcatgtgtcgatgaatggttggtagcacctgttatttataaatgttgttttaaatctattcataatttgtttataactaaaaattgttgtttatgcgaaatagccattgccttctttgttagccatgcatatgcatatttctgtgtacttgttgagtattctagaatatactcaccttgtaatgcccccaattatagaacaaatgtttttattgtttcctgaagagtttgctgctgaagacgaggaataggttgtgtgtcacaattgactacatgtggcaagttgaatggagcttctacgtatttatcttattttcactgctactttattatattcctaggtccttcgtagcagaataaatttaaactgtagacataatcttatcgtagtcattttattaataaccgttaggtttcttttgtgatgttggctgtgatattatctgtgtctacgtgtgctagcctgattctggagtagcacttaagtggtcctattttgggtcttcataaagttggtattatattagagccgcatcgactgtaggccgtacccttatttagactggtcttactatagccagcgacgaggacgatggcagctcggtgcacaagaagttgctcctctccaaggagcagtccacgtcggtggagagagacatagatagatagatagatagatagatagatagatagagatggatgcagcgacgatggcagtgcggatggatgcggtgctccgcgtcgggctcggggcacctgggtggagagagagatgggtgcagcggtggcggcagtgcggatggatgtcatgctccacgttgggcttggggcacctaggtggtgagagagagatggatgcagtgggagtggcagtgccgatggatgcggcagtgttgatagtgcggacgaatgtggcgctctaggtcgggctcagggcacctgggtggcagcgcagatgaaagcggtactctagttcgacctcagggcagagagagagagagagagcgcggtggagtggaggggaagagcagtgctgacagcagcgtccattcacgcgacggcgacagagtggagattatggaaactggggagcttgacggctcgaccgagacggaagcggcggattggagaggatgtgaacaaagcggcggcgagtctacatggcagcggctatgctactggccagcgtggcttcgacccctctctctgcacatccctaacggtgcagatatcggagttttcttgcgacggtgccgtgcggctcacaaaatgcagcagatgggaggagtagtggaggcccacgacgtcactgattcggaaccggtacagcccacggaacatggcggcgatcagctcgtacgttttgctggtctcgatgatgtgatatccaccggctctgctgtggcggcgtgacggccagcatccatgtcaaacggggtgaactcgaattaggctgctgtgggaagcacgtagagtatagatggtttcctccagcggtgatgtgcactctaggttgatgccgatggcacactcagaggcgaggtagtccgtgccgagcacca

SEQ ID NO: 58366 - DNA, 1231 bp, Oryza sativa
cataaaatgcagcagatgggaggagtagtggaggcccacgacgtcactgattcggaaccggtacagcccacggaacatggcggcgatcagctcgtacgttttgctggtctcgatgatgtgatatccaccggctctgctgtggcggcgtgacggccagcatccatgtcaaacggggtgaactcgaattaggctgctgtgggaagcacgtagagtatagatggtttcctccagcggtgatgtgcactctaggttgatgccgatggcacactcagaggcgaggtagtccgtgccgagcaccagcaaggcctcgccgacgaagtgcttgatcaccaggaagtcgatcgcagagctgccgccacttggagcgatagaggcgcacaacacgcaccagggtggctgcgtacggcgtgcgaatgcagataacggtgtcccacgaatttttttttattttttagacctttttttaaattttattaatataccttttcaatatttccaaaaattaaaccttttgatagcgttgtcctgccatgccagatgcgcgtgacgccatgccagatgcgcgtgacgtgatagagttatttggccatgccagatgggctggcgtggccaaaagttcagatttagaaataccttttagaatggtctattaataaaattttaaaaataaaaagtataaaaaataaaaaaatttcgtgtcccaccggccaagcccgcagaggaggtggtaatacctttgctccttcgccgcctcctctccccactccaccatgctttcgccttttctcagcaagttctcgccagtgaccaccactgatgccaacagaaatgtattggactgaaatgccccgacatgtgggtctaactcagttgccatgttagctaaaatctggttcgtaacttaacaaaaagggggacctcaggtaaactttttccaatgttggagacataaattgactttcctcctagactagaaaattaataagcacgccgtatgacgcgctttatttataggctgtctatttctggatatgtttatattgtacatttaactctattttttatgtttgcgtttaaatctgcatttgatcgttaatcttgttaaaaaaatatattgttataatttattttttttatttatattgttactaatgttattttgaatatgactatatgtttatatatttgcataaaaatcttaaataagatgaatggtcagacatatattcaa

SEQ ID NO: 58367 - DNA, 689 bp, Oryza sativa
agggcgatctccaccacgtcctgttcctcgccggcctgtctccactccacgtccggctccacctcttcgtacactcgccgttgttccatcgccgccgccgccgctcgccggagttcgatgtgtacacgtcaactaagcttgcttttgtgacagcgacgtgttgtaataaacattatattacactttatatagatgcatgcaaatgtgttgtgagaatggaattagatagatagcttggattggttgatggagatggcaggagcatatgcaatgcaacctgggttaggttagctaagctaattaaggtagccatggatggagatggagtgagcttgacgccatgggtgacctccttccttggggcaaggacatatgcttctttgcttccaggggcggatccaacgtgaatgtaggggggactcatggataccccggagcaccccttcgattttttccccataaatgataaactaaaggtccctaaatagctggatattgaagaaactgtgtaattgagcccccccccaattttttttttcctggatccgcccctgtttgcttccttcatggcagatttttttttttttttgctacacctggtgtattggatcttgggtaataccaaaagttcatcatagttgggccaattgggccgcctatatgcttttcaggaatttcagcctatatgt

SEQ ID NO: 58368 - DNA, 3498 bp, Oryza sativa
  unsure (1)..(3498): unsure at all n locations
attcaaatatcaacggtgtctaactcaaggaataaaataattaatttatgctaatcttgtttatgacaatttattgtacttttcaataacatttttaaaattgatggtttcaaaagtaatactacaaaataagcatatttttattgcctatatgcattaaagagagaagttagtgtatatgagtttgaaagacgactgtattcgttctttctggttcctagctccccgcctcgtttttcacgtgcacgcttcccaaactgctaaacggtgtgttttttataaaaagtttctacacaaaaattgcttaaaaatcatattgacctatttttgaaaaaaaattagctaatacttaggtccggttcttttctccaacaagagttggatgaagattaagattttcgttgcacgcttttcaaactggtaaacggtacatttcgtgcaaaaactttctatatgaaagttgctctaaaatatcatactccctcagtcccataatataagggattttgagtttttgtttgtattgtttgaccactcgtcttattcaaaaaatttgtgcaaatatacaagacgaaaagttgtgcttaaagtactttgggtaataaagtaaatcaaaaaaaataataattccaaaattttttgaataagncgagtggtcaaacagtacaaacataaattcaaaatctcttatattatgggacggagtgagtattaatctatttttcaagtttgtaataattaaaacacaatcaatcatatgttagtaccgtaaaaaacttaatcttcatcttcaggagaaaagaacaccaccttaattaatcatgtgctaatagatcgtttcgttttctgtgcacacggttccagatggaacctccagcaacaaacagatcgttaagtggctaaaaagagtgctaactcaggggtgtttggatccagggactaaactcatatcggatgaatttggagtattaaatatagactacttataaaactaattacataaatgagagctatttcacgtgacaaattttttaagcctaattaatccataattagcgcatgtttactgtagcatcatataggctaatcatggattaattaggttcaataggttcgtcttgggaattagtccagggttataaaatgggttttattaatagtctatatttaatatttataattagtgtccaaacatccgatgtgggttttagtccgatctaaacagggtctagtgctatggctccttcatgcattccacgtttcattgctctctttctatcgttaccctctctacccagtgaccaactcaccatagctctctatatcgcctatcgtttgggaagtttccacactcccagccatagtgatagcggcatacacggatgcatctagcgcagccgccgctccctcatctcgatcgcccgacggagacctggaccgaggaggtgatcgttggcggcgcatccccgcacgagtgccgactgcgcccgtgcatctcccgactcggctgtattctcctgtccctccacggatccactcccgaagatgcttgcttgctgttgctgaagatacatgctggttggtgctgctaatgcattcttgatgttcttgtgtacctgtatagtgtgtcgtccgtggatccggaagagggaagcattgatgccgttttattttacttttgcaatcactatttttttgttcccctggccttttccttataaactattctgcatttatatttttattcaactgaaattgaaaactaaagaatgtaaattctttgattataaagacgacagatagtttgaagtttttgaatctggatgtggtgcttaaagctctttttttccctctgcatttacctttttctttctttctttaccaggtttatcttcacactttgatctgtccccccggtgaactttttctttttctaaaaaaacaaacttgcctgggagggaagtattttggatttgttgaaccaaaatgtctaggacggatatggtttttttaaaattgcatgtcacactctatttatctggattcatctagtaccacgtacttctttttcctttgtattcgtatgtgcttggccactaacggtactagcagtccgccggcacaagttcaggcagatcaggccgtgtagatcgagccgccatcgccccctcctccttctcatcgcccaaagcaggtgtcaccatgccggtggcagcctacggcactatgagtaggcagatggagatagtaatctattttttcttgcgattgttttctgggatttttttctccaatacttcggacttttctagatgagatcgtacgtttgtaaaaaaccccctatcgaaacttgtaatttccatttaggtccacaggacgggttttcaccgtcgatacgtcatctaacggggctgtggataggtgcgtacacgtggcactttctacagccaagaatcaggaggagagctccacacgagatgctacgtcgctcaattggaagcctgggatcggaccctgaaatcagtttataagatctggcccaacagaataggtggagggtaacggaagggagatgggttgggcttggctagaggtttgagcccgagaaggagatttagacttaagtttatgttttttaatttaggggtattcctttatgggttgagagaattgataatttgattatatttgtaatttaatttattgacgtctctttagccttatggtctccactcagattaaggtggcaattattttctagagttaaataatatttgttgtaattaaatgatatttgttgtattgacaattaatttaactcatggtctcttagtgtcaaattatatgcttgttcaattgtgggcattatatttggattagaagttaaattggcaactaatttctccttatttatactgtataagctctatataattttgtaaattaattcatttcatccccttggtatgattatgggatttagttattcatagctttgttttaagttgaacttccacccaactccagcaaagatcactgcgcatgatccaaaagttctaaaaaaattcaaatttttactgattttttaactgaataggagtattattcagggtgttacagtcaaccggactcttggatcagcgttcgctctgcacaggctcctatgtaccggggggactcaagaccacaatcaacgtcgtgatgcgtgagctgatggcttttgatgggctcggctgatatttttcatcagtgaatctatggggttgtttggtttaattctttcatccatactttagaccgccaaacctccataactatgtttttgctaattatcatagttgtaaattaacacattttttaagcaccttgctttacatatcatagatttaatcttttacctaactttaccacaaatacaacttacaatctataggaaaaaaaaatatgacaagccacacttttctaaaataagttataacaatgttagttgagaactaa

SEQ ID NO: 58369 - DNA, 4149 bp, Oryza sativa
ttagtccctgtctttagacactaatttagagtattaaatatagactacttacaaaactaattacataaataaaagctaattcacgagataaattttttaagcctaattaatctataattagagaatgtttactgtagcatcacataggctaatcatggattaattaggctcattagattcgtctcgcaaattagtccaagattatggatgggttttattaatagtctacgtttaatatttataattaatttttaaacatccgatgtgatagggacttaaaagttttagtcccatctaaacagggcctaagatacaacatcatcccccaccaattattctttttattttattcacgaatgcgaaaaaaaattgcacgtcaatatattagagaagaaatcagagatttgattaggggcaattgtatctgtgcccccgctttcgaagccaattgctattttacccttattttttagggtttacagttttacccttactttttgaatctgaagcagccgtgtacccctgtttcaaacagcaggttctaacggtgttagttgtagagaaaatgacatttatacccttagtggttatagcattttttgcccccatttttttcaactgtgtatgatttttccccctattttgtgactttagcttgtaaataattcaaatatgagcatctcttgtgatgtttttgtattttaacccaaaaaaatcacaaatactagacaattacgaaatatgaccaaaatttgaataaaatttcgacaacattttaatagaattttgacacaaactagcctcagccaaattaattcaatctgaagcgaaaacaaaaccaaatcaaagctaaaatatcacacgctgaaattaattccggacatcataaatcttcaaccagccgccttccatccaccccaatcgccacgtctaactccacaattatgcagtaaactcctaaagtgcaaaaccaccagtagcatcatcctgaactggaactttatgagcggaaaagaagcacttggccagctcgaagattccagcgacgtcgtcgagcgctagctgctcgtcctccaccgctgggaggcgaccgtcaggcgccgctgccggcgcagcgttgcccggcatgagcgcgggaaggtggtgcgaaaccggtcgccctcgccgccgccgcgacggccgccggctactccgcgcgcctgggagcggccgttgccgccgcctggctactgccccgtcggagcgccgcgcgagcccccgtccttgcagccgctgccgcgccgcgcgcacgccctcgccgctgctgccctgccacgcgccgccgataggtttcgggttgggaggagagggattcaatctccaattctctatccattcactgaggggtacaaaggtaaattcatatttcatgaaatcttttttttattttcttttgtatttctttaacccaaaatgcgggacccacctaacggatgttagaagtgagggcatacggctggttcagatttaaaaagtggggtaatactgcaaaccctaacaaataagggtaaaacagtagttaagtttgaaagtgggggcatagatgcaattatcccttttgattacacaacgtaaacgaccagaaaaccattgccaggggacaagaagaaaattggaaaggaaaagactgtaaaaggaagaaaaaccctccttaaagaaaaaaaaactcctattaattatttttttacataccactatcttataatcctcataaaattttagtgtagcagaaattaatttcagagaaacgtatttatccatgtgatttttacgcatgtccaatttaactattccttctgtttcaaatcattctagatctatatactgaatcaaacgttctaatttgtatcatcaataatttcttaaaactcaaatagtttagtgtcatgagaaatatttcatgatatataatttacttgttgaactacatggatttctaaaaattgatggtcaaaagataaagataagacgtgtgatttaggacaaatgtaaaatgtgaaacggatggagtacttaaaaagatgaatattaatatgtaaataagagttcttactagttcttaagaaaataatgttgacaaaatgtgaccacacactcacgtccaaaaacacacacagaaatgattgtgataaagagaaaggcgccatggatacacacagcacttctttgttggaagctagcgaagcaaatggatatggacacctcaacgaactgacccgtacgcccgcacgtagtacggggattttttttaacttttaattttatttattaaaatatataaaaatagttttttggttttaaagtattacaaatcaaccccttaccgttctttaggagtttttttccaaaaaaaaagcgccctccaaataattttttttataacgtgacacatgtccattgatatattgtaatggtcatgaggaagaaaagtggcacttcacgggcaacccccaccctctaaaatagcgacctacaatattttgcagacggtctccttatagccctctaggatgacgttaaggggttgcctataaatggctaaccctgattattttacaggcgaatcgcttgtagccttccgagagagcgagaagggggttgccaacaaaatggtcgaccactcttcatgcggcggttagcatgagccaataaccgtgtgccacgttattttttaaaaacgcactcccaaaaagcgttagggttgtagatttttaaaactttgaaaccaaaagttatttgtttaaaatattttaataagtaaaaacaaaaaaatttaaagaattccgtagcactgtagcccatttttgatatggccaaggcccacatagcaacgcatatgcatcattcatgggcctccatttctagtgggtttcatgggcttctctttttttcctcggccgaaggcgaagcgttcttttcccctttgggacgcgggattccctcgccgccgccgccgccgccgccgccgccgccggagtgaccacctcgctcgccggcggactcgattggctcaccggcggcgacggaggaggaggaggcatctgcggcgttcggcgcgaccccggagatggaggggttcctctgcgaccgcctgctcgacgcggcgcagcccatcgccgagcgcttccgggcgctcttctccctccgcaacctccgcgggacgcccctcgccgcgccctcctccaaggtctccccctcgtcggctcacccgcttacttgtctccttatgcagcagctttggtttccaccgtgatatgattcaaggtctcagtagcttgccgacttggtgtcagtactcagcgatcgacgacgtagcatagttagctgccatctttcttctaatttgctttcgttgatcgagctagtttgatgcgattcgaggttgtgaagatgcaattagctgtctgtgtgctggtagactggtagcatttcttcggtatatggtggcaagtattactgtcatgccttgtagtttggtaccaaattcccaattcagtaatccatctcgcattcttgctcaggcgttgatctgacaaagttactttatatttcctttcttgtactagttaattctgtgctaatttatgctctcttatgatttatgaatcatccttgaagtctgaaaacagtgtttaacattgaactgagaatgattgtttatgtttctactgtcatatagagctgttagatccaattgcctgtcaatgttttgttaatgaacgggcttaagaatacctgatgtgtttgctgcaatgctcagctgcaagggactcttcaaacttgcttgcccatgaggctgcatttgcactaggacaaatgcaagatgctgaggctatccctgcattagaggcagttctcaaagatctttcacttcatccaattgtccgacacgaggtaattgctacgacggactaatgccatcttctgcttatagtgatttactttcaattttgagaagctttgtatgtttattcattcattaggctgcggaagcgcttggagctattggcctggaaaagagcatttccctgctggaggagagtttagctgttgatcctgccgtggaagttcaagaaacatgtgagctggctattagacggatagaagata

SEQ ID NO: 58370 - DNA, 2644 bp, Oryza sativa
acgatgtgaagtgttgcaatatgactttttgtcacatccattccgtggcaacatctaaatttattaccacaaaataaaaatcgttacaataacctattaccacgctatttattaccacggctagcaatgattttataattgtggcaacatgtatctattgccacaattttagtattgatgccacgatttttttttggcaacaaatgattttttctagtagtgtatatgaactatagataatggcttcaacaagaatacgaaccaccattgtcatgtacaaccagctaagactagaccttaagatataaaccccaagtcaaattattagcaacaagcaccatctcaaagaagcctctcttagtatgcccccgtcattccgagacagtgtcgtcatatataccttctgaacttagcacaatcacaatcaaccacaaacattacttcatacaaccttctgtagacacgatccctacgaagataatactgcgaaaagccaaaaggcacctggccaaaatccatacatctgtcctatataaagagaaaaaaaaaagaacttgagcatgcaaggacaggctgcacaggccaaagccagcccagataaacttgtgtctgtcaaagggaggagcctaagctgtcgatctgccatacgttttcagcgttatccagtattgcagcagtcagttgaaacgagtttggacgagacatgcaatcatgcaggtcttgggatccatgattaattggcatacgcaaaagcgggatcacctgctaaatctcgttgcacacgattcgccaattcggtcgaagacaaatcgcaccacacacacctttggtccacgctagtttgcgtccaaaatatttgtgatttttgggtggtcaaattagaccgctgtctaatgtcccgggcgtgtagtgtgtgcagaattgtggctggatttgtcagattgcacgtcaaatgttcagcactaatcaagtagtaaacgtcacagcgcaggctgaaatatctatctgacaggagaaaattaacctcataaatcatatcaatttgatccaaatcaacggcgaaacatacaatgttttccacgaggctgatttaggaccgtagtgcatgcaacagcggcagccgccagacaactatgtatattttgtctactaaattattacatctctccatcctaaaatataattatctagggctagataagacatttactagcactacgaatctagatagaatgtttgtttagatttgtggtactaaaaaatacctcattcggtcattggttcttatattttaggacaaagggagtacatatgaacgagtagataaaacgtccacttcgtagtagaaagcgggggaaaaaaatatgctgtatgttatactgcattacagttttcagaaactaaacaataacaaaaattgagacctttcttgacaatggttttcagagcacctttgcaaaagaaatggatgtgtcaagaacatggccaaaatcattgatctctcgatggaaaaagtttatctcttgcatgtagttatctgtcttttgcatggtgaatggtacagggaggatgcagagtttggtctgatcaggtaattcaggggcagggaaaaagagctgggagacctgccgtgagaaaactgcatgccactcactcttaccttttcttttccttctttctttttattttttttgtgtgcgtgcagagaataccataataatccagattcagtggtgcttgtagccaaaaagaaatacaaaaggaaaaaaaaagctgcatcgtccctatctgaacgcactactctgccctcctcaacggtcgtgctgcattttagaacgacgtcaacttgaacagtttcagatgctacgtgtcagccttaatccgatcttgagattaaatctcaatccaattgcaggtttcaggatgacaacaaacccttggttctgtcagagagtaaaaattcagagcaagaaaacctgaaaaacacaaaggtttcatctgaagttctgaaccattgcacatttggccaatttgaatttcaagaaagtttacacacacaaaaaaaaactgtaaacgcattttaagtagggctttatgcacacaagcttttgacagacagatgggggcccctaaatagttggagtacagatttgtcaattccatgagcacttaagcagagagaggatgcaagtgggatgcagtggactgaccatccatgtctgaagctgcagtctatataagcatggaaactactaatgctactacatgaacttatatgtgcatcttagcaaatgagacttcagaaccgagcagatggaaactactatagatgtggcgacatgacgcatctcattcggaatctggactcccccggcatatcaactcccactgatggggagtcttcttctttctccccatcactcatggcatcttgcaacaactttgttttcagaggggggagagagagattgacgtgcatggtgccactcaaagtgccacgaatgtttatttgtggagcgggttattcctgggtatgaaggtgctaaatttggtataatcacgtcatggttagaccgcgaacgagatattaggatgtgtttggttggtgacctcgaaaggttttgatccgcccttgatgctgtct

SEQ ID NO: 58371 - DNA, 842 bp, Oryza sativa
ctcgtcccaagccaacccaggccaaccattgcacattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccataaatagagtgtccactagatggggttttgtttattctagggtgaacaaggtaataataacaata

SEQ ID NO: 58372 - DNA, 11804 bp, Oryza sativa
aaccccaagatttcacgtgagactcttcctcgacgtcgtacaccgatttttcacagggaatcctcctcctgtacagtactccatccgaacaacaacaggaatggtatcgtaaattaaagtagtcgtcttgtaggtaggagtagtggtatacactgtacaatggacaggtacgtacggcgagatcgattaattaatggatcgccatcgaaaaaaaaaaacggtgaatcgatcgatcttgcgcgtatggggagccaagcgatttgctttccgatcgccggatgcgtccaaacgcgctcgtcacctgatcgacctgacctgatgacccttttcacgcactcgatggcgcaccgggatccatacctttttttctcttcttctttttctcgctcacacaccggcgtaaagccgtcggctttgctgattatgccgcttaaattattgccagtttcgccgcggccgattggctcgtttgcgtcgtcgtggttgctgcctcccggaggactcgacgccgattggcccctctccggataagatcatagtaggaggagtatccttctgtctctctctcagataccgtctacactctacatacgcatatgtaacatcccaggagacagacacgaattggctgtgtttgagaagagagaaatagagaagatacgcgacgagataaattattagttataattaattaattaataatcattttaaacttgaaaagggtttaatatgatttttaaagaaacttttctatagattttttttaaaaatatacatcgtttagcagttcggaaaatgtacgtgtgaaaatcgatgttcttttcttatctttgttcaactctcagatgcagccttagatgatcgcgttagaaaaaagaaaaccaatttataaccattcattccttctaaaatataatgatttctgtttagcaaaaataaggtcatggcaaaattcacttttagtcattttaattgtcagtttcttactcttaaattgctcaggccaggttctctttccaaacatctgattggatttgaaattattaaaatgacaaagaatcatgaaaatcagtacataatatttatatcgtggtacaattttttttaaaaaaaatactaataatgtttatgttttagattggaaggaattaatgggtatgttcagctggcaggtacagcagcggcctgctgctagacgctgtttttttttaatgcttgcttcactattccaacatgctgcagcccttgcagccaaacagacccaataccactttgcggcaggtctgccctaggacactgccagtgcatgtcatttcatagtatatatcagcgggtttatgataaccatgaatgattgtatagcaggctaaattagacttgcttgctaattatgtgcaccccaaatgggtccaaaaaggcactgcatatcacacataactaattgaccgtatcggagaaaagtagtctgatgattatgatttatgattaagcttaaaaaagctagtgcaaagaaattaaacagaggcagctaggtgatcatcgtgcatatgcacaccatggtcgatcaccactgaagaacggtgggtgacgcaaaccaactttggcgacgtacgcaatgcacgtcgcattactaaagctgttaattagctagctgctcacgtatgtacgccccggtttgctttagctaattaattctccacaaggtcacggtcgatgtagtgtggatatgtgataccttctctgttttataatataaaactttcttatattgttcatattcaatacattatgaaacggagagagtactgtatcctccgcaagctaattaattctccacgaggagcactgaaatagatacgttgataataacgatgagtaaattgatgatatttttttaacaaatactagttgattgaagtttattcaggctcagaaatttttctaactctgtcactgcctggccttgtgctaatcaaggggccaccgggatcaagctcataattgggggattagtaagtataggttattaatatcgcccggcaccaccgtcaaatcatgggtggactgctggtgtttgcattgcattgcctcccctcccgtcggtttgttaatcctgcgtgtccatcgccgtcgccgtcgcgctcgcgcgctgccgcgtgacgccaccgcgcggcggacgcggtcgggtgctctcatgtgtgtccccgtgtcgaccggaggtggtctccagtttttttttttttcctcttcacactttctgaatttcacaggaaccggactactgggtgcggctggttgcagcctcgcagggacaagggtgtgttttttttgggtgtgtgttcgttcacgacgtcacgtagaaactggattataccctccggtatttgatcgaatacgagttttaaaagaaaatataccagtcacgtataagttgcattacagtataattatactatagttatatctaaaaagttcttaaacataaaaactgtcaaatgttatataactactccctattaagcccatcatcttttggcctcatcttttcgcttgtgcttgtgcttatgcttatcggttaaaatttaattttttaccttaaatttgtagctaattttaaggtttttttcatcgaaatttattttccagtctttgcttttaggtcgctaagaacatgtatataaaaaatttattcacaaattattttttgtttgcaaatatatcatttggcttattccaaaaataagcaaaacaatagggctgttcaacgctcacgatcatagactgacgaacacttccttaaaaaagaaaaacctaagaattaacccagacaaacattttatccagatttaactttagaattggattttttttaagtgacatatcctatcgtccatgcccactactacccaccgaggtcgaggacaattcttccagatcccatcatcgacaacgccctaccgcgcggacgtgtaaattggagaagttctctgcctacctccaactagggtgaaaacatgcagatacagtcagtattctcatttcctaacctatattttcctttaaatttagagtcaggtacggatagtgccggataatatatcactcatcccgtatcttatcccatattatttcatcatgtttgtaggtagatttattatagtttttcatacatattttataatgtgggacatacgggcggatacatgatttcccgtatcctaatccgtattttctaatgaattcggattaaaaatcagatagtatgtgtatcttttttttttccatattcctcccggcgagtgttggatcgggcgggcgggtacacccctacctccaaccattaacgccatcaggccacccgtacactcgccgtccacactctgccgcggcccgaggaggagggacgaaacggccggaactgctgtgtacgggagggcccaaactaattcggcccgaaaggcatactctaagtgcggaagttagttgggccggaaggtagtgcgatttgcgcaggggcctgaattagttggactggaacaggattgcagcgtactggggcccaaactagttgggtcggaacgggattgcaagttacgtgcaggcccaaactaatttggttcgcatctgcgtcgaagctggaattttttttatttttagattttttttaaaatttttacagaaacaatctatcggcaaaaaaaaatttacaaaaataaaccttgccgtcccagtggtaggcggcaagctgacgtggcagacagcgggtcaaccgcgccgtctgccgccgccggtcaaaattgcatttggccccagagggcggcaaggggctaaatgcaattttggcagcctataaagagcttggagctcgtactttttgcatttaggccccttgctgccccactagaggacggcaagggaaccagatgcaaaaagtaccgccaaatgatatttttatgttatgttaataataattaaacaagtatttattggtaaaaacttgttaatattgttataaaaatgtattgaagttggttgtttcgcaatttcatatgttaagtaaggtattattttgtaacttattcgacgtattagtacttggagaattgatataggcctatcgcagtctcggtcgtagaaacattatatggatttaaacaaggagaattatgtaacatgaagaaatagtagtacaatttgaacatgatacaactatttccattgcggttacatagatgatattagatttgaactaggagggaggtagtgcaatagttgaacacaacgacgatgtagtaatgggacaaggaagcatgacagtagaaatttcaatatgccaagttgtccgataatagctaacccctatatgaggatccatctcctctctcaaactgcgctttagtaaccctgtattgctctgatagttcaagctgcacaacacggctaggtggagttagaacccttctggtgtctatccattctctgtattgacatctccttggtggttcctggaaggaaagaatagatgtgaagcgagcaaagttagtaaatgttgtgagaaaataaggattcatgtaatcaaaatattcttaccatgaaatcgtcgtcaagaatatttggacaaacaaagaaccttcgacccaatattgtaggctttatggaacgaagaacctgacaacgatcaccacacctgcatcttggacgggcttcccatggagggagtgccgtagttagcacccgccagtcgcactgttgttcacgacattgtcgttcgaaagccgcttttctctgcaagtattgctcagtactcggatgcgaaataccagcgaccttcttgtaaacaagtggttagggtcgagaacgggattttctgtatcgacccactcgatgtatgcggaagccgtagtgcaggtctaccgaatagagtagtgttacgaagaataaaacgattgcccatacggaatgaataagcatatgcagataataaaatacctcacagtcatagttaggtcacctaaaaaagcgccttcctcgaatatcaggattcctcgaagccattagttggcatcgatcaccgcataggcagagaggacgctggcaccaaggtggtagtaggtatacacaaggatcgctacgccagttcggatcctcaacgcccaggcgtctagccattgacgaaagccggtaggatttgtaatgaagaaagtagggaagagagtactgaatgcgactgagttctgaaagattgtgaggcctcgctcgttaaggcgacttatataggcacaaaaaatcgagtgatatccctgacatgtgaacgtggcggggcatggtgggtacgcctgattggcgccgaaagttacattggtcgtatgcggcaaatggcgggcaaatactcgtatcgcacgcgaataaaggaggttgcatcggtgcggcagaaagtagtcgtgcatacgccgaaaggtatcgtgcacatataacaacaatgtattcattacacaagcatacaatactagcatgtgaagcaaataaacaaagagaagtctgctctactggccctgccccgtgccgcgaccacgcttggtcctccgggcctatgctcgcacgtggtcctgggagtaggtgaaacgatccggtggcacagcacgggtagcacgagtgtctggtggcggagtggcctgcgcctggtcctgcgtctgcaccggcggtgcacctcccagctgtgaggggccgatgacgtcctctgtcgagcctgaagcgaagtcgaagtcagtgatgtcgaagagcaaggcggaagccaccaagtggtctgacgaggtcccagcatggtccagtggtggaccctgactcgacgtgccggctgcttgtgacgaagtcccggtatactgccagaactgcgctgagtgcgaggtcgacacagttgcctgagacgctgactctgcagcctgggagaagtgggcggcctgcgtcgtagcgaactgggcaaaacctacacatcaacaacgggacccttgtaagctaagacataaaatgcatctaaattgattgtcgaagtactgttgttttgtaagtacctgtggggggcacaacaaaaggcctagccgagaaaggcggggtgctgaacggtgcacgaaaccctgaagcaatcagatgaatcggctcacatagatgtgcgaggcatgtacaaaaaatccttaaaaatacttacctccatgcggagggggagtcagcctaggaacgtgcgcagctggacggggaccagtcggtacgggtggccgctgtggtgctgcatctgcccgagcaacgtcgtctgcacgacaggtgagcactcggagaatcgagcgcatcgactccaccatccacgtgtacgtcgtcaggtgctcctctacggatactggaatccccgcgcctaaacgttggatcgtcgttgaactgtcaacgacgaccctgttgatgtcgacgacctgcatggttaatttgttcgtaaatattcgtaaaatttgatgaagagaaaggaataaaacataaaggaatggtgcgatgcagggtactcacagcacgagcgaagtcctggtcgcggtgcctggcgtagaggtctttagtgctcgcaacgtgggcctgctgctccaagggagcgaaggtgaccctagtatgggtgcgtggctggtactagcgtaggtaggcctggtacacctcctcggtgtgtggctctccctcgtgctccacgacctcctcggttgcgagcaaccagtcctcaacaaaagtccccaacttggtgggccagttgccagctgactgctgacccttgcgcgagtacctgcaaattaatgtatcatattagtgtgaatcgacagatgttgcaaattattgtggagaggtagattttaatgcaacaaatcaaagcgtagtgaaagatcttaccggtgaacatcagctgggacggtcgtcgaaaacagtactggaaaaggctgacggaagccgaattgccgcatcacgcggaaaggggcatgaggctcaacgcagatgtcgaagaccatcggaatcatagtcatccaatacgcctggtcccttgtgcagagtgtggacagacccaacggcgcacgagcctgggtagccgcggcactgtagggctcccacacgacgtcagtcggcagaaggcggtcgaactccataacgaactcaggatacgaccgcctaacctggacgtgagcccatcggcgctgcaatatgagacgatcgatgtgatgtacaatgaacttagcaatgaacttaacaataagagaagatcgatgcaacgtacctgacgacggcaccacagagtacccatcgtagggtagtcgacctccggtcgctccgcgtatagtgactcctcgtacgtgtgctggtccacctcagggcggccgattgcaatcctctcagctgcccagatagaaagaaagagagggcacccaccaaaggtcgcgctgggatccgacttcgtgcaagcctcgaaaggccacggtactgagccgccaacaacgcggaaccccacgtccactgaggcacctcgccaagagtacaagctatttaaatacaacaaatgttactaagggtacataacgatgacgtgcaatttaacatatatgtagagttcgataatattacataacataacataacattacatgccgaagtccgacattacgtcagcatacctaaagacattacgtgcctaagtctgacgttacatcacgagatctaaagacatgacatgccgaagtctgacattacacgacgaaacataaacacatcgataagttcgaaacaaattacaagcaaagccacatgccaacatagaacacaagaactacaccacgtagccagacgtggcacgacgccgcctaggacgtggtcgagttgaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctggcagcctccgactcgtccatatcgttgcggatgcgacgagtcttcctccttgcagccttgcctcggagcttcgatgggtcaggaatattgagtacttcatcgttagtctctgtgaactccctagctatgccgaacccataaatctcgccaccccatgtatgatatactgcttgcttactgaagtactgtgacacatatactgcatctggtatgccacactccgttgcggcagcaatgacatgggtgcatggcctgtggagcagcttcggctttgcacaagagcaatgacatgtgccgtcggctttgagaacacattcttgtttcactctcttgcggtagatacccctgcttgccttatcttgacatagtatctcaaacctgtgctgttgggtaccttgcactagagctcgatgtttcatggcctttttacacaactcctctagctttttctgcatgaaagttccgaataaaatgctgttgttcggtatagagggaagaactgcctagaaccgatccctaaaatacctgcatgtcccatgtaaaatgaactccactatgccaactagtgggagtccacggacactgcgcatcacccagttgtaaacttctgccaaatttgttgtcattattccatatctagcaccacatgtgtcatacgccttggcccatttctcttttggttcatgcagaatccactgagaaaatttccgaatctccactccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgcatagcctcttgaacatgttcatgagctccttgttcttgaaatgtttgaagaaattagctctcatatgacgcatgcaccacctactatgtacatcttcccactcaccagggtatcctcgttccatactcccaaattgcaactcttctatcgctcgcagaatgccagcgtgcctgtcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatttgatcccgatactttccagtcaagaatgtcccatcaatgcagagaacaggtcgacagttcatgaatgccatcttgcatgcatgtagagctaagaacgccccctttgcagcacactcttgccaggatgttcaattgaggggaatttcttcactgcgtaagagctcccagggtttctttcttcgataataccaagcaggcgtggcaaattgtcatacgaggcttcgtaagttccaaatctcatctctattattttctgtttggccctccacgccttggcatagctaatagtatacttgtatgtttcttcgatgtgttggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccattttcccttataagcgtgcacaatccagggacaaccatctttttccttaacacaccgaacttcatattccgaccagttggacttggcaacccaaaactctctatgaagtgacactgcaaaatattttaccgcctccttcatatcttctgctctagtataaatcgctccagaataacctcattttctttgtactcccatctcacactatcctcttcagagacgaccagactagaaaaatcctcactagcccattctgctggattaatatccgtctcatcatctgacgaatcaccttcctctacatgctcgttgtcagaatcctccctctccatttcatccacaatggcaccgacagtctccccctcataggccactccacctggttgaatgcccactggagctactacgcccctatcctctcgtgcattgacctcttccacagaagtctcatttacttcagcacttggtccctcgccatcatccatgttcatctgcacacctggatccttcgggtgaacaaacggaaccatagctagaggccacccgcgttgcaatgcatattccacataccatctccacactcgagagttttgaactggcattagttcccaataaaaaccctcaattgcccgacttactataacattgattgttatgtcacttgtctgtggatcaactctcaagcccctcattaactatccttttatagaaggtacactcctctcagccggtctgtcaattcccctttctgatacaataaattctgacagatctaccccagttggcccgtaacggacatttcctgggccatggtaaacttggaatatttgtttgttcgacatatctgtcaacaaaataactagtatcatattattctttcatgcaataaacacctacaacgtaatatcttcttgtgtatgccaattcaacggtaaaatactgattccaaactagcagatctacgtagttatcggtatctacaatacgcacttctagattagtacaactaaaaccctaaaaatataatgcatttattcaaacaaagttttaaaaaatacacagtatttaactcaatagtcacatataggatctatgaatattacctgaaatcggcgtgtgaatccggcagggcttcgccccttcttctcttctcctcccctttcttcttttttttactggatttgtggggggaggaatgagggccgggggctaggcggcaggccttttataggcagtgaggcctgccgcccgaccagagggcgacaaggggccgcctgcaaaatggccggccccggctggcttttttgcattggggccccttgccgccttttcctgcaaaaaaccctccctccgtcaccgctcgtccctcccccgtttgccacgtcagcttgctgcccaagtggtgggcggcagggtctatttttgtttttttggccgatagattatttctgtaaatatttttaaaaaaatctaaaaatgaaaaaaattcttgaagctgagactaaaattcggcccactatgcaacgaaacgacgatagaaattcagaaaaagtacacgcaaggtccctcaacttgttagccagatagaaaatcgtcccccaaccgtaaaaccgaacatctggtgtcccccaacttacaaaaccggtcacaataggtccctcggcggttttgactccggttttgtgccacgtggcggctgactcagagtgggacccacgtgggccccacatgtcaggatgccacgtcatccctcccttcctcctctctctccctctctctatctcttctctcctcttgggcaggtcatgccgtgacgcgcgtcgagtgccgcggccaccaccactacgactgcgacctgcggcagcgaggggggagggcgaaacggagcgggacggtgaggttgtcgccggcaacaaagccgatggctggtgctgctgctcgtcgccatctcctccgtcgacaacttaccggagcacgccgggttcgacggggtgcccgcgagcaccattgccgcgagctcaaccgcaaggtgctcgagcttgccctgtgcaccgtcggcatcttcaccgaccgcccgttctggaggggcggcgccagct

SEQ ID NO: 58373 - DNA, 55110 bp, Oryza sativa
  unsure (1)..(55110): unsure at all n locations
cgccgctccgccccgccaaacggcaaccacatcggcggcgccgtcatcttcgatctccccttcctttgtcgcctctaccggaccggctactggcagtgggagaaccaccaccaccggccggagctggccaagggcaccagcgcgcggcggccgcctcgccatctccatcagcggctacagtgacagctagatctcctctccgctgtcggccgcgtcgaccctcttccccgccgctgcatcggccgtcggacctcctctccgtcgcgctcctccttcgccagctgttagccgcgccgcccgcgccaccgtgcgtcgccgcctcaccccgacgacgaccgccgcactcctccctgcgcgacggcagccatcagcggcgccgcccgtcccatcagccctcctctccgcgccgctccttccccgtcagctgccggccacgtcagccctcctccacgctgcgtcgaagacgctgccgccatccacgcccagaggaaaaaggagagaaagggagagaagaggggaaaaagagaaagggcggtgacgtggtttatctgacatgtgggacccatgtggggcctacataggtcccacgctgagtcagccgccacgtgaaataaaaccggggttaaaaccgccaagggatctattgtgacaggttttataagttggaggacgccagatatccggttttgcggttgggtgacgattttgtatctggtttacaacttgagggaccttcggtgtactttttcctaggaattcgcacagccacagatagcatccgtgccacgacgcaaccttcggtgtactttttcctaggaattcgcacagccacagatacatccgtgccacgacgcaacaagaagtttcgcattctaatacttagctactaattggtaaattattactactacttgcactatgcaaaaggcaaatcagatcttaattcacatggcatggacatgataaaagcaacacaaaagaaccagagcacatctggatgagatgaagatgaagttcatccatccagcaagaagcaatttgggacgagtccggtctctccctcaatcagcaccttcccctgtaattaagcaagaaccaatttgatcagcacagagatcaatccatcatcacgaaattggatgaataatttagttttaagcatcatttacacatgcccagatgtcaaaaggataccttactgacatgtgaactgcagaagagcactcttcctgtttgagttacaagtaagcatgttgccatctcaactgaagaactggcagtacccgtgccaatatatcaccaacacttaaaatttcatatggcacggcacacctattgtggccttcaatctctttaacaaattcctcagaaaagaaattgttacatttttgcacaaggactagttaatgaatggactctagaagtgaaatttgtatgatggtggattgtgcgttgattcatggagaattacctgctactacaattttgcggaagaagaaattacattttgacactaactgttaattagttgtgaatcaatatttgttgggaacagagaaagaaaaggaacattggtgatgatcctggaagtggaaaaataacttgatttaaatggtgagtactgaataaacatatccaaaaaatactggcgataaaggtggtgtctgaatggagttttatgagaatctcttgcataattcattgctcgagactcaatactgggttaatatacccagagattagtgagaggcaaggtcaattgtcatcttattaaactgcgataactgttgatggttgattttttctttccagcaaaaacaacaagaccacattcactcaagaaagtcagaacaaaaaaagggcctaaaagagtgccaactgagtgaaatgtttcatacttcctccgtttcacaatgtaagactttctagcattgcctatattcatttagatgttaatgaacctagatatatgtatgtgtttagattcactaacatctatatgtatgtgggcaatgctaaaaagtcttacattgtgaaacggagggagtacttccaagttagcttcctgtacaactaagactcctacttatatagtcagaacttaccatgcgagaaattaatcaaaacaatcacaaacactagcaacaaatatttctcatcctctagagaacaaattagaaatcactctccttttgcccaaaacatttcagttagtaacattgtccctaagaacacaatacaaattgccactcacacaaataattagtcctgctcttaatgggtcatgaatcaatatagtggggaaagagaaaagaaagaaaaagcattgttgatcgtcatggaagcaaaaacaacttgatttaaatggtgaatgttaaatagacatatccaaaatactggtgatggcattagcatcttaatagagttatatatgaatctccaccatattttttttatgaaacaaagccaattcattggttcagacacagagattagcaggttgcgaggtcaattaccatcttactgattagactctcataagtgctaatgattgattttttttattataaaagggaacgcaattttgatcaccaaagtcaaatacaagaaggacaaaggacataaaacaatgtcacattgagtacgcaagaaattaatcaaagtaatcccaactcctagcaacaaatatttctcccatctgctagaggataaattagaaatagctcatttttttccagaatatttctgccaataacactgtccctaagaacagtataggtgtagaacacaacatgaaatggaaactcacacacataattaatcacgttgttatgaatttgcaacaaataagtcagaaaaataaaactcattagagttgaatcaggaacacccacatgctgaaattttcaccaccatatccatttacaaaattgtgctgcagggcaaaatgtaatacagaagctactctacaaattcagaataaatacaacagtatatatataggataaacttatgtaatatcctcgcaaccttaagtcacaacacaaatccctcttttaagaaaaaaagtaaacaaatcgaaaggtgcaaaaccatctctgcgactacctctacgctttctttcatcataccagtttggttctttcatcatagtaccagtttgaaacccaagacatacaactctataaaatctgtgcaagaaaagaaaggcttgccttttttttttaccgcgcagcaattcaggcagccgcagctcgcgaggccttccagctctcgtactgggggtcgtcggtgggcagctcgaagcggcagagcgggcacgagttgcgcacgtcgagccacggcatgatgcactcctcgtggtaaccgtgcgagcagggcagcctcttcacgcgctccccggcggcgacgccgtccctgcacaccgcgcactcctccccttcgccgtcctcgccggcggcgacgacggcggacggtagcgcctcgacggccgacctcgccgcgggcggcttgctcttcaggaacaaaccctccccgacgagcacctcgtacacgtcacggtcggaggtgtacacgaagccctcgtcggcgggcggcggcggcggcggcggcacgtcggcgaggacctcccactcgggctccggctgatccatcccggcgccgccggagggagatgccacctcctcccaatcgaattcctccgccgcgttggaggcctcaagccgcagatccgccaccccctcctcctcctcgtcgtcgtcatccaattggaggcaatcccaccggatctcctcctcctcctcctcatcggggaagccgaggtggtcggggcttggcgcgacgagcgcgtcgtggaagaggtcgggctccacggagaggaactggctgcggaggcggtcggcggccgccaccaccgacgccgccgagaaccccgacgacggatccgggtggaacaccggcacgaaggcgtcgtagcacgaagacgacgacgacgcatctagggtttggggcatctcgtcggaggcgagccggacgaggagagacgaggacgccatggacgcgagagatagagaggggaacgaaaaaatcgcgccctggattagcgtctcgcgagccgcttgctattatagctcccctaaataaaataaaataaaataaaaataaaaattaattctgctagtgaaactctcgtggtacgtagtagattggaacggcgaccgacgagacgaccctcgtcgctgacgagtggggccacccgatggtgggggattataaaagaaccagtggttggtggtgggtcccactcgtcagtggcgtgatggttacgtgtctcgcctgtcggggctgtgtcgtgcgggagcagaaaattaaaagtgctcgcgtttttttttggggcctgattagctaccaaacaaaattttttcacccagtctgattgacatatgcatggaatattaaatattgtgtgtaaattgtgacacaaatcttctaagcctaattgcatcatgatttggcaatattgtgtttaataaattaatcacctaatttctagataaaatctgtaatttattttattattagtctatatttaatactttaaatatgtgtccgtatatctaatctgacacgccaaaagtttcccttaggcgaactaaataggccctatgtgttctctgtacttttggggcaatgacaggtggggccgtgtgcttttgtcccgaggtgttagtgagagaagagatggtggtgggtacggtttggggaggtggggggcagtgtggtggcgctgtgcagtgtgagcggagcaaaggggaagaagggttgggtggttgcttgtcatgtgcgcgtgtgacaggctggaagaacagcgacgcaacgcaaccaagggaggacgctgagcggggcagcgtctggggcggaggcgagcaaaccgttcgttacctggtagctgttgggttggacggttgactatacggtgatacgccttggttgtgtagagtatttttttaaggagtaaattatactccatttcttaaaataagtttcacttcggcattatgctgtgtcatatgattaagagtaaatttcgtagaattacggatacttgggtcaaattatctcgaaactacatatttaacaataaatttattataaaattacaggtttaaggctaagtattataaaactacaaatttaataataaaattatcatagaactatagattttagagtttaaatccttagctccaatgttttatttgagttataaatgttcaaattttgtgattaaattgatataaaacctgtagttttgtgataactttgttactaaatatgtaattttgtgatatttcacctaaatatgtaattctatgataattttagtgttaaatttgtagttttgtgatacatcgtaataaatttgtagttttgtgaagtttactctgtaattaaaggaaaatattgtaaaatctaagtaaaaattattgattttttttgaatttagaccatatttcatgggatttcattctgattttgtgaaatttctatatgtttgatgatgtattctagtgttaaacctgtgtaaaatgaaacgtgttacaatctacctagtgcaatttaagagtaaagtttgttttttcatttgttaatctttagagtttaactgatgtcctttggttcagtttgatattattgagaagattattgcttaaagaaaatttgacaatagatcaagtcacaataaaatgatatttacatgaatcttttaaatcttaaaagatcaacgacattaaatattaaaaacggatggagtatttgtttttataacattaaaatgaaaaataccaacaattcatgggctaacaataattcgcattttctcgacggaatggtatcctttgttgggcttacattttttttccgaggggtaagggcaggagctatgccgatttcattaaaagatgggagaaagaaaagttcacaacacataatttacaagaataaaaaaaatcccaggaatcaagaggaggatacaagaattttgagttagtgcaacgcaactagcagcaggatgttgcgacggatcatctaaacaatctgggcttcgtcaaaagccttgcacatggcagacgggtggtaaggtgccttacaggtttgaattttttttgttatgattcggtacaggtgtactcggctagcacatgctaactttgaatctttgtcaattcaatattttatcttcatcacgtcgggtttgtaatacacgtacatgccagaaagtgttattagcaaataataaaatgttgtgctgaactgatgactaagtgtgtgagtgggcaaacgtgtgatgtggacatttgagctgcaattttacttcagaaagcaataaaaatgtgtgcttaactttaataaacttggctctcatgttttctctatcaagttgcatgcccctttaatttgcaattttggcaggagtggaatattttattttagttgatgactcttggattagctggtgagagggactcatcaactatggtgtactatacgaggaatcattagtactttggacgataatgagattggcttagaaaatttctgccttgagttggcaaccataacagattttgttggagtgtataaagtgaattgcccgtctttccctatcagtttaggcttttaggtgcaactgacttgtgcatgcaacttaatatggtatcagaacnnnnnnnnnnnnnnnnnnnnnnnnnnnnnnnnnnnnnnaaataaaacaattgcagcccactccaatattccacgcttgagacttgagggggtctcgcgtgagggggagtgttggagtgtataaagtgaattgcccgtctttccctatcagcttaggcttttaggtgcaattggctggtgcatgcaacttaatcatcgccagcgtcgccgtatctttctcgactacacttcgctcttctccggcaaccgcgtgctgctccggcaattctccctctatgccgttctcgtgccgcgaccgtctcggaggccttctctgctagtcccctccgatattggcgtatggttcatggtggtcccctacctcgcctatgcggtattggcaacaccgttgcgcgcattcatcccgagttgtccccgggtttggcaaacccggcgtgacgtctcgtccttcacggttcgactacatcagctcttcggcgtcatcttcctccacgatcgccgtgattgtgtcaccgtcttcgtctctagcgtgtcttcgcgcaccattggtccacgatgccctcctgtgcatccacgaccactctacggcgcctcatgcgctccctgcggctcgactacctcaacatcagcttcctgacttcggctacatcgaccacggctactatacgcatggcttcatcgaccacggctctctcggctccttcgctttggctacgtcgacaatggcacaaagggctatcatccgtgttgagcactcttgccggtttcttctccagtccaagtgtccgcgttgctcacgcttggactgcggggggatgttagagtatatggtagttagagttatattaggataggattggtttgtgtggactccttccatatctgtaatccttccttatctcctccccatgtactcctatatatatcggccccctgaggctcaatacaaagtgtctcacgttacgcaatatacctctcctatactatccatcagatttcacctgtccaggttttgagaatttgaggtccagcttctcggttatcaaaaggttttgagattcaatgagatttctcaactagtgcagaacagaggctttgaattttggaattctataagatttgtacagattgttctcttttgggttacaggcttacagcatcgctagagactgaaacaactgaaatgatgctgtagtttgtctattactccttctgttttcacccctgcgtgggtgggtgggtaaatggttggtaagagggtgcaaatgaagttattttggaacaaatggctgaggctagaagtgaagttattttgggacggagtgggtacttaccaagattgttctgagatactcttttgcaatgaaattttcaattaaagaaaagttatcttttgtcacaaaatattttgctattacaaatttacaattcatatgtgcaggcacaagcatacatgctaaatagccttacaatgcattaatttccttaccactaaatataggtcattaggtcttcctgtgatccttgagatcaaacttcaggagaccttgaccattaacttcatgcatatagaatcagcatcttgagaacaaatgcaattagatgtttcttagaagtatttcataatgttttcattgatatatcattacaaatatcatgtctaaaatctttcatagtttattttgtgcttgtaattgcattacagattgcaacttattctagccctggggcacaaaattggaatttgacacagcagcctcattcttgggccctgcaatttcattggcaagggcccaaataatctcaatctgtcaggctcccagattatacaaaagatggtcagcttatgcttgctcaagtttacacattcctttcagtatttctccacaatttgtactagtagtatctagtactactagaattttattattgtattgttacaaagatcatgactgaatctcttatcagagtttatttttgtaattgcattacagcttgcgccatgaaacttattctagcaatggggcacagaaacaggatccgcgatggcggtctcattcctgggccctgtcatttcactggcaagggtccaaacaatctcaatctatcaggtttccagattctgcaaaataggcctgttcagcttatgcctgctcaagtttacacatttcagtatttctccacaaattgtactagtatctagtaccactaaaatttactattggagccaaattgtttctccattggcacacaagatgctgaatttttactcttcagttacccatcttaaactacaaaccttgccataaagagtataaacattgttagtaaagagaagctcctggagcaaatcaggtaattgctcatcttttctcttttaacgagctcagctgagcaaggcaggcctacactaatcaacatgtcctgtagtctctgtttgataacgctgtgtcctgaactgctccttctgaatattttgactaatcatttccatcttctcggtaatgacccaatcagctgctctgatcaactgctctttcgcttctcgctgcgcctttcgaagaacttagcacgaactcccttgtctcttctctttacagtcacagatggatcatgatgagctgaactgatcgtgtattcgtgtgtgtgagtatgtgtttttctctgaactctgaagattctgacgacgacgacgataaaagatcgtatcttgggggcctgacactcactcccgtttgcttcaggccgggtgattttcttgataaagctaaagacgcccattttgcacaggggacgctttaatcatgttgcccaagaaccctgtaaaaaccagctgcattgcaatgttcgtgtcgagaggggtgagttcgatgtcacgtccttttcatctttatctcgcggtttgcacgcatttcgcaaagcgtttttcgcaggagccacctgtaatccccccctctttcccgagcccgacggttatcagccggactcgggtaagagggaggcagctgcgaggaagagggaggaagaagaaaggcgaaaaggattcagaacagtgtcatcaccgaaaggtgaagtacttcatgcctagaagaataacctcacggtttacacgcatttcgcaaagcgtttttcgtaagagccacctgtaatccccccctcttacccaagcccgacggttatcagccggactcgggtaagagaaaggcagttgcgaggaagagggaggaagaagaaaggcgaaaaggattcagaacagtgtcttcaccgaaaggtgaagtactccatgcctagaagaataaaaggtggacaatgtgttgttaggcagtagtacagggtgacttgcatttcactccttgcaaagtgacaatgtgcaacttaggtaggattactgtcagtgaggaggacaggattactgtgcggtaaaaaaatggggttaagaggggtaagtgcccctggtaattaccgtggctgggcaaaagcgtgtctggggtggataaaaagaattgcatttggttggctttgctttgccaatcaaaaggcttgattcggggtggcgcgaaccccgaggctaatgatagtttagtttagggttagagtgaggttgggggaatcagaagagcatctaaaggctctcaggttggttaccttaattggagtacactagttgtactataagcattaggtgtttgcaatttgcttccatgatcaatggatgtgatgctttagtttggaaattctaagcatgtaaaattgcatttttcttacgacctactcactctttcccaaattaatattcatataatagaattcaaaatttctcaaattaattatcatataaacgtatggacacatatttcatcgaaatataattaatgcgacatgagaaaatgtgtatatgctaaggtgtaattggcatggtgttttaatcaatgcatgcataatgagagaatgtgtacatgtgtcttgattgatacaatttaaattaacttttggtcttggtacataaacatataaacatatatgataatcaatttgggatggagggagtatttagtttattgccacttttaatctgactaaatttttacattatcaatcggacaataaactaaacacatttcaaccattgctacattatcaaattttggcagctctagaaacttcatctcttaaaactctaccataattttgcaaagacatcaaaccaaataaaaccaatgctaccaaaatttaatgatactaaaatgtatcaaaattcagtattaacaaattttggtatggctgattttgacaataagtgaataaggttttaatttctcgtactcctctgccaaaaaaaacttaattcagaggatgtatctagactatatgtatgtttagatacatcttcaggattggaatttttttaatggagggagtacgtgttaacgttcaataaaatgactaaaatgattatccgcgaagtgacccgcacccttctttgcgacgaacctgtcactggaagaaaactagtacgagtgatcatgttgatcacgaaggtgtagacagttgttcgtgtccaataataactgtactaaagtaactgtaccgacatgacagtggtggtcaaacgatgatgagagagaatggtacttgatttacagcaaggcttcagaaaggcatcagattaaacaaagcctgtgatagttggcattgtcagaaacttgagtgaggatgatgccacttgcccagatgagaagatggcaggggtaattagtgagtaagcaagctaaagcaaaggttaaaacagcatgattaaagggtttgtttctactttttactgtactttgctaccaagaaatggtaaaggcagggggtagtaataaactcaaaactaccctcgatctcctaggctgtaaaaatcatgtcgctggatgcagcaaactggctataaaatcaagaacacttacaacatctctctctctctctctctctctctcctggagtctctctgtttgattggttagggagcaaggcgatggatgctaatggcggcaatgggtttggagtagagagcaacgcttcggctgtccatggtggcatggcgatggcttggcaatggcatggcggccagatgagcggcggcagctcgtgcgctgcggcgccgccgccggtgcaacagccggcgatggattctctcgcgtggtcgtcgacggtctcgccgagcaccggcgctgccacggcggcgagcggcgccggcttcttgctgccaccggcagccgtgcgcggcggcttcggcagtttcccggtcaactccggcggcatcgtcgagccggccggtgactgctcgtcggagtccaagaagaggagatcagacgaggtacacactcacttgctccccgtctcatcgcatcgatcaaaacattcttaataaaaagcttgatgaatcgtttgcacaattgcttgcaccggcatttgcaagattgctggaacggatcacgcgaacgcatcgaacgcgcttgccgattctgggaacgagaccgagtgtagcaaagatgtcaacggcgaagtgatcggcccgccggcgacggcggcggccggcggcaagtcgaaagggaagggagccaaggacgccggcgaggcgcagaaggaagggtacagccatgtcagagctcggaaggggcaggcaaccaacaaccacagcttagcagagagggtataccctacatacaaaatttgaacagtttcaaatttttttaaatattttttttggggggaagagaacagtaatatttacaaatttcttcaaactgatcacctgaactatgagtcaaataattgaagattgtggtgttatgtttcttggcagctgagaagggagaagatcagcgagaggatgaagctcctgcaagaccttgtccctggctgcagcaaagtgagcattctaacccagaactgaagctacagtgcgaaggtttctgaatcatatgtgaatttcataagaatggatggtaatttgtgtttctgaatttgattcgattaggtcaccgggaaggcgttgatgctcgacgagatcatcaactatgttcagtccctgcaaagacaagtcgaggtactgacatgatcatccacagggaatgactgcaatttcacctgacaaagcacaacgcaaacactgatattcggttttcactttccatctctgcagtttctgtcgatgaagctctcggcagtcaacccaagaatcgatctcgacattgaatcacttgtcaacaattccaaggatgtatggaacttgaaccatcttcccttcctcctctctgtttttcttcttcagtttgcttcgcgagaaatcagaaattcagaaatgtgtgcgacaagttcatcatatttcttgatgatttcaggttcttcgttttcccgggcagccttcctctgctcccatgggattctccttctccacggagatgatgccggggctacaattatcacgaccgggcatccttcagggaggtgtccatggcatgatcaatccagatgtgttcaccagcctcatgcagaagcagcagcaaaatgacaagggagcattcagagagcctcaggtttgcatctgatacatgccattgttatttgttagtatcacttcggctaagttatacaggaaggtttaagccattagaaagaactaggccagccaaataccattcagtttcatctagtttcatattattatatactctctctgtcccaaaatataacaatttctagctatgtatctggaatctggataaggagatatacatagctaaaaaatgcatattttagaaaggaggttgtagtacagtagcagtttgcaagacaaacacatactgttcaccattctacactcattgcaaacgtgatcatctgatgggctctctgattcttgaacagatgcatcagactttggatggatcattccgtaacaccgcacaaatgccgtatccacaggtcatgagttcagaagagctaagcatcaggcaagatcaagatgggtttcacatgtgaattgcagcaacatggatgaagcaggtttattctgatcagaaagcagatggagtgacaagcacaaacagcatgtgcataggaattactgctgctgagcaattcagaattgcaattctagttgcctgagcaagtgaccagctgcaatctgacttccaatgggaagggaagaggtttcccatagattcagtacatggggtgtagctgtgatcaaatatcagaactgaagcttcactgaactggacagctagaactgcaatccatgatagctagaaactcctctgacataggacggaaaaaaagaactgaagaaaatatatctgtgcatgtgacaaaaaatggatgtccaaatatttgatgcgagcaattgaatcgcattgggatgcatatcttgttttttgtggctccttccaagtagcagcgaaaagcaatgtttgatagaaacactgaaatacaactgttcagcatgaaatttaatgcttatgcatcatttttttttcgcaattgcccctttttttttcatattgagtataccttcctttcagagtttgttttctgttctggtggtcctttggctgtgagattttatgggacatgatcacaatagataatcttaggcagtcctaaaaatcaaattttgatttatgctaaacatcctgtgagctccattgaccatttggatattgggtttatctcgccaacttaaatcgcaacagctgagagtaataacatacagattctatcataacgatgatgcctaaataggtcaacagttgaaattttgagacagtaagaatgcatcatttgtttatcttgcattttgatattcttttcttactagacaaaatgcttcttcaaaatgtgtagcgcaagaatattaggcttaagcattgatctccacaatgtaaattgatagtaaaaactgcataaatatagaaaacaacaaagggacatttgtattgtactgattatttttcatgttttattgataagaccaccccctccaatagatagaggtggccaatgagtctacagactctactgcacctacaaaaatgctgggtaacaacccaagtaatatctatgacaaaatcatgtttttaaaccatgattatatcccatagcaactatttctgaagttctaacaaaggatgcccaagagaactcacttattaatccctccatgggtcactctcaggcctcacttcagaaggctcaatcacctccgtcaccgtggcttcagatgagcctgtctctgtgctggcatcaccagtggttgctgcttcagtctcggtgtctgacctcccccatctcccgccaagggcaattgtcatcatctcatagatcttaccacccaactccgcaggactgtcaggctggacattccaagtaaacaaacagtcaaatggtaaggttcatgatgaccaagaaatgaaatataatgagtgtgttttgcttacagtatatccactggagatcagagcagtctcatacaacagctcaacagccctcttagcttctgtactttcaggctcatttttgcaggcagcctgccaacaattgtttctcattcatgttaattattgcttatgtagaaatgggtacatcaattactgatgataagcaacaaatcttacattcaagtccttgacaatagggtggtcagggttaatttcgaaaatccttctacccctcatgaactccaagcttgatgtgtccccaagtgtttgtgctttcatgagtctgaattgttgaaaaatatgcgttagaaatcaagcatagtacaacacaatgatttaatcgtacaggaaatacctttccatgttggcagaccaaccaaacttgccagatacaagaacacatggtgacaaactgaggcgctttgatatttgaacctttgctaccttgtcaccaagctgctgttttacccagtcacacagaagagtgtattcctgtttgctttccttattgtcctcatcttcatcacctgtgcaaacaaatatatattagagtgatgcagatagccatgaaaaactgtatccagagcaaatttcaaacacttcctcagtcctcacccaactccaggtcctctttgctgatatcaacaaacttcttctctttataggtctgcaaattctgaatggcaacctcatctattggctcaatgaggtagagaacctaaagagggaaaaaaaacagcaacatgagttaagtggaagcaagaatgacagttcttgtctcatcggtattatgttgtgttcatacttcaatgtctttctgaaccaacttttctaggaaaggagcagtctttgcactctggagactatctgtagcaatgtaatagattgctttttggttctctggcatgttttctacatattgatcaagacttatcaaatctccctcatttttagaagtgtggaaacgcagcagaggtgcaagacgcttgtgatttccggtgtcctcaatgcaaccaagtttgatgaacttgccaaagctctcccagaacttcttgtaatcctgcagtacatatgacaaggcttcaacacgtattcaaacataaaaactcaggggacagggtagctacgagtttttacctccttgtcatccttttcagaaatctcctcaatcatatcaaatgtcttcctaacaagtctctttcgcataattcttacctaataaacaacataaattatctcgaaatgcccataggaagatcaacaatgataactttccttgtatgtaatttgaaatataagagctggcatgcatttcttattaacttactattcgactctcctgaagaatctcacgagaaacattgaggggaaggtcatttgaatcaactacaccttttacaaagctcaagtatctggggaactgcaaaatgcaatgctaaactcagaaatttgttctattaatcaaatagacaatcaaggaaggacaacacaaatgcatattcacaagcaactatcttgtggactgagagataatataccagttcaccatcgaagtcatcagagataaatactcttttgacatataaccggatattcttagtttttggattcattatctcctcattactaagcggagccattcctggaatgtaaaggacactcctaaattccacctcaccctggtagcagaaaatatcatgtcataaacaatattccatgcacttaagttaagtgaagtgatgtttgacaaattcatgtacctctgttgtgaagtgagtgtaggccagaggatctaagaactcattgaatgccttcttataaaattcattgtattctgttttctcaatttcctttggacttctcatctgcacacagagaatatgattcaactatctgcttccttaaacagtggatagcacctcacatgcattttttttgggagatagaataccaaataggtaaggttcaaagactgcaaattgtgtgcaatggaagtaacaaagataaaattacccatataggctttgtttcattggctagctcccaatcccagtatttctcagtaattgtcttctttttcttttgttcaccctataggtggatgcgaatcagtttcaaagaacaaagtcaatataaggataagaaattagaagcagatcatccaagataactaacctctttcgcctcttcaccttcttttgcctcttcatcctcttcaacctgtcaagcaaggaggtcacatcagtgaaagaaatctgaaaggaatcaagaatagtagctctaaagaacttgtaagatgcatgttaagagaattagcaagaaaaaaccaccaaggccttacctcgacagttctggatttttcctgccatgtgtatatggggaaagacacaaactgagagtagttcttaactaggccttgaatccttccaggatcagcaaactcaaacttatcatcaggctgcatagttacagaatatgaggtttccatttttttgtgacgaagatgtgagattttagttataaaaaggtattcatttcgacaaatagaaaagaccaaactcacccttaaaacgagagtaatctgagtgccacgtgtaagcattttttcaggatcagtctcttccttgatgacataagagctactgtcagctacaccttcccatacatattgcttatctgatttggggctcttagtggagaccacaacctgcaaacacataatttagggggaaaaagatcaatgaaaaaataaaaagaaacatattccatgaaatatattttacaaggatagcatccaaaaaatgtctcataccttttccgctacaagaaaagctgagtaaaacccaaccccaaactggccaatcagaccattatcggctccaaggtctttattctcctggattgtgattgatttggtattaggaatgaaacaacgaagcaaacacacaggtagtacacattgcctagacattggtacaaatattcagaaagtagaaagggaaggaacaatgctctacctttagagccttcaaaaattttgaggtgccactctgagcaatagtaccaaggcaatccttaagttcatctttggtcattccaatgccagtatcactataagaacaataacaagattgtactagtaaactacctgcactaaacagttcgagtcgacaaagcacaactattagagaataacttacgtaatagttatggttcctgcatcagggtctggtttaatccttatctccaactcgccgccatcagcaaggagagaagaatcagtcacaccaagaaacctcagcttatccaatgcgtcactcgcattactgagaacacccacccgatagttagcacataaagtgatgagccatgggatcaaattttaaaaggcttttaaatggaactatcgtttggctatgttattattgatgaaacactacatttggcgagagttactactgacctcacaagctcccgaagaaatacttccttgtggctgtaaaggctatggacaatcaaatccattaggcggctaacctacacagcacaaaagggattaaacagttactatattgggctatacaagtccatcacaccacatgtcgaattcacgatgaaaaatgatgaatcataaattcataataacaacattccattactgtaactctagtgaaatgctagcataatcaaacagcgaagaaactatttccatccaaccccgaagccatcccgacccgtcgtcactcacctccgcctggtactcgaacttctcctcctccgccgtctcctcggccttctccgcgacggcggcgtcgcacctcacccgcaccagtctccccctgctcccgctccccgcctcccacctcacccctctcccgcacctcgccgacccgctcccccgcgccgcgcccgcccccggcgccctaaccctccccgcgcacggccgcagcgccgccaccgacgacgcccccaggctcctgctcagcgaaggcgccatgtgagacctctagtagtagagcgcggcggcggctgcacggcggcgagccgaggcgaggcggagaggataagggtggaggagttgctagggttttttgttgcgggtttaggaggagaggaggaggaggaagagatgaggcgacgggggaagcttctagaagcggtcgaagcgagccgccgctgcagtgcagtgtcgcgcttgagtgtggggttgggtcgttctgaccgttcgatccgcggatcggacggctggattgagatcgaggagaggttggttctcatttcctcggttcctccgcagagtgtggggccacctgtcagtgagagtactttcatgggccaactcgctgcttgggcttgggtttgggcttattaatttcaaggcccatttaggactttggggccatttgaaattttgaagtttgaactacttcacgtcaaattcatatatttggaactgatgaaatcgtgtcaaacttgtgtgaaatccatcaaaccagagaggcatacacaataatgcaatgcaatacaaaagaatttaacagggactcaaattgagaggcagcagtaaaaaaaaaacaaaaaaatgacgtgctatatttctctttactgttcatagatggtttatgattttgatcatcatccggagcacacaccacacagaccaatgttgacatctaacatgggagagaagactagctacagccacaacgccactctctgaatcgatcaccgatctcggctagtctcgatgcttcgaggaggctctttgaagcaatcaacattgcagagccccatcgatctgatcatctctccgagcctgtcaaaaatttacaccaatgtcagtttgtggcaagagtatttatcatctttttaatcacaacaaatctgcggcaatatcatttatcatccaaagtttcttcactaggaaaaatgacttaggtaacatgattactgcaactctgtatgatgatggtggaagtgaagaattgttcagagaaccaacctgtcgatgctttttcttggtttatctggctgatcgtgttcatccctcgtcctgtcaaatgtgtcaacacttctccttgatttttctttcttctccacgatggatcttggcttctctctgcggcccgtgcttcgccttcgtttatcgacacgatcattgctcaatcgaggcggcagctcatgcctcgtgctcttcctcggtggctctagcctctgtgaggtcgtccatggagcgtcagagagagcagaaccatcggaagccgtttcggtttcggctagcagcttctcattctcggttgatgatgattctttctccaaaggcatattttcgatcgtcgatatgaacttcttcagatgccttatgtacactgggaaggtctgcaggttacagtggtctcctccctcgatccatagaggttcatacttattttggcacagctcccatagctgcttcccatgggaacaatcgacaatatcatcatttgtgccctgaaaaacaagtgaaaaggatatattaagttaaattacataaagttgtacatgagaaatgcacagagatgcatatatattcaggcttacatgaattaccaaaacgggagatttaacaaggggcattttctcaatgttctgcaaagaaaacaggtgttcggttagcatggacaatgcatgggaattaattttagtatctcttgatagttcagtcgtcagtgaggcaaaccttgtatatgtcaaaccagtatgttttcttcacagaatacatgacacgcaggccagacaatatggggctgtgcagaactactgctcttatacgatgtaactgagcagctaaatcgacagtcggaccgctaccgacagactgaccgtacaggataatgtcttcttccctggtgccatatacctccacaaggcatttgtatgcagcctctatgtcagcgaaggtattagcttcacttgcctgagaatggaaggaaacagaatgatttgattcaatagggctttcaatttccaatttagtctttaactcaattattggaataagctcactgaaaagaggaattgtggaactgaaaacaatcaagtggggttcagttttgcggtgtcttgtaaaaagaaaatagaaggcctcaagtgtttccaattcatcagctaataaaacattccgaaagtaatgttaggtttattgcactcctatataggcaaagataagagcgttaatttcaggaaagaatagagagcattgttaaccttgcctgatgaccgtccataaccagaataatcatacctgcaaagattgaggaaattattccaaatgcaggaaaatgaggagctaagtacataaatacaaccattaattcacaccaattcctcatttgctacgatgaagtggcaaataaggtaacgggtaaaattttagtaggatatgaggaatttatccttaaaacagttaaaaatagatgcaccaaggtgaatgcgaatagcctatctagcataattgaaatcctccacattgacaaagatgtctctgttataaaaaaaaacgtcacaaagtccagaaaatgaaagtctacaggacaggatacaacaaaattgactaagaatcttttgcgttgtttatcagcaacagttagttctgaacatcattgaaaatgaaacatggaatgatttttgtgatcaataatcggacaaaaacatctcaaacacgatggctattgcaggaagcgcaccagctccattggaccatttgctttacatgaagaatccagacgccaattaattgaggtaggcaacctggaaagctaagtacttggctctcctgccgagtgtgggtctgtgggatcagggaaaacatggccttcttgatgaatgtgagatcaggaaaaagctatacctgtgcatttttcaagcttttttttttttttgcgaatacgcgtattgcttatcattgtatcaagatcgaaggttgtagatacaaaaatcggtcgagctggggaaaaaacaacaaaaggaaaaatgggggaaaaaaaggaggggatggaaaaccactattatgactctaatacaaaatgtcaaatccatgtataacgcgatcatcaatttcaatgtaagaatccataagaggatcttatgggaggtaaaggtatcactaaaaatcaaagtatttatgtggtttcttcaaaaaaaaaaagtaatcttgacgaaagataacctcataaagagaaaatggaggggaaacaagctatgttgtttttgtaatacacaagagaccatccaacatcttttctttgattgccatgttgcacgttttgcttggcgatgtgtcttctttgccttcaatatcccccctccccacaatgcaaaagatatttttggtaactggctaaggggagtgcctagacccacaaaaaaatgattttatttggagctagtgctctatgttggtcaatttggcgttgccgtaatgatatagtttttaactataaaaaaatgcctaacatcatgcaggttatcttcatgtgtttcaattggcttcactcttgatgtatgatgctttcacaggaacaaacatgatactatacgcaatggtgctacacgtttggaattggtagctaaggaacttttactccagtttggatggcgtagtacctacagaatttcgtgatagaatctacgtgattttaaaaaatattattttagtagatcatattatcggtagaagttgggggtttgtaccatcttgccttttttaagctcttttctgttcatttctgaactttttggctatgtgcctacgggcagaggccggagatgtaacccatttccattttctaaaaaaaaataactctaatactccccctttgtagacaagcccactagtgacttcattgttctgacgtctttttttgggcacacttgctctcatcccaacccactttccagtatgaaaattcctctgatgtacctatcacagtgtgtaatgaggacctacaactagttattaccaggttcatgcgcaatcgaccagttctttttttctttttgggtacaggagggtagccccaatgtcaacgaggaaactgtttgtacagccctcaataactgtaactctgtaagactaatttagctgtttaatcatgtgtcacgaaatagcaaaaccaaaagagcgagtagtttacaaatccaaagaatttgagtacatgtgaacacaatacactgatcaatataaactctatgaactgagcccactgaaatttcagatcaaatagaacagatgccaaccactaatcaatgctcaatcccaatgatcaggtggaaatcaatccttgacaacgcatactcgacaggacaatcaattgacggaggaagtgctaccagattccaaattgtagaaatctagttgaaagccaaaactgcaatactatgaacagtgctctgtgtactacagctaaattcaggacattctaagcattagaacaagacatattcaaaagatcacaggacttcattaacgacgaatataaactggtctcaaacaaatagacagagatgaaaatcgagctagccaattaaacgatgaatatatactggtcccctccagcaaggcagcaagttcatcaagacaccaacggaaggcaaaacaattgacccggatcaaaccaaggcccggctattcaagcaaagccatcaatcatcaattcatcatccaccaaagcagcaacgtttactcccctaagcagtgaaagttaaactaccaaaacaaataatcacacgaactgacgaacacttaccccatgaggtttacatggaggcgggcgctgaactcgacgaagagctcgtacatcttcccgatgtcggcggcgttgccgtgggagtagagcacggtgagcctcgccttggggcaccgcacgtacacggcgatgatctccgtgccccgccgcgtccgcacccgcctcgcctccacaccttccctccacgggacccccgtcagagacaccctcctcgccgtcgccgccgccgccggagcagccgaccccggcggtggcggctcctcctcgtcggccacgccgtacgccggcgggtcgggcgggaaaaacgcgaacttcgcggccaccgaggacgtcaccccgcccatatcctaccacctcacgacaccggcggcagcggcatcagagggttcctccggccggcgagcggcggcggaggctgggggagagggagggacgtgtccgtgcaaagccggaactatttggagggcttttatggaaacctccacggccaaggtctcctccctaaaggggctatttgtaattaccaaacttatgtagggacctaaatgtaataattggaaagttcaggggtttatcggagggcgagggggataaagaacgggcggggaatcagcggaggagttgccgggagaattaaaggaaacgatgtcacgtgaccgccggcaagggcgcacgtgaggtcccggctttacatgtagcactcgcatttttctttcctttgatccgggtcttgatatcctaagattatggattatgattgtaattatgctcactgctaaaaatgggggaaaaccctagtgattgtgacacggcacaagattttctctctcacggtgttgttgctaggagtgcatatctgcatttaattagaaattcaaaaatgatgtgcgactaatgctaaaacagttgctattctctgtttaatattttttgtcaatgaactgtattgtttgatccacagttgacaatcaactttgtagtaaagattttttaaaaaaaaactttgtagtagcatagttgttgttgcatcaatctgttcatcaagagggtctctgcatttggaggttgtggattgtaagtatgtcctacataattatgagtatgttttgttttgcattgcacctgaattattagcaggcaagaaatgtgctcatttttttcgcaggacgagtcattaactgaaaattttcaataattatggaaaagctattagtatatgccatatgaaaaggcatggtccatgcaaactggcttttcatgatttctgcagctcctgctgctgaggaccagacccagtgtaagctctgaaggtgacattgaattgaagaattggttggcagtagctctgatctgcctgccactgtctcttcttcctgcaccccagctcacccttgcaaacccatacctacatgccttttttcatcaaaagaaatgcacaattctgcagcatgccaagaaaatttcatccatttttatcacagcaacatgacttgctaatcgccatgtactacaagttgagattcatctgagtggatggaattgttagtattagaaaaggctggttcgaatggaacacagcaatcgtggcagattaaactaacaaaatggcattgatatcattagcctttttcctccccacaagagaaaaaaacaaagatcattagcctttctagctctgctttggatgcaactaagctctgcaatgcttaaaacggggaaagttgggtgtctcttttgatgctgcgtatactcgattgtttttccttttcattcctggtgcctgagccaggtcgaatgtgtaaaagccagtgaaaaaaaatcaaatgcatctaaaccatctgaacaaatgcatttgatttggtacttctgtctgaactagtgagtcatatatgcactgctttccttcctgtaatctacctccattaatcttcagttgtagtgtctggtaatgatgacctgatgaggattccattctcccagttggtcgagtacacaaaggctggagaggtgaaaagatgatcaaatcaaatgcgcacgcttgctgttactactctcttttggttctggctgtcagaaattcagaacgaaagttgcaagacaagtatgcctgctgtttggaagtcaatcatcatcaccggagcccgagctgcacttccctggcatttcttgtccgggccagctgtgacactccttttttttgttctcaaactgtcaattgtgacttgctcactccgtttttggccttgttcagttctaaattttttcttcaaactttcaactttttcatcacatcaaaattttcctacacacataaactttcaactttccatcacatcgttccaatttcaaccaaacttctaattttaacgtgaactaaacacaccctttaaatgtatagcattattaacttttgaaatgatatctatccattcatcttactagatgttagagaaaatataaaccatagttaaagtatttttagtgataaaacaaatcacaacaaaataaatcttgctcgcatagtctttttgacaaatagaaatagtctgacgtcatgtctaaaagacaacaacgttgtatatttaataatttaaaatgaatataggacgatgtctgttgacttatataaggcatatcttattttagtacaaatctttaagattaattttagctgttagtttctttaaaaataatagctgtataaatcaacttttcgtcaaaacacttcaaaatatgaatccgttgacatagactgtacacactacatgtaattatactttgactaattatttattgaaatttacaaatataaacttttaaaatcaaaataagattgcggaaaatctagtggtttttggggggggggggaggaccatgaatcaacaagattcaagagtacactggcacttccatcagcagaggcccagaacgatgtcagaattcagacggaaaaagtacacccaaggtccctcaacttatcatcgagatataaaaacattcttgagcgcaaaactagatatacggggtccctcaactatataaaacggtcacccgaggtccctcggtggttttcaatccggttttatccgacgtgacggctgaatcagcatggaacccacatgggccccacatgtcagctggccacgtcatcaccctctccccttctctccctttctctcccctctctctctctcttctcgtttgggcaggcagctggagaggacgtcggcgactcggcgggctgctgccttcggcggggcggggtgggagaggacgagggcgtcggcggccggcgacgggcggtgcggtggcgcggcgacaccggagaaggggctctgcgaggttcaccggcctgggggacgacgacagcttggaggacctcctcatcgattcgcacgcgcatctcggtgagcagcgcgtcgtccggctccagcacgcccgtggcggccagcgactcgaacaacagcgccatgccatcggacttgacggtgtcgagggcgtcggagtggagggcgaccttggcaatgtcgtcgaggtcgggctggatcgaggccgtggtcgtcggcagggcggcccaaggggcacctgttcaaccggccgccatcggcgctggggaaggagccgccaccgcaccagaactacgccgccgtgttcgacagcctcgacgccgcggccgcccgacgagcgcgcgcaggtggagcgcgtcatggtgggcgaagagaacaagggcgtcctactccgggatggcgcgcaccggcgggagcggcacgcccggctgcagcagtgggcggcgcgcatggagatggccgggttcaccagcgtgcctccagtccgcaccgcctcggctggtgaggaggacgcagcccccgtcgccgcgcacctcgacgccggggtcacgctcctcgacccaggcggagtgggacgacggcgcggttggcggcgtcggaggtggtggcagcgcccctgctcccggcgctcggcaggccgtcccagaggaggtcggtgatgacccgattggcggcgtcggagttgtggtacgtgtcccagaagacgaacgccttgcggtcgctgcagggccgcgagttcggcaggcacaggccccccaccgtcatgcccaccgtcgccccaccgtggcggcgagcgcctgcgactccgactgcccgccggcgtcgaggccgacgccgacgccgacgcctagcaccgggtcgtcgtcgttccacgcgacgcgctgaagctgcgcgtgtgcgccaacgtgctcggcctcgttaaggccaaggtcggcgcggtggcgccgtatgagccctgctgctcgctgctcgacggcctcgtcgacctcgaagccgtcgtctgcccgcccgcgcagctgatcagatagttttgaccccatttgatcagatagttagctggatttgtttctgaaggaagcaacgactacatcaagaacttcttgcagccgttcatggcggacggccagacgtacacgcacgacacgttctccgcctcctcatcaccactctggaccggcaactaaaggcaagaacacacactaatctcccctgtgaaaatgaccagtaaagacgaggcctgatatatcgtccatggcggtggttaaattgttcgcttttgcagaggctgtacgggttgggcgcgaggaaggtggtgttcaactcgctgccgccgctgggctgcatcccgtcgcagcgcatccactccggcaacggcaagtgcctggaccacgtgaacgaatacgccgtggagttcaacgcggccgccaagaagctgctcaacggcatgaacgacgcatcgccgccgctttgcccccctcctccccaggcggcgacgccttgctccctgctcccacgtcaccgccgccgccgccgccgcgtcgccggccgccggacctcctctcccgcctcgcctcgtcgtctcttccccactcggcggttggtctgcccagaggccagagccccagagagaagagagagagaaggggggagagagaggaggctgacgtgtggggcctacgtgggtcccacgctgacttaggcgccacgtcggacaaaatcggagtcaaaaccaaagtgaacggttttgtaagttgagagatgacgtatatccggtttggttgggggacgatttcgtaactcgatgacaagttgagggaccttcggtgtactttttccgaattcagacaggccatgtccaatatcctcgactttgggcctctgtactttaactttgcagagcagttgggcctaggtcaaaaaccaagtggataagtctattttacctccctcaagtcatatccctggttgagtcgcatctatcaaccgatataacccatcatacaactcccagaaccactgcaaatcaattccccagccggttttgtcccacgtagcatcttagaccacttggataccttcagtcttaccggcgtgtactacccggtttgaccggccacccaatgccgacctgcacagttcaccaacagaaacactattcactgtattttcaataaacacttacctttgacaaattgttcatcacatatattaaatcaacacattaatttcataccaaggttatccagacaatgctcagccgaataatccgattgtgatcggattttctgcccctttatggtacaatagctagttgctcatgtacccttgaaccagagaaactcgaggaatagtccacgagcaactatagctaattggagacgatcttttgttgcaagtgtagtgcttgagagtgatcgtttgagtacacccaccaagagtctagtgttgatcggtggcttcaattgaaggcttcatcatgtcactcttagaagcgtgtttggtggtcttataagaagattatgggagaaatagcatttgtgtgaagatttttggggttttttcacagtgggaaagaaccaaaatatgagggcgatcgtggactttgtgactatatatgaaataggggcaaaactcttacgcatagtgttttaacgaggattagtggatattgttgaatctccgataccttaaaaaacccaatatcgttgtatctggaattccctttcttccactatctgtaacactttcccaactccactcctccatttttcacgtacacgtttttcaaatcgctaaacagtgtgttttttggtaaaaaaaaatataggaaagttgttgtaaaaatcatactccctccatctctaaatgtttgacaccgttgacttttttaaatatgtttgaccgtttgtcttattcaaaaaatttaagtaattattaattcttttcctactatttgattcattgttaaatatacttttatgtatacatatagttttacatattgcacaaaagtttttgaataagacgaacggtcaaacatgtttaaaaaagttaacggcgttaaaaatttaagtaaggagggagtattagtctatttaaagttttctttagctaatatataattaatcatgcgctaatctactattccggtttccatgtgaaagagagaagttctcaacttcaaccaacgaacacggtcttagtttgtgcgtttcttttcttagtctcaactagagtgtgtaagacgtcaactaggttagaaaactttgaaaagggttactttgaccgtgttcttcaaaaatcctattttacctccttgtagaacatctttgatcctgcactccagaaagcaagcaagcaatgatctgaacaacttatcaaagtagtcaaaaaatgtcctaagatcagactttttcagcacagtagcaacaacagtagccagtacgacctggttgatttggcccacagtatttactagctgggattatcacttcgtttaaaggtagcaagtttaatagtatatacaactaatagctctaattcatctatagccaattaaatagctaattcataaacagttatctataaaaatatactacacctttaatatagtctcacctcccacacacataatgtattggagtccgtgctgtagctggctgcaaatatgtagcacgctttctttctctctcctcttctcatctccacgtacgtgtgcgaacagctaacttatagcctgctattgtactcgctctaatttgataggagtagtagtagtatttcattggtaagctccggcgttgggctgcacctctctccttttgctgtcggtcatggaagcatcggcgcggagccccagcgagcgacgtcggcgacgcgaagccgcacgttctcgtcgactcgacgtcgtgccgtacccggccggcgcaggggcacatgctcccgcccctcgcctcgcgccgctgctggcgtcgcgctcgccttcctcggtcgcgccacggtcacgctgctttcccgtcgtccgcgtcgcggctcctcccggccgcgtgcgtcggctttttacctccgtttccgttagcacgtttttcaaattactcaacatacggtatgtttcatacgaaaactctctataaaagttactttaaaatataaaatatatctatttttgtcaagtttgtaataattaaaacttaattaatcatttgcgaatgattttctcgtattacatgcgccaacttaatctttatctcagtgagttttaaacaccaccttatttttatgttatatgttaagtttatttcttaaattaataatttatgcctataatcaaatcgataatccgtcgtaataatctactcgacaatctaaatcaaacgaaaagaatccccttaaattgccactaaattcccactcttatgttttcacgcacacgcttttcgaactactaaacgtgtgtgtttcgaaaaaaattctataggaaagtttctttgaaatatcatactacttccgtcccaaaatataagtagttttagagtcgtgcaagggtattgaatggagaagtgttgtgattgattaagaagacaaagtacgtggagaatttaaatgttggagggttgtaattggttgaaaacaaaatataggtggagataaattgctagaagtcgttatattttaggacggggtagcattaatctattttttaaatttgtttatctaatactcccttcgttcctaattaatcatcatataatattttgaggttattcccaaatgatcacctttttaatatgcattccctaaatctttctattatctgcgtatgaaagtaaatggacattgatacatatatatatatatatatatatatatatatatatatatatatatatatatatatatatatatatatccatgcgcacaactatatacaatcaacatgcaacattttggtttattattggttacaaaatagtcgggattacatgtaatagagtttgttaccgaagtaaatatagtacgagagaactattaacttttattaatcttggcgtactcttttaatacgatgaccaattaaaaaaatacttaattaatcatgcgttaatctactgctcatgtaaaaaagaaagataccaaccgctacaatccatcacaacctagcttctgacagaattagaagctccccaaacaacatagctagctttggtccagattttaagaaactgtaattataaaatccagaaaatgaactaggagttagaagctgtaaaacccaaccttttcagattctcagaaactggctatcaatcaattgtttctcagaacgtcagctccctacacatatcctactaaatatgaaacggaaggacagggtacctatctcgacgtcaaagtcattcgtatacaagacataaaaaaaaaaaaggtcagtcgtacaatagaagcactttcttttatcctacatggatacagcgatgacaaaaattaaatcttaaactttaattttaattttttaagaccttttattgtagtttctttttcaagattaacgtctaaatcattaataacacatatttaaaatttctaactataaattactaccggaggaccgttcgtcggcagcagccagagtctctgacgttgcatcgattgtgtttgtctaagccaattcactccagttctagtgttgaactgttgataattgggttgcacctctcgttttgctgtcggccatggacgcgcacgcaccgccccggagccctgcgtccgacggcggccatggcgacggcgacggcgacacgaagaagccgcacgtcctcgtcgtgccgtacccggcgcagggccacatgctcccgctcctcgacctcgtcgcgctgctggccgcgcgcggcctcgcgctcgccgtcgccgtgacgcccgggaacgtcccgctcctcgcgccgctgctggcgtcgtgcccgccgtcgtcggtcgccacggtcaccctgcctttcccggcggcgtcggcgtcggggctcctcccggccgggtgcggcgagaacaccaaggacctgccgggacacctcttccgcccgtttatggcctctctcgcggcgctccgcgcgccgctgctcgcctggtgcaaggcgcagcgccgccgccgccgccgcgtcacggccgtcgtctccgacatgttcacggggtggacgcagccgctcgccgcggacctcggcgtgccgcacgtgacgttctcggcctccggcgcgcactacctcgccgtgtcgcactccctctggcgccgcctgccgagaaggcgctgccccgacgaggccgtcagcttccaggacgtgcccggctcgcccacgttccgttggagccacctgtcgtggctgtaccggacgtacgtcgccggcgacgaggtctccgaggcgatccggcagttcttcctgtggaatctggagagctcatgcttcgtcgccaactctttcacggcgatcgaggccgcgtacgtggatcgcccgctcccggacctgatggagaagaaggtgtttgcggtgggccccctgtcggacgccgtgggccggtgcaccgaccgcggcgggaagccggcggtggcgccggcgagggtggcggcgtggctggacgcgttcgacgacggctccgtcctgtacgtctgcttcgggacgcagcaggcgctgtcgccggcgcaggcggcgagcctggccggcgcgctggggcggagcgcggcgccgttcgtctgggcggcgaggggcggcacgccggtgccgggcgggttcgaggcggcgacggcggcgcgcggtatggtcatccgcgggtgggcgccgcaggtggagatcctgcgccaccgcgccgtggggtggttcctgacgcactgcggctggaactcggtgctcgaggcggtcgccgccggcgtggcgatgctcgcgtggccgatgagcgccgaccagttcaccaacgcgtggctgctcgcggaggccggcgtggccgtggccgtggcggagggcgccgacgccgtgcccgacgccggacagatggccgacgccatagcctcggcgatcgggaacggcggggcgtcggtgagacagcgcgcggcggagctcggcaggagcacggcggcggcggtggcggagggtgggagttcttccgtagacttggaagagttggtgagcatcctaagctcgccaaagctgactaattaatgtatttttattcaaactgctactctctgtttcaggttagaagacgtaatcaaagtcaaactattctaagtttgattaattttataaaaaaaataataatattttaaacccaaaacaaatatattatgaaaatttattcaattatagatttaatgaaactatgctgttgttataaatattaatattttttctacagaattagttaaatttagagtagtatgaacaaagtcgaaacatcttataacctaaaacggagggagtatatattttattcctaataaactgtgattagatgcgaatataatggttattttcggaagctgggaatagtataatggttatttgggattggggctaagccggctaacctttgtcctagcaaacttattaccatcactgtattttatagggcaatgctattgaccaaacaaaatatcttcttagtatttctaaatttcatataaaccaaataaaattttactattgctattctattgaaacctataaaaaaaattagtaatcctgaaagtttctgtcataaagggtataggccacaaatactatcatagaaagcttacctgacttgataaataggaggtgaaccaaatcggctacttgtaagtagagcagaacttgggaatggctaacacttgtaatacaagataatgggtggatagaatattcgtaagcttcctatacataaaacaagtcgtatgtggctaaattactaataactacatgtaactgtgtatctcaatctatataagatgggcgtgggtctcaagattggggcagatgcaatcacatgaacatgacatatacaaaaccctatagcaatacaattcactaaacaagagtagagtacggtattaatataattatctctcatcgagtttgtataaatctctttctcttgtatcaccattgagctcttagttcaacgcatagcgttctaacaaacgacactactattaataactttaccgaatactttacaacaaacacatataagagcaagttcatagtatagccgtctatcagctccaatatatctatagtcaatttaataactaatacatacaatagttacctactatactatagatacatggtcccacctgtcatacacacattgcgtcttgcaatccgtgctgcagctggctataaatatgtagcccgctgcacttctttctcatctttttatctcctagaaatgtatttatatctggcttatagtttgttattgtacctgctctaatactaccaacaacaataatacatttaactttgatagccttgaaagtggcaaaaaaaaatgaacatactcttttagagcaagtagtatggttctcattctcaacaaccatcttcccacatgtacacagtgacatgttattcaagatgcacctggtgtcttcttgcaactgttggagtacagaatcactagtgcagaacttcttttttttttaagttttagaattctgacctacacgtttattttatcttttagtgggatacctgtatgattcatatatatgttcatccctatctctctatatgcactgtgcttgtaatctctactatcgaaatctgtacaaatcagagggcaattagcgaggccacgtggcatgactggattcatgggtttggtccctcgcgcacagccgtcagatcacgcatctacggtgatatatcgtgcggtggatcttgttgtaaaatataatctttcgagggagtttaatgcaaaagagtagagtatccatactccagtaaatacttcgttcgtcatccgttcccatccgccgccaaggctccaatctccgctcgttccccaccgcggccgtcgcctcgctgtcgccgggcggctgccgatcccgagccaacagcccgccctgctgccggcacgcggtcgttgaatcgagggcgctgcctcgcccccatgattttctggtgcgtcgccgctctccacgtgttcctcatcagccgcaacgtccactttctccgccaccggcagccgaggcgccgcctccgcccacatcgcagcattgacttctccaggttggctcaccaactccatcggctattccaggtcatccaccgtctcacccctctgaattgcaaactactatcccctgctgcactctgcctgttcgttgtaatgcttattagtggaaaatagttcaacaatgtcatctgccaacgattagtagaacctatgatgtgaatccatcatgttgtttgtctgtgaccactgagagtttaataatgcttattaatatgttgccatgcgaatgctcctagaccaaaatgtagtctctgtcagtttcttgggtttctttgtaaccatctgaatttaaatcggtaaattgcctatctgttgtatgtaatttcagaagtttaaaatagcaaacgtcaagatggggctatctcatgataaccttaagtggtaagatgaggttggggatacaattcatatcaagagttttttactgatttggaccaattatcatgtacaattttaaaatgacacaaataaaaaaaaatgacacaaagaaaaattatgtagacatgaactgcaaaaacatatatggtgattagatacttagatgaatgagagagaatccttgcttacttggtgcaagattaaagattaaaagaaacggtaaagtttatctacggtaaagttcagctgcatatataagttacaatgtgcaacacgtaagaccaggcttctttgcaatcatttatctactaagaatctactggtacaagaggattaggaggcaccagcatattctgctcatgtttgaggtaaacgctataccaaattattaaacgaataatcaattcctcaggctctttgtgtaaactgaaatgcactcaaaacgtgatctttaaagaataagaagtgaaagttattttaaaaaaaggatttccagagttcttatagacatctggagggataaaatgaagataagtactttcattactttggttcattggactttagaatttgtgcgcacatattcgactttcaactgatgtcgatgaactcattgtcttgcagccttcaattgatctgaataaagcttattccagaaactatgtcatatctgagaacaattagatattagaattaaattaaattcatattacagagagcagaaattggtactagaactgttatgtcgttagcattattatgttactttatattacagattgtttctgcattttctcagcactcaagtggaaaataagctggaaattcatgcatcgttttgtaattttaataaatttgtaaactaataaatagcccatggagatctttctcatacattgtagtgctgtcgaaactcaagtatggttgaattagtaccatgattaatcgtagcttcatgcactttcttttattttggcaatggtctctttgcgtactcttctattcatgcaatgacatgatactgaatactgagcattgaattctgaaactgaactggcattattttgaagaaataaaaaaaaaccaatcatgttattaggcaacaagatcagtgatcatgctcaagttgataaggaaccatattattaaatgtttaattttgattattttcctagcctggtactgaagtactgtctaatttgacctctgaagtacttgacatttgaattttttctaccattgccatgaagattttgtaaggttgctttttattatacctgtacagttagatgcaatatttaaccaatcgaagtaggagtttttgtgtattcttttaatatataatttttttcctttcaaaaatgcggaagaaaaacaaattggaattgcaaaatttaacgctgacaaagcatccattcaaggcattcctttcttttttgagagaatcccttatatgccactagaaattggttagttctcttatatgccactcaaaattggcttctcccttatacaccactagttaagtttttctatccttttatgctactcccagcactatagcatttgttgactgttagtcaaatattagttttttttcataaatgaccaatatgccatctcaactaaaaaatgtgtaaacttcaaaaaaatcataactaatttattttaaatcctttttgagtgaacaaagttttgtcagaacaagtggaaaatgctctttgtaataaaaatattgttggaaagctgcatgtttcatacttgtattgaaaatttatttgtgatggtgatggctaaaattgcatgtgattgaaaaacaaaatcaattttcatatgttgtatccagtagatatattagtactaaaatacctatcattggttatataccaactctcaatggtaaatgtgtctttttactatgaagttaacggtcaactgacggtggagtgacggcaatggcataaaagggaggacaaacttgaaccggtggcatagaaaggaagagccaatttgaaggggcatataagagaaccggttaatttggagtgacacataagggattctcactcttttttcatgttagcaatggtgtaattaatactcacctgtcaaatacataaatcccctgccaatggttctactgagtcctttttcttgctcttgttcaagaacattttattttcctcttctgatctcaagtcccaacgtctattaatttatttctttaggtttctggttcaatatgttaagaaaaaaaaccattgatcctaaacaaggccactgacaaaatagattggcctaatctaaattgggcgcggcaaagccgcacgttgtttctagtaagttttctaagttcagcaactttttttgtaagtcatgggtagagaaaccatttttggttggtcgacccaaattcacaatagtcccggttccattaaaaactgggacttataagaggatgatctttagtcccggttggaaactccaaccggaattaaaaatcatttttagtcccggttgattccatgttaggctgtattagggccctaggatctttagttccggttagtaacaccatccaggactaaaaacctatttttagttctggttgatgttactaaccgggaataaaaatcaaaacacactatatagtccctagtaccgatcctcttttcccatccacacaacaaactcctccctctatctcttttttcctctctaacttcttatctctttccttatctctaactcctagccttctctttcctttttttttccttccattcaaagcgagaagagggcgggccggccaggcaacgggcggcgcggggggccgcgcggcggcggccggcggcggccggccgccgcggaggggaggataggaggcggcagtggccggctgattgttcttttttttttacaatttatgatttatcctgtgatgtatttgatttgtgtgtgatgtgaatcttgatgtattttttagaacttgtgatgtaatttttttaagagtttggatgtatttagagatgatctatttgaggatttggagatgttctgtgatatgtgatgatttggatttgggatttcttagtatgattaggggatggtgtgaaatcaatattcaatgttaaaaataatgaaaaagagaaaaaaaaagaaaaaatatctttagtcccggttatttgaaccgggactaaatctttttagtcccggattcgtagtcccgggattaaaaagtacttctccaccagtgagtgttattgatgacgggggctgatacagccttgtgtctagcttcataaatttctattaatattttataacaatatcatataatttataaaaacatttaaacttctactattagaatacctaattatataaccctacacgcgaggatttcctagttgctccaataactgatgcctatcatggttcatggagcaagatgacaggagtttgagacatttagctaatttatttattatgccgatgggtttccttggaagagttgagacattttattatgccgatggactcaagggttggctgatgactccatattgttttcttcaccagtaagggtttgtttggattagtgtcctactattattttttaagttttgtcactactaccaattatttggtagaataaatttgtattcatcttatttggtttgctactaaaatattgctaaattgtgatactatactgaagaaagttctatattactaccaaatttggtatagacattaccaaaaagttagcatcaatccaaacaaatgataggtactatttatgctactaaaatattgttttggtagcaatccaaaactaccctaattctctgctaaaaggcttggacatggacacgtaagtatacctgtgtctgcctgccaatttaggtctggtgccaaaattaaccttaccaaaatttgggaataccaaaattttaacaaactgacactattgccaaaatttcggtaggattagcttaataatgttaccaaaattctatacatattgccaatatttggtaacaaactaaatatagctacataattgtcaattttaacaaataatggtatagttgaaaatgtcatcaatctgaacagccccttaatttgcaagtggagcacacggtgaaagtggtgactgcaagacttcttctacagtactacaacagtactacagagtagggatgtcaattgtgcccgtttacccgttaacccatggataaaaacctattagggttgggtttgttctccattttatacccatgggtatcttgttgggtcaaaagctatgcccgatgggtaaatgggtatgggtatgtgtaatcactacccatgcccgctttgcccgtttacccgtgaaatctaacttacatttaggctaggatcaaaatccactagaatacataagccacgttctttgttttctacggtttcccttttattttccttattatttctctccccctctatcgtcaccagaggagagacaccacaccgaggcggagaatatttgatgttttaagtttgatttgaacttagaagcttgtagactttttgttccactgcttttgttgtggcgggtaaccatccttacccgtcatgtagtaatgggtatacccacgggcacaaataatctcacgggcacgggtatgaataggcactacccatgcccgtcacacccaattgccatccctactgcagagatgtactgttcatatgagggagcagtgaactaatgccataaacagtgttgcttactgtagctactggaaccaaaaaaacgtactgttgcatattgtctgtaccaaatttaccttagcgtgcgatccgattctgtcggtctacagtacccctaatgtgcagtacatttcatcctctccctttagtatctcttatgcagaggatctcaatttagcttggtggggtttttttccacagttagtacacgaaattctggtgggcattctataattttccacggtgaaaggtatgggcggcgctctagtggaagaatatggattgattcttcaggctattccactgtggccttgtttagttctaaactttttctttaaacttttaactttttcatcacatcaaaatttttctacacacataaacttctaacttttccgtcacattgttttaatttaaaccaaacttttaattctgacgtgaactaaacacaccctatagcagctaggattcatgtgctcgaatagctttgaaatcatgacggctaaatactctctctctgttcctataatatagcaagttaaaactagacgaaaaattttatagtataataaatctgaccacatttttatttagattcgttatactataaaatatcttatctatttttaaattgctatattatgttacggggagtacaaacaaggatctttcgaggagtgattggagtgaagaccgatgcaccacttacagtataaaaggaacacgtgtgtacagttgcgacaatgatgacttgtagtacgttgatagtgttgtcggcgtgtggttggtgagttttcttcaagttacagtcttcaaaaagataatctgagtgtgaagattttaaagtatacggactcacatttaaatcattaaacgtagaataataacaaaataaattacagattccgtctataaactgcgagacaaatttattaaacctaattaatccgtcattagcaaatatttactgtagcatcacattgtcaaattgtggcgtaattaggctcaaaagattcgtctcgtaatttacaagcaaattgtacaattggtattttttcccctcacatttaatgtcccatgtatgtgtccaaactctaaacatttgatgtgattttttttgacaaaaattttaggatctcaacgagacctttgtcctactataccaatagaaactttatgttgtccaatgctattcgttaaaaaaaaggtcatgtatggtatgcgtcactcgaatttacctctgtgcatagtcttgccaactaggtatcccctccatccctaattgtagttttttctttttttttcttttttttaaaccgttgaaccaacggtactccatacatctgctcgtatttagttgctataaaaataaccactttacctttatacataaaagaaatatgaaaatccgtagaccaaattattagggttaattacaaactagcatggtggcccgcgcagattgcgcggctagtatcattatattctctctcatataatagcatatatgttttctcattatattattcaaatatattaaaatcacaacatatttttaaattttgcaataactttacaaaactattaatgtgtaatatttatattgtattttatatacgtgttagttattaattatttttaatattaaattttagttatttgtaaattatatatattcctatatggactctagactcgtcttttaatacttcttttttttaatttcgaattttctgtaaattgtatttctatatagactctatgctcttctttcaatattatttatttttatttcttaatttttattatttttaattgtatttctatgtggactctaaactcatctttcaatattttttaatttttaatttcgaatttcagttacttctaaattgtattcctatatgtactttaaactcttctttccatgttttttttaatttcgaattttagttatttataaattgtattttatacagactctaaactctacttttaattttattatgtttattctaaattttagttagttagaagcccgacgaccgcgccaagcacttccgctgccgcacgtcgcctgcaacccaacgtaacttaatgttgttggatttttcatttcatgattttgtggatttgtgattcattttcttgctcagatggatcggattgggagagaggtaatacatgggtattaggtttcttgcggggatcaaattcatgaggtcgagattggtattttcgtgttgtttttgattatctggttgattgattgatttgaggatctagctcggggattctttctgaaggcagactcggactcggggaaggacagatcacacggacgagtgaaaaatcatacatacgaatgaaaattatgtgacgataggaaaaatactaatcttttaattagttaagatatgtactctatactctacttctaatatttcttatttttaattccgaatttccgttatttcctaattgtatttctatatggactctatactctacttctaatattccttatttttaattccgaatttcagttattttctaattgtatttttatatggactctagtcccctcttctaatattccttattttttaactctgaatttcaactatttctaaattgtatttctatatggactctagtctcctattctaatattccttattttttaattccgaatttcagctatttcctaattgtatttctatatggactctagtctcctcttctaatattccttatttttaaatttcgaatttcagctatttctaaattgtatttctatatggactctagtcttctattctaatattccttatttttaattccgaatttcagctatttctaaattgtatttctatatggactctgctttttctttttctccgattaatgtgagaatttctaggccataagagcgaacgtggaggctcctttttctattcctttaataatataatagatgtgcgtatttagataaataccattacaatttgtctatttatagttgtgccactcaaatttaataaaattggaaccataccatcgccgttcatttttcatcctctccctcatatgctcgtgggacccacctgtcagattcatcttcttcctccaccctctcctctttctctttttttttccaatctctctcccccacgtctgtgatgttcgccgttgcgccagggaacgggtcaccggcacggaggttgttgtcagcgtccgtcaccctgtgctgctgtgcaccaccttgtgcgttggctagccgtgctcgccgacgccattctctgcaaagatttaacgtttctcactatcaatttaacaaatgaactcatcaaatctaccgatagcgattggatttaacaagaatgtaccaaccaagatcgaagcagtcggcggctcggcgtcgtgggggctgcccatggcgggggcctcccggccgaggcgacgtggaagccttcccgccgcacagggcgtccctaggggcgtacggccagcgcgcccgcgcagggtccccaattttcaggggccccctaggcccaaaacttcaacgcactagatatataactcaataagtaaattggtagtctaactagtcctaaaaatctgttatttttcttgtcgtttcggcttcgattacgcctttgccggttcgcacagttgcgccggttcgcaatcttgaatcgcctcccactatggaccttgccaatcacaacgaacgagaggagtaaacgacgcctcacttctttctctcgtgcggtcgtgccggttgacgcctgccgcgcccctgacctaattctttctggtaatttctaatccggtaatctctaattttggattatcattttaggccattctagattgctatgaaatatattacagagtataattattttcatattatatcatcaattaagtttttatccttcaactttacacagggccctcgaatttaacgggacggccctgccgccgtatgtcaaggtccccaaccgccgacacgttgccgccgccgccattcgtcttgacggactgcgccactaagcagcagcacgagatggcgaggaggaggcagagaagagaggcggcgtccgccacgttcacaagaggaggctgagaagtggtagagagagatggaaaaaaaagagaaaagaggaggatggaggaagaaaatgaatctgataggcgggtcccacgtgcatattgggggagaagatggaaaatgtggtggcgatggcatggttctaattttaaaaatttgagtggcacggttataaatagacgatttgtaatgtcatttatctgaataggtatatttgcaatggcatgaatcaaattaacccaaattattaaaagtgtacaattttggtagggttagtgaaggtgctatttcagcatcctatgccatgtcatgttgaattttggatcggtgttggtatatttagttagtttagaggtcttaagatactttttaaaatagtttataaattcaatacatccactcacatgttaattaccatcaatgtattttactcttttaatgcactactgtttcttttttccttcgattattggcacggattgtttatccaggtaagactataaatcaatatttaaaaaataaactacgtaaatagcttagaataggtggtataatcatgcaacaaagaaagtttccttttgagaaatattttttttagaagcgtggagtacaaaaatgcagggaaaacactgaaaaaaaaaagcataataataacgtagttatatttttttttacggaggaagtgtataatacggcctcgcgcgaacctaccaggtttttactcctgcaaaaacacggatacaaaagcttaaaaaaaaacagtattagatcgagaaccctagccccctagttcgccatggactttcgacgacggaagccgccgaaggacggcagggtgttcgtccgcggtctcgccgcgggcaccgccggcgaggcggacctcctccgccacttcgatcgttacggagtggtggacgaagtctccatcccgagggtcgtcggcgaggtcgacagcctcaccggcctcccggccctccgcttcgccatcgtcaagttcggccaccccgagttcgccggcctcgccctcaacgatcgggagcaggtcatcgacggccagatggtatggtcggcgtctccgatcgacttgacacagttaatctctctttctgaatataagcagaataaggcgtgtcaaattttcttggtttatattgcgccatatgtaattgtgctcaaacaaacaaatcatgttttaaatatgtaattgttgctggaacgggacgaccggctgcaggtagccatcgtgctgcggctgctgctgaaatgggaagccctgctgcaggtggacatcgtcgtgctgcggcggctgcaacggcaagtcctcctggtgcgaagcctgatcagtcaaccggtggagcttggtgttctccaggaacagagcatgcgcaagagagatgacgtcctccagatactgccacgaggttcctcgtggagggtagattccttccatgtcttttcccaagttcttgagagcaagacttgccatatggattcgggattggattttaatccctcgtgcgtgtcactaaaatagttacgaaaaaaattgagaagatatattaacatgtgatatatcgcttcacaaaaatgcaaattaaaattcaatttctacatctcgcaaaataaatttaactgtgaatatatgttaactagctatagtttaattttttttcgttgcgagatgtagaagttaaatttgaacttgtatgtttatggagtaatatattacatgttacatcttctcaaattttcttcataactattttaagtgacatacaaataacgatgtgacatccttcgaaggatcgaaatagtttcccatatggattcggagtcctcagcgttctcgcagttggttgggtagtatagggaagcatcctttcgcagggaccgtagatttgatcgggcgagtttggcgagtggcgctggttccgaacctcgcacgtcgtgtttggcaagcgcatcattctgcaactcgtggctggtgtcgcggtggcgctggcgcatcaggatcaggtccgcagcttcggccttcgggatctctgaccgcgcggccgtgctgctctgcgtccgcatcgttctgcaactcgtggccggtgtggcggtggcgcagcaggttctcgtagtcgtactcgtactcgtctatgacgatctcgccgccgtgccgctcgaagtccgaactttaagcagcctcggccaaacgccatggaagagacatcacaacccactggctcctgcaaaaaaaaccattcacaaactcaggatcgattctgcattactcggctaagaatctaatcgaaacaacacacagtaggatgcaaattcagttactgtcaaatgcagtttcagtttgatccacaaaattcattctgcacatgtaggatggcaaaaccattgcacgattagttgatcaccttcagtttaatttatctaagattggagtaaatgacagtaacaacgcacttctagttataaattattgtaatttgagatttgagatacacccttgccgcgccatgcagttaacaatttttaatggcacgcacgagcacaagaactttcaccgatcaaccgactcgaggtatgcagtttccagctcattcgccatcttctccatcgcgatccacgagctgccaccttcctccaccgccgccgcggcggccgcggcgagctcgctggtcttggccctcacatccgccagcttcccggcgtccgcggcgtcggcgaacacgcgcgcgagcgcccccgggtagggcacagcgcccgcgccatccgcggcacgcacaccggcgccgtgcaggtcgaccacgagccgcgcgtcgatgaactggtcggccttcatcggccaggcgaggagcggcaccccggcggcgacgccctcgagcgtcgagttccagccgcagtgcgtcaggaacgcgcccacggcggcgtgccggaggatctccatctgcggcgcccagccgcgcacgacgcggccacgcgcggccgtcctctcctccagcccctccggcaccacggcggcgtccgcgcccacctcccagacgaaccgcgcgccgctcgcctccagcgcggcgcccagcgccgccgcctgggccggcggcggcttgtacatgctcccgaagcagacatagaccaccgaacgcgagggacacgtgtcgagccaggagaacagctgctctgcttccgatgacctctcctctccccggcagccggagtcggcgaccgggccgaccgaccacacgcggccatggccgaagaacctgttcaggtactccaagaactcgccctcgatctcgtcaaatgaattcaccacggcgccccaagctctggagttgagcaagaagccttcccgcacgagctcccagtccggatcgccggcgacgtagctcctcaccaccgacgggacatgctcgtacgggaaagacggggacccgggaagagggggacacggaggtcgtcggcgaggagctgcacccatccaagaaagaagtcggagacgacgacggtgggggcatcgtccgggcgagaccgcgcccaggagaggagcggcgcgctgataccggagagatggacggcgaggagcgcgtggtgtgagttctcgtggagggaggcgtcggggagatggatcgggagggcggcggcgaggggggtggatgcgaggaaggcggagaggagggggagatcggaggccgtgacggcgacggtgagggcgacgccgtggcgggtggagaggcggtgggcgaagtcgaggagcggcaggaggtggccccgcgacggcaaggggacgacgagggcatgcggccgccgccgggagggcacgccgtcgttggtggacatggcggccggagaagagtttgattgcgcgcgaggaccagtagtctctggagatgagtgaacctccgaggcttggagtgagtggtgataggctgtcgagcagtagcatttctagctgctctatgacaatcaacatcagtcaattattacttcctccggctcgttttaaacataacgatgatttcgtgtctaatcttaatcatttgtattatttaattttttttatttttattattattagataacaaacatgaatactactttatacgttacttatattttttattttttaaaaaataattaaaataaaatgaatgattaaaattgaacgtgtaacctcatgactatatttataatatgacagtggaagcattttattagaagactttatacttaattagttgttgaaatggtagtagtatgaacagcttgtgctcgccaccgacccggatgcggaccgccactgggcgtgctaggctcgtgaagtcaaattacacggcgactcggctgggccccgacgctcgcagggatttcggcggggcttttaactattcgccatttttagatttgggctgtgtttatatctaaactttagatctaaatttttaacttttttcatcacattaacctgtcatacacacaacttttcagttacatcgtaccaatttcaacccaaactttcaacttttaaaaaaactaaacacagacttggcaaataactatttgccacccctatcttaatgacatgtgggtccacatgtatctatgacatgtgggttcagtggcaaaaagttaattgccacatctaaatgtggcaaatggttaagagggtgtttaggaagaagggactaaaatttagtccctcataaaattgtagtccctcccacagggacttatgcttttgtgtccctccttcccaaacaccacctaaatatctcgatttcggggggctcgcgggcagcttgggggaccacgagagctcacggaataagttcaccggatgtccctcaattgtacgccgagtctttctgaggtctctaaccacaataacaaaaaatgtgtatctctaagatatgtaaaaccgttcaaaaaaatcccaaaatagtatagatgtctggtttcgttgatatgacattatagtcaacaaaaaataaaaaaataaaaagtgtggcccacatgcaagtgagaagaaaaaaatatgaagcccacgcgtcagcattatcttctttctttctcttttctttttttttccttctacctcaagctgtgccacaggcacacacagggacgcaattacggcgcgctcgtgttcctcaggctggagcttatgctcgtcatcctcgccatgccctgcgtctcccaggcgtcggcggtgctcatccgaggcggcactacgaccgggctggcaccgggctggccggtgggatcgtgctcacggcgttcctggttgctctgctgctgttcctgtcgctgggcgtcactacggggaggctgctgcactacaaggaggtgcaccaggagattgttcgccggacgctcggccccggcaagcgtgctcagtggacgtggaaggaccccgcccgccctgcctggctcgtcaagctcagtccgctcttcgatgacctgcgtgtctcgcccaagtacatgctctcgcagatcgcaggcagcggcctcgtagcggatcatcgtgtccgacgacgagaatgaggacgccgaggcgccgttcctgcagaagttgctcggcatactacggattgttgacgattcttaaatcataatataatatctgactgtcaatatctgcatataataaaataaaacatgatatccgacttagtggtaggtattattactaatcatttccactagtgatggtgaaatatgtgtatgcaggtgttttaagaaaaaaacacatccgtcaagcaacaaactgcacctccgcgcattcaggatacatttacacagattgaaggccctataaatcaagtaaacaactctaaatgggcccaactatcatgccaatgggctgagggcctcaaaattagtgtccacgacaaaaaaacgggccgaacggagccgtcccgggttcggccgaacctccaattcggccgaatactttttgtagccgttgatcgtgagattcgacatggacggccctgatctcttcccgatgacggttggagggtagtttggtcgtttcctatacctgtaaccgtcatatggaggctataaatagagctcatctcattcattcacaacacacaactttgagatgaattattattggtatttcttaacgacattactagaaatataatttccagcaatgacgcagaaatacttctggtatattatggttatagagttcatccgcaagcgcacggatacaccatagtagcatttcacccgagagtattccaagagtatcgtatttattttatcccgtgggaagatcatgtagagagaactcaactaataacttatatattacttgtgataatcatattctaagcaggggttaagataatccaagggtacagtgacacacaagcattactactcatcctcgtaataattaatctaagctaggtagaaagaaaagagaaagagaatctattcctatacttctaatatacatagtatacatacattctagttaactggtatactagctaataccctctatccgtaataattaatctaagctaggtggaaagaaaagagaaagagaatctattcctatacttctaatatacatagtatacatacattctagttaactggtatactagctaataccctctatccgatgccctcctggtacttcgagaagccacccctgactgctgagttccttacgacagcccgtcatgaccatccaaccagggctaaatacggaggaataccctcctcaggaaattaacttaggattatatataggcgcggaggaatacccgtactgagctgtcaccatcagcggcacacctctcatctgcaatatataaccccaaataatgatatcccgtaacctagacaccacgtctaaactaccagatactactctaatattatcatcatgacatagagtaattgcataagcaaacactatacccgcaccaaagcatctcccagataagctagcagtatattcagtataacatgaacataatgtaaagtaggtactaacatactcggaaagtatttcaataccataaatggtacactctgtctgtcaagaaattccacggtgaatgggaggagcttaagtgcaatttctgccttactttcttgacagacagagtgtaccattgtttcgcttcttctctaagagaaagaaacaatttccactttagagtttcatgtgtcatgcctacgatggataggcacgaagacactagctcaaagtcccgaagatggaggtatgggcgttcaccgatactaccagagaaggttttctctcgaaccatggctataaagccaggactgatttcgtagccatccgaaaggattggttttgaagaacaggatggctcacaaagatcagcccgaggagcagaaatgttttgaattgtgggttgctccatcaaggaaaggaatcaaagaagaagaaatatacataaagatacgaggatgacctagactcggataaattaacaaccgttccccggcaacggcgccagaaatacttgttggtatttcttacgaccacagataaatccgcaagcgcacagaataccgctgtagcacttcaccttcgggtgaccccaaaaggatatcaaactcagggaacatgtgtaatctacctaatgctaagacaatccgaggagaacaactaaagataggtaggctaggctagaaaggtctttctaagggttttaattatctaagctaagttaaaggtaattccctatctgttgctttgggcaccgacccctgctagtctgtcagcgtggttctggctatagctctatgatgtatccgaacgtggaggattacttggacgggattcagggctgtcaccacctaccgcctacctctgacaaatccgtgggatacacaacaaacaaaggtaatatctaacctagacaccacgtctaagttattaattactactctaatactcgagcaggaacttccttctctatccggagtcctagtactagtgcacttagtataaatactaaacaatgaacctgcaaagatggaaatctatcttactcagacaaaataattaaataacataacaaaggaacacgaatgcttactttatagaagaagttctccgaatcaggagcagagtgtaccgacagctccggtactcctccagaattcctcctaggaagctacactcgtcgaggtagaagtcggatgagcgccaaacttccgggcactcctccagagcttcccctcactctctaccttattctcatgtacaaaagatacaatagagcctcttataattcagctcaaagttgtgtgttgtgaatgaatgagaggagctctatttatagcctccatatgacggttacatgtatgggaaacgaccaaactaccctccaaccgtcatcaggaagagatcagggccgtccacgttgaatctcacgatcaacggctacaaaaagtgttcgggcggaacccaggacggctccgttcggcccgtttttcatcgtggacactaattttgaggccctcaacccattggcatgatagttgggcccatttggagttgtttacttgacttatggggcctccaatccgtgtaaatatgtcctgaatacgcggaggtgcagtttgttgcttgacggatgtgttttcttcttaaaatacctgcatacacatatttcaccaacactagtgaaaatgattagtaataatacttaccactaatttggataccatgttttatttcattatatgcaggtattgacggtcagatattatgatttaaggaccgtcaacacggatctacttcacgttcatggagtcggtgaagcgggtggcgctggggatcgtggcgagcacgcacatacgctggcacacatcgtcggaccactcgtcgtgtgcgaacgccgtggtggtgctcgccatcgcctccttccagctcttcttcatccgcaaccgcgctcgcctgccgccgccgccgctgttccgcagccacactcgcccgccgacgtcatcgctttgcctgctctgggcgcccgttgccgctccctctccgcaggaagaacgaaagataagaagagaaaaaagaaaagagaaaggaagaagatgatgctgacacgtgggtcctatatttttttattctcacttacatgtaggcttcacatttttattttttatttttttactgactagatgccacaccagcgaaaccagacatctatgctgccttgggaccttctttgaacagttttaca

SEQ ID NO: 58374 - DNA, 1907 bp, Oryza sativa
ttgtcatcataagaatgtcatgcttatcatttacttctaacttgccactgaatgctttggagtatgatgtcacgcttatccagcataccatgtttgacaacttgtcactaactgcatcatattagctttcctagcctccgggtgctagatactactgctattcgatgcaagggtcgataacttttgcctttgaattacgtttctcaaaagaaccaacttatcacacttgacatgctttgacatcttcctaaataactttactactgaacttgttattgtctgaccgttttcctgccaaatctgaagctttgttgttagatgcgattttaatctgacctcggtaaactatcttcgaacatatcacttggttcataactgggaatagctcccacgaacagacaactcggattcactttccactcctcagttagcattcaacgtattcctttacacctttaaccttgatgtgttctttccagatttctcttatcaatcacctttcgacctacttctttgcctgatcataaacacctttgctggtatcttctgagagagtcctcatagaacttgtctgtattacacatttctccctcattacatgaatactaagcattgtctaaaaggaaaggtgcttagcaatggtacattgcatcctcaacatgaatcttccataaacataacgaactcattgtttataatcatgaatatatttatttattacatgattgctacaaactttctattacacaatgataagtagcgaactgaaaaccacaaacggggctgctcactttgattcgggggagatatagctggcattgtcctagtgactgcatccttgattggttctgtgatgatgtggtaggactgcgtattgctatcattcacaggagaagcttccttctgattgctgtttgaagcggatgacggttttctgcttggtatcgccctcctgaggttgattgccctttgcttggcctggagtaggtcggggagagacacaacttcttccatcaacgacaattctttgctgaggctgtcggtgcagagaatggttggtgctgaaggtattattgctatgatttattgcagagtcaggtgcagcaggaggagcattggtgctgtggatgatatcgtcgatattgccgttggagctgactagctgatgagacaatcgtagggttgttcgttggatttctgcggtcttggtcgacaacacactgagttggcaatccttgggcacatggtttgtaccttcgcatagaaaacatgtgaccttgcaggtgggacactcccctggtggatggtcttcttcacaataagcgcagagtgtgagacacatgctagcaacgtgtccaatttctccacaacgggtgcatgcctttgattccatctcttcctcgccgagatgtcggggagactcatcttcatcatccgaggagacttgatctgacccttcactatcagatactctgccaccgtggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgagtcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctattaaaccaaaggaaggggcttctttggcatatacccatggacaattcagggcatagtgtccttgttctctacaatcgtgacaaaaggggacatct

SEQ ID NO: 58375 - DNA, 11761 bp, Oryza sativa
ttttgttaatgaacgggcttaagaatacctgatgtgtttgctgcaatgctcagctgcaagggactcttcaaacttgcttgcccatgaggctgcatttgcactaggacaaatgcaagatgctgaggctatccctgcattagaggcagttctcaaagatctttcacttcatccaattgtccgacacgaggtaattgctacgacggactaatgccatcttctgcttatagtgatttactttcaattttgagaagctttgtatgtttattcattcattaggctgcggaagcgcttggagctattggcctggaaaagagcatttccctgctggaggagagtttagctgttgatcctgccgtggaagttcaagaaacatgtgagctggctattagacggatagaagagcaaaagaatactagtggagttgaaagtgcaactgtttcaccttttctctcagttgatccagcactgcctgcaaagcaaggacttccagtagaacaactaaggcatgtcgttcaacacagtcctacatgtcttcattgtgctttgtgtgtattatcatgctactaatagcatggttattaattttcagggagcttcttctcaacgagcaagaaagcatgtatgaacgttatgcagctctctttgcactaaggaatgacagtggagatgctgctgtttctgctattgttgctgctctaggcgtcaaaagtgctcttctacgccacgaggtttgcttgaagccttgaacttcgataatcgctgttgcatctttgtccacaagcataagttatgcagatccttacatctcttgttatgatacagaaaggacattagcaaagcaaaattatccagttacacctactcagttttgtagtaattaggatacccaataaattgttttctgtaagaaactaggggtggagcttcatccaaataaggtagagaaaaaggcaacatatcaggataggtttggtggcatgatgtatttcatgagacagctgaatattctagagtgcacatttcttgatctattcatgatagcaccatctctaaagatcaatctattctttttattgagataatcaacaacctttttcatattgttactgttatttatgttgtcattgtgttctccactgtaatcattttttcttctgtaatgttttgcaggttgcttatgtgttaggccagctacaaaacaaagctgcttcagatgcactttccactgtcctgaagaatgttgatgagcatccaatggtcaggcatgaagctgctgaggcccttggttcaattgcaggtaactaatacgataagatttgatttcatcagtctctcatcaaccatggatatatgtcaaagctttgtgagaatatgtccaatgctgtcctgcagatcaggaaagcattgcacttctggaggagtttgcaaaggaccctgagccaatagtctcccagagctgcgaagtagcactcagcatgcttgaatatgagagatcagggaaggcctttgaggtacatacatacacgccaggcctagatcaaacagaaaagcatttgtaactagctttgtggcattgtctaacacattgtgctgtgttgttccattccatgcagtttttgttcccgcagactcctcaggtgcagcaggagtcctaagtgagttgtgaaagtgtgaactgagagcgagaggcaggctggaatgtgtctaatcctgtaatccaaaccttataccagtctaccttgaattgatatgttcgtcaaaaggatttactgatcaatctctgggctctcattctaggaagaaaagagaatgtgttttctttgagtaccaactagactaggtgcttaatgatcctattaacgcattgtttttttttaatcttgcacatatatttcgttattaaaatgagtagtacaagatataagtgggataatgcacataataccacgatgctgattaattgtctgcagttgaacactacagtgccactgcacatgatgtcataccaccgcagcaatgcagcatatgcaatataaataatctagcttatcttttgactgttaacacaggaattaatgaagaactaaagggtgtgtgcactttattaccatttgcaactctactaaattttaataagataactgatcttactgatactattcttccaaatttggtagttttgaaagtttctcctaataaaaacattaccaacatttctttttttaaaaaacaaactaaacacatccaatgcaaccaaaatttagtaacaccaaaacatgtcaaaatttagcattaataaattttggtaaggttaattttgggaacaaagtgacacaagccctaacaaagagtgtgttatgatcacaattcaggagaagagatatgtgtatatatcaaaatcaaaactgtgaccaggtaaaacactggtcatcaagcatgaagtatttacaccgtcaaagcactctcatagaaccagtatacaacctcaacttgaggtgcaaaaccatgcaaaaatctgatggcacacgaatgcgcaagcataatgtcagcaaccagttggtactcacttctgccaactggtaatacagcagtcaaaccagggagaactcaatgcatgcgatgtgaaatcactgggtaaaaatcacctaaatgctatgagaggccaagtaagatcagtactccaatagcaattggtggaacctaatgcgtcatcagatgcttgacgaggtacccgagcacagcaaagatcactgccgcaacgagcagcgccacgacagaatgatacggccccccagcaccagcggcaactgcaaggaggagtagtgttagtgtcagcactcagaagattaatccggcctagtaccctactgattgtatacttgcaaatgacttaaccattattactccattgatcatatgaaaaatcaagaacagtgttaaattacacgcaagaagttccaagaacacaagtatgacatctatcaagaacaatacagcagaaaatgatgtaatcgaagatcaagaacaatacagcagaagatgatgaaatagaattgatgcccctctctcaatgcaagaactcacctcggagagtgtcgacggggaggacggcagctgaggcgttccccaacggcgggagccacgagagctcagaagcgtaggcgtcgccgtcctcacctaccaagttcctccaggcctgtaaatctgcaggtagcgaggaatcaggcattcaattgtttctacgagaagcagcgcagtagttgtttcgcaagaacatgagcattttatagtatttcgcaataaaatcaagaacagagggcactcgatatgtcgcaagaaaaccaagaaccagagcatttgatatttcgcaagaaaaccaagaaccagagggcactcgatatgtcgcaagaaaatcaagaaggagagggccaagaattaggaacctgagggacatgggcatgggcaccgcatatcggcgtcggcgtcgtaggtgtgcgaggccggcgatggaagtgatggtggtggctgctgccggaacaagggaactaagtagttgacgcaaagcttggcggcgccgtagaggaagacggcccaaacgatgatgctgagcagcgtgaagagcacggtcgtgaggcatgtagatgagaacacatcgtcgtcgtcgccgccgccgcgctccatatagtcgccgacgacgatgtcggtctcctcctcctcgccgccgtggccggcgcccgtcccctgctcgtcgtcgggctcacgcgggggcacgacctcaaccgcgagcgcaaccccgcctctgtcctccgccgggtgcagagctctctcccgctctggatgcagagcgtcgccgccgccgccgccgccgcttgcagccagcgccaccacggagtggacgacgtcgacgggtatgtcgagaaacacctcctcatcgagctcgaactcgtcctccgccatggggaacggaacggaggcggtgatgaaggatggtggtgggaggggaggggaaggtggggatcgagtggagagctttgaggtggtggtcggggtggaggaagaaaggggggaactcggcggctggggcgctgcttatataggcggttgggagcgtaacgcttcttcttcttcttcttggcggtcttcttctccaccgcagccgacggtcggagatacatggtgtgttcggtccgagtcggcgaccattgaccaccgacgcgcaactccggtcgtcggggaatagccactccggcgaggcccgggcccggagcttcaccggaaccccgccgcctccggcgatgcgcaacccacccctgtggcacgcggcccacgccatggaagtggcgactgagatcgaggagaagagactactccgtactatgtctatgtatcatcaccactggacccccatacaccggcaccggtccatgggccatggactcactcaccccgacttcctgttcttttcggtttactttttgcaagtatttttcataaaaaaaagttgttataaatatacatattaatccattttcaacttttaactaatatacttaattaattatgtactaatgaatttaattaaccatatacttaattaatacatactcctccatcatataatataagaaattttggttgaacgagacacatcctagtaatacgaatctagataaggagcctatcaagattcatagtactatgatgtgctccatctacctgaacttacttatattttgagacggatagagtaattaacaaacatagtctaagatgggcttagaccctgtttggagagcttaaaattctgagaagaatctggttagaatctaaaaagttggcaaacccagatttttgacttataattcattttctggattttacgagaagctgcaactacccggaccttcccaaacatgcccttagtccaccatgagctgtggatcaaaattcaaattctctctctctctctcttccactagaagtgggctccacccatcagaccaaatactcctttacactccttttaaatttggaaaactcttttctttcttgcaaaagttcatttaaacttgtaaaatccatatattcctagccacaactctgattgactccgtttagctatttgaattacccttgaagaaaatatctacctaacgacgctattggtttcttttttttaaaataatcactgggggaggggggggacggactttccccacctgaatttcattaaggaaatagaagaactgggactacaagagattagtggtttcttacataggaagagagaagatctttccacactgaaacaactaccatatcttctctacgaagacgctcagcccagagagtagcatcttccacacattttacaaccattcgagagagggatttagggagataaccaaaaacaacatcatgcttgtgaatccataaaccccaaaagcaaagtaagtaaaagacttgaaagtgcttatcaggacaacaattttacggtccttgagaagatatgtgtgtccaacgcatgagtgcaacggagcaaatttttctttgagcggtaaggaatcacgccagcaatcagatcaaaaggaagtgcgggcagggtttcccaaactgccagggccggggttaccggtctccggcggtaagcacggttaccgtggtaaccgtgaaaaatcgtataaaaccgtgcaaaatttatcaaaattttaaattattttttaaatttatttgaatttaaggaggttaccgcggtatttatattaaaaagaagtcatagtactccgatccctttatatatgataaccaaaacatcattactcaaaactaaactcgtgtctttcacatatattacaatgtacgtaggcttttaacctgatgtgatgagatcagaggccaaaggcagcaacatgaccagtgtttctaccttcaacgaggttatggatgacggtcacagcaagcatgatcgcagggccagagccacccaaacccatgaaaccagccaacagattcagtaaaccaacacaaattccaacgatatatgctgccatggtcatgtagtgcctgcatcgcctgggactaatcgactcgtcctcgtcatgctcctgcagcagctgctcaggcgacactcttgttcgttgcgtcttctgcaataaaattcaatatatctatatataaacgtacgatttatatataactagttaattgatcaaacaatatgaacatactcaattcgtcctattaaaaactaacctaatattagatatgacacatcctagtactatgaatttgttcagagttttagatttattttttttctttagacggaaggagtagactggtacttacctttagaagcctgacgaggtatctttttgaacgtgagcaaactctgaaccaaaataccgagagaagagcatatcccaaaaccacgaacgcaacataaagaaaagaatggaccgggtctatcacaatgtcatccaggcttcaattcatcatgcagcaaaaagaaaacaggtcataagacaggttagttatacatatatgtagctcaaataaaattataaattgagtcctgcctagcttagttactgcctccgtgtttttttatcaataaatatttaggagaggaggtagtgtatactagtagtttcaatggaaatggatgaacaagtaattaaagctagaagaaagaataaaaatgagggatacatacgttagtggcgttgttatgtaagaggcgatcccactgacaggccagtagtgcccaggatactgcctcatttccttccaaatgccaagcatgttcaccactttattcgtctcgccatacttgatgctaagcatctgcatacatatatgaacaaagtaaacaaaccaattaattaattaaacaacggttaacagcacaacacgatcaacaaattaatcgctctgtatccattatcttaaaaaagaaaatgtatgtagctacctgtgagattgaagagaagggaaaggagaggagtgcaggttgcaagatgatgggagcgtaggccaggtaggagacgctgatggtgtgtgtgattcgcagcgttggatcagccggcgacctcaccggcggcaaggtgatgtgatggtctcccagtattatcaacactaacaaaaagaaggccaaagtagcaagcatcatcatccaggggtatgcatggttcaaggccttccagaaaatacatgcactgcaaacatttaatccaataatacatattattagctatatatagtgtactagtaatcaatcattcgagctagtaattattactccctcagttttaaaacgcaagatatgttagttctttataagttaaaagtttgactaaatttataaaaaaaaatataatatacattacacgaaattaattttgttaaattcatcattaaatatatttttataatatactccctccatcctaaaatgtttgacgccattgactttttttaaaatgtttgaccgttcatcttatttaaaaaatttaagtaattattaattctttttctatcatttgatttattttaaatatacttttatgtatacatatagttttacacatttcacaaaatcttttgaataagacaaacggtcaaacatgtttaaaaaaagttaacggcatcaaacatttagagaaggagggagtatgattgatgttaaaaattaatgttattatattttttataaacttagataaatttgaggtttgattcgggataaaactaaaacactttacttaggcttaggctgatataatgaaataaataaataaataaataaatatatatatatatatatatcctaatgagaaattcttaccagcaattggcggccgagaacaaggagagaccggacaagaatccataaccctttcgaaggaggtcgtccagataaatggcaatgagaccaccggcgattagttgaaacacgaacacgagtgcagctgtagtaataaatggcgtgcctcctgcaatggcggaggcatatagaacaatggcaacaggcgacacgatggctatctgcatcgcaaacaacctccgtgtcctctccctgaatcgatcgatccaagattattattattattcagacttaattaagttagaccatgcatgcatgtggatgaatttgtggttttagtttttggtaatatatatgaattagtgatcatcgatcgaatatatacgagtaaagaagctaaagttgtcaaattaatagttttgataaaagtagctacagttttctagaatatacccttaatgtcatcttagcataaaaaagacatttagagcacccataatggttatctataagctctatacaagagatccatgtcagcatattttcttacttgaaagagattaaatgaaaagagagagagtaaagctatctactaacctggagatagtctacagagaaaaacgaggcaatgcattagagagctatagatacacatgtagacatactattgaggtgttttactattaatctagtcttttgctgagatgtacatgttttatagagagcaccttactttaccattgcgggtgctcttagaacagtacataatgcattaactcaagaggtgatatataattttttttttgcttaaaagcagaacatcaaagctcgaatagtacgcattaatcaaacgtctattatttaacaacggagttattattaataagtactccctttattttatttttatattataaattactttgactttgactttttttctagttataaacttttttaagtttgattaagttcttataaaagaatttagtaacatgcatatacaacaccaacaccaaattagtttgcttacttaaatatagcattgaatatattttgataatacatttattttaggttgaaaatattattatatatgtttctttatatatactcacttagaaaaaaaaatcaaaattacttataatataaaaaacggagactgagatattacaggcggcggcgatggtcggggagcctgtcgtcgtggacgccgatgatcttgagcgccatgcagaggtggacgaccatctccgagtagagaagagggaccaacccgagcgccatcaccgtaggccgcaatgacgccgacatggcgttcatccagtatcgcgggtcgtgctcgccgccgccgtagtagttttggaccccgtagagcagcagctcgccggcgacgaggaagacgagcagcgacaccgccgtgtagagcaccttccgccggaaagagaccgccatgacgccgccggcgttcgtgctgctgtcttctacctccggcaacagcctcgccaataatctagcagaagcaaccgctgctgctactgccattgatcgatcgatggatcagtgaatttcgtcgattctcttgtagcttttggttaatttctgacgccgattttgattttttatcgcgtttcgttcgggcggtgcaaaccgaatcattattggattccattccaggccgaatttgtgtacggctcgagttgggcctcaactgggccgcgtattctccacaaagcaacgaattagtatatgggcctccatttcaggttaatttcatgggcttttcttttctctttttattttttttccctcagttgatccagcattgtctgcagcaattcattgtgttttgtgtgcatttatcttcctattttagtatagcgtggttgttcattttcagggggatgcttgtcaacgagcaagaaagcatgcacgacaacagtcaacagagaaacagggtttatcaataaacatccccttttacttgctttgctagatttcattttcacacattggacctctgaatctgtctgtctgactcatgctgttattatgcattgaacaggatgatgattacgttgagacgaaaatgtctgagctgaaaaaaaaaagaggtgatgaagtatttcagaagagcatcagtgtagtacacactgtcactgttacattcttctatctgcttaaaaaactcatactagaatattactggaatgctagtactatgctgaaagactagtgcatcagcccattacctctttgtgtgcaactcaatgcaaaattttccgttcccttgagttagcaataagaaaaaaaaactagatctttccttccattccatggattcataaaatcagcaattgataccttttttttttactgtataagtaatgaattttatgatataaaatcatcgtgagctttgtgcactctggaactggcccatcggcaaagtgtaatgttttgcaggttgctgcttatggtcaggcaggaagctgaatgaactttagtcacgatgtgttgtttgatgtatacttcctccgtcccaaaatataagtatttttagaccctcacacggtcttcgatatactactttaaccaacggtatctacgaaagtaaaatgttttaaataaaaagactagcatattatgatagttcgtttaatgataaatatagtaacatcaaatttatgttattaatcttttttaattttttactattaacagttaaaatttaaaaagtttgacttggcactattctaataatgcttatattttaggacagagggagtacatttctgaattggggagctgatacttgagttttgtgcagcaaagcagaactgggaattcagaattcagattggaaagaaagtgacagacagagaggtacggccgtgtaaaacaccctacgccggaaagagaccatgaattgctgccttgtacgatcgacctcgccaatctactactaccaggcaccagcagcaactgccattgatcgatcgatcgatgaatttctcggcgatgatccctagcttgattagtttctttttttttttgagaaagggagggaaactcccccgttttcattaaagaaaacgcagatgattacaagagttccagacatcaagttcttacagaaaagacgggagaaaaaggaaaacaaacagttattacaggactagaacattggcatttcaagcatcaaaacacaggtttccatcgtcgtcttcaaaacttcttgccattagtttagcctgcctctctctgtttcacatcctattctttgtctgccgcccctccatccaaattttgagtgaaagatctcatttgctacctgccttagtagctgcgcccccactgcattcttcctttgtctccctccttgctctgcaaaatactccaagagtttaaatttgagcaaatgttgtaaattatttctataggatcaacaggcataattccatcaaagcaggctctgtttcttgctttccaaatggtccacaagactgctgtaacccccaccataatcaacttcccattccctttgccaaatttcaaaatccaggagctaaacatttcccccacattcctgccaggcttcacattgagagtgcattcaacaacactccaaatgaaatgagccatcggacaatctaaaaacagatgttggatggattcactcttgtcacagaattggcatttaatcgagcccttcctccaaccccttttgaacagattatgttttgtaagaatactatttcttagaaccagccaggaaaaaactttcaccctgggtggtgctttgattttacacatttttttggagggataattgatccccctgaatatcaaagctctgtagaaaggattaacagagaaacctttactagacagtcttcaaatcagtctgtctttttcattagatagactaacatt

SEQ ID NO: 58376 - DNA, 1197 bp, Oryza sativa
  unsure (1)..(1197): unsure at all n locations
tgagaagtgtgaaactaatcacgaaagccaatgttagacccgcccataacggcgggcatggctattcgaaatagtttactctgatcagaggtgtaccactgtacccacaagacacaaccccacatcatgtcaccatgtgcttcaataccacccacggtatttcggaaaggagttgtgacaatacccctcgcataacacaatccactgcagcgcaccttcntggatcataatcacccccttataancaaggcatggactccccagcgacccccgtgggcttatctccgccacttctcagtctggtgcccccaatgaaccatgctatacaaaagataaagccgttgcccatactggcttgtggttggcacgataaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtgaatcattagttatcccataaatgtgctaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaattgaattatgacgcaataatgaattatttttgaaaaggaaaagagggtttattgcgtcagcgggctagggtttggtggaccgggcgcacgggcggcggttcacacgaacggacggccgaga

SEQ ID NO: 58377 - DNA, 577 bp, Oryza sativa
tgtgtagcgccagctacatataccaaagttagatttagtttaaataaaagggagtcaggtgtacataccgtgaagtaccaagacccgtatctgtttgttttttttcttatctctgtcaaaagctcaaatcaagaatttgttggcatggcctcaggccgcacgttgcacctaccccagtatctctagtactagctttcttttccatcttaaaactagtagttggatcctgcttcattgtgacttctttgggtccagatcttttttccaacaaaaagttgtataaaaatttgaatattcgtggtactcttttcaaacggctaaatggtgcatttcatatgaaaacattctatatgaaagttactataaaatatcagataaatattttttgagtttgtaataattaaaactcaattaatcatacattaataccacctcattttgcataaaacactaaatcttcatcttcacctacatgaatttcaaacaccaccttaatactacctccatcatataaagcatgtcgtgttacagataaaaaatatcccacagaagctgtcgttttaacatcttcacagga

SEQ ID NO: 58378 - DNA, 1224 bp, Oryza sativa
cttaacggcggccggtccggtgctagccttctcctaggtctatgtattgggcgttgtcggtgcgtgggcgggggtaaattttttcgttttcccggttacgaccttccagagttgtaatcatgtatttttttttctgctctatcagtttgaacttcgctgtctttggtgctagtcgttaaaaaaattctattaggtctcgctctgatcgattcgctgagattgcacttagggcccctttttcaaaggaaattcataggaattttagaggatttcatttctataggaatttttcctatataaccctttgaatcaaaggaatggattctatggaatcctatgaaattcctatagaatgcatcttcccatacaagttttggaggaaatttaacatgaggtagaaccctatggaaagaattatttgagtctttatctctccttaaattcctgtgtttttcctgcggcccaatcaaacagttattcctatgtttttcctgtgttctgtaatcatctattttacactagcattttttgtctgaattctatgtttttcccattctcctattttcttcgttcttgtgattcaaagatcccttaacaaattattgcatgcgagtgagtccgtgcagttcccgtgatttgttgatcttttcctctcgtaacagtaggagcctgtgtaacatcaacagacaattttgccagcgaacattgaccaacgtacagtggtcgaggcggtggtaggtagaatttgtgattcaaaatgaagctgagagtggggaccagagtttctctatttctttgttcgtactgtagtacgtacggaggtaccattcgcatgatagagaccactactgtgacataataaaaatttttagattagatacgtgtattaaaaattagtgaaattaaatgagaaaaagttataattgaataagaaaaaaagataagttggaaatttaaatagtgcaataaataaaaaaaataaaatgaaccgagtagggagtaccttagaaagttagaatgaatattaggacccagtgatgaaaggtagttttctcgtaattagttttgattatctgaaagcaaaaggttctttagccatgcagatttgggaatttggacgctttatgtgcgaatgctaattggcgaacgcgcgttgccattgcgtatttccggcccacaaggcctacacacgcgcgcttcttctctcttttttctttttttttt

SEQ ID NO: 58379 - DNA, 4017 bp, Oryza sativa
aaatccacatgtcaagcatatataaaaaataaaattaaaaaccatattttctcctattaggtaaacataaaaaagacaaaaaaaaatctaaggtagagaggagaaaatatgattttttttaattttattttttctatatgactgacacgtggcacgtaggtgctatcgtggcatgccacatcagcgcatggagggggttagagctcctctggacctagatgacacctcaagacaagttcgaggacttgaaaatgcattttgagagtttagggacctagataatacgcccactcttttttttctatgagttctgctgacacgtgggccaccagtctatcataaaagaaagggtaacatagtaaatttgagataaaggtagagagtagccgagtgtctccccattccctcccgtctcgtctccgctcattgcgccatctcgcgcatgaacaggggaggggcgccgatctccatctggcgagcagagaagggggaggggatcctggtgagcaaccacatcctctttctgattcatctctctctcccaccttctttcgtgtggaatttgcttgcgctaaccatagcttctctccaagatctggaaggaagaaactttttctcttaatttcagagccttaaccttaatacaagaaacagtttgtttgttcctcaaaaagggagaaatgccgttaatctgcggggctgtgcttgcttgcgttcatcctccatttcctgcttgcaatgtggctgcaagaaaagattaaaagggcctctctcgtttaggtcggggtgctaggaagtagggaaacacctttctctcttcttttggtaggaaaaagatggcgcctttgatgggacaagccatctttgctgatccctagcacttgtttattccaaagtggggggagtgatggtcgatagatctgtagagacagtagagttgtatgattgcggttagtgggcggttggacaggttcagtgttttcgacattagcttttgtgatgatgcctttcttttgagcgagttagatggataaaatcagtgggtggcttcggttgtgacttgtgaggagtgagtctcgttgtagtggacctgtgggaggttgatggatctgcgtgtgcaggttggttcttgattattttgtttttttttttgtttgggattgttgggggatgatctcttgttcatcgaattggtggatttctgtatttttttgtgcagttcttttgtatctaggcatgttctaatcaattgaaattcttttgctgccctttgcagattctgaaggcaagtgtcaacaccaagcttataaatctttgattggtcagtagttctttctgcaatctggtctgatatatatacgtatcagttgtgggagcaatggcttcaaaggcaatgcctcgagcgccccctgcagctcccaacttacagtcactgaaactgtgttctcagaatgattcttctttggagacaaccagtccgagtaaacgaagtgcattggtgccaggaaggtcagctgaatcaagcaaaccgaatcccgaagtggtgcaaaaggagcagaaatcaactcagcatcaaaatgagtccattgatcttacgggtagcaatgatcctgcagaagtaaaggctgagggtaacctggttccaaagcgtcttgcagatgaggaaaagggtgttgtggaggatggaattgcgaacggaagcttgaaatcatcttcagctttaggaaaggagcatggtatagcaagtgcaagtggaagtgccaggttggttgggagatctgagactggagaaagaggtttcagtagcagcagatgcaggccaagcacaagcagtgatgtcagtgatgaaagcgcttgcagcagcattagtagcgtcaccaagcctcacaaggcgaatgattcacgatgggaggcaatccagatgatcaggactagggatggaatccttggcctgagtcattttaagctattgaagaagctaggttgtggtgatatcggcagtgtgtacctttcagaactgagtggaacgaagagctattttgcgatgaaggttatggacaaggcatcacttgcaagccgcaagaaattgcttcgagcccagactgagaaggaaatcttgcagtgcctggatcatccttttcttccaacgttatatacccattttgagactgataagttctcatgcctggttatggagttttgccctggtggagacctgcatactcttcgacaaaggcagcgtggcaagtattttccagaacaagctgtcaagtacgtatgatttactcaatgcacatgatacacattaataccttggtactcttgtagggttcactatctttttcatttgttgtttttctgttccgataaatttcgaaaacgtggatacacaattcagaaaaggttatggtttgctttaagttagtgtaactgcgtaattggatggattatattaagtatgtaagctgattgtgatgataattttgtgcaagttgtcaatgtgaagtcaatacatgcaaaattaatttctacacaatgatatttcattttatcaatgtagtttttttaagaattaataaaaactgcagcttacatccacattcaagagctaaaactcctcaaatagcatgaactaagcaacagcatgaaaagtggtatgcatatctttggaatatttgttttgttccatgtacttcttgaattcacttatttgcaagatagcatagtaaactgatattgcactttcttcttggtcgcagattctatgtggcagaaatactccttgctatggagtacttgcacatgcttggtatcatatatcgtgatctgaagccggaaaatgtccttgtccgtgaggatggacacatcatgctatctgactttgacctctccctgcgctgtgcagtgagcccaacactgatcagatcatctaaccctgatgcagaagcacttcggaagaacaaccaggcctattgtgttcaacctgcttgtgtggagccatcctgcatgattcagccatcgtgtgccactcccacaacatgctttggtccccgatttttctccaagtcaaagaaggatcgaaaaccaaagcctgaagttgtcaatcaggtcagcccatggcctgagctcatagcggaacctagtgatgcacgctcaatgtcatttgttggtacacatgagtacttggcccctgagattatcaaaggcgagggtcatggtagtgccgttgactggtggacctttggcatattcttgtatgagcttctgtttggaaaaacacctttcaaagggtcaggaaaccgtgcaacactgttcaacgtcattggccagccgctgcgcttccctgaatacccggttgtgagcttctcggcaagagatctaattaggggcctgctcgtcaaggagccccaacaaagattgggttgtaagcgtggtgccactgagataaaacagcatccattttttgagggtgtgaactgggcattgatacgctgcgcaagccctccagaggttcccaggcctgttgagattgagaggcctccaaagcaacctgtttcaacatcggagcctgctgctgccccttctgatgctgcccagaaaagcagtgatagctatctagaattcgatttcttttaggactcaataatttttttttccatttgtttgcatcatcttgagtagggttttcacatgtagtgtcttgcagattagtatgtagattttttttgtttctgtcaacatgtcctgtttttcttgaagtaaacttattggcattcagatttatatttctcagcaaagatctgaaatggttaatcttcaagtgagtcaaagaaaggccgccactttttggcttgtgcagtgctagctcagttttgtgtaccctatatttctcatagtaattagtactcagcagttgttctgttacagtgttacttctgtctgatggagcatttcaagtttaacagtattgtccttaccagattgtcactgcaattgctgaatagttatgtgcatgag

SEQ ID NO: 58380 - DNA, 5182 bp, Oryza sativa
cagtgctagctcagttttgtgtaccctatatttctcatagtaattagtactcagcagttgttctgttacagtgttacttctgtctgatggagcatttcaagtttaacagtattgtccttaccagattgtcactgcaattgctgaatagttatgtgcatgagctgaaacacattcagtgagaagtttcactgaataatgcttgatccagaaaaaagaatgttgatcaatattgactcattgactgcaacagcagtttttgtatctcagtataactaaatgctataccatagatactaatcaattattttgttaatgcatgattggctgacaacttgacatagccatgtgttcctatgccctatccctgtctgctatgaggttttgatttacgcatctaggacaaattctttttggagtaataaattgtcacatgcatatgctgtaatctatgatcaatgataagtgctccatgtcaggattgccaggttgccaactggaggtctgcctagcatgttttattgttcggtcttctggctatacatgaaaaattgaggatataatagagtgccagattttctgtcctttggctgcatttttcatgtggttctagacattatattataatcaagcacaactcttcaccatacaacaatgcagaaaaaatgctggaaatatcccatataacaaccatcatctcctgtacaaatgaatcaagaaattcaagatcacaacattggtgaaagtgtttttttacaagcttttgttgtctgaagatgctatgcgtgcagtgttctatatctgcaaaagtgactgaagcagcaaccataaaagtataagatcaaaatgagaagcatttcaaatattttgtgattttattcctttcattgggattaggctcctttttgtcatcatcagccacagcgcgattgttatgatctggtgcaggtgatagtggcgttgggctgatagaattactcttgttatttacaggagaaggtgaaattggtggtgttggatcagcagttggcacagttgtaacctccttgccatcacagacaatcttgacttcacagtatagaggtgcgttcttctgaacctgtcctgctattgtgtttcctctcttgaacttcctgtgctcattcagacaaattcagaatgtatttctgaaatgccagcaaattattttggtagttctgttaattggaacttgcaaggtatataaaccttaccgcaatttggattttgaaacccccagaactagctgttgtacatgaaagaccggaataagttcgaggatcgcattggtaacatgatcgctctcgatgaggtacacatcaacattaacctgaagatatgacaggaattataattggatttctatatgtgccttgcagatacatctcaagctgttgtatgagcacagaaatgtgaagatctgatgtaaccagttcacctgaaagttgcggcaatggtctaaatatttttgtagcatcacacgcctctttgatctctcttggttcatgtaagtttctacctgctctgggcttgcttggctcttgggcatcattcctactatttcagatatccaaggagacatacgtcaagttcatcagaagatatgcatcaacttaatctgtttagacttaaaaaagttcaggcgcacagtcattattcagaaaaaaaaaatacaatcagaaattttgtctattcagacggtgagagcagagcttcagaatatatgatttgtttcgtcagaaccaattgaaaattttaaaaatacaaattatcttgacaagaaagctactattccaatttttggttgtagacatcatgtgtgggagtagtataagggcctgtttggatcccctgccagaatttttcaccctatcacattgaatgtattgagacatgcatgaagtattaaatataagcgaaaaaataactaattacataaattgcatgtaaattgcgagatgtccatgatttgacaatgtggtgctatagtaaatatatttgctaatgatggaataattaggcttaataaattcatctcgcagtttatctgtaatttgttttgttattagtctacgtttaatacttcaaatgtgtgtctgtatatctgatgtgacacgccaaaacttttcacccctggatttaaacgcagcctaatatttaacaacgactcaagctagaaggaaacataaatcctagactcaaccatgactatgatgtccaaatgaaaagactttaaatatagatcctgcgcgccctatccctccagaaaaaccgaacggtttcttcagagttatgtactgatgatttgctcttaacattttttactgtatggtgagttatctatattgctcagctagcctaaaatgagagttatacaacagtatatatctctgcatataccagaaagccctgggttttcctaagctctaggcagtcgtccttctcagctcccctatctggccatgccaaagaatggcctgtctgcatcattcagcaatcaacgatgaattgctgtgcgagtgtcaaagaaaaaaaaaaaagctacgagaacggaatctcactgtactggtctgttcacatttcagtggaagtgtaacaaagtactcgccctgctcacgccggcatctcagagacctataacactcgaactactagtctactctactgtttgccatccaatatactccacgtatatggagttgagaacagagaataaaattaatgcggaatcacatgaagcaaaattcgtgatgggatgtacttttgtacctgaccgagcaaattataattggttttgtcaaatcgaaaaattaaacgtgggttttagaaatataccactgatgggccattatcccttaactgtagatgcatcgacaaaaacaaatatagttctttctcgcataagggtcgtgttctttccagcttacagattgtagatgatacggcacacttcgtaagcttcaaaaccatactttatttgtaaaaactttaattatgggcatttcttagaaaactttttgaaaaccaacaattcaatattttaatatttaattcattcatttatattctcgaataatttccatacacttaattctatacatcacccataaagaacaagcccttacattatctagagaaattttacggtccttgatgagaaagtagccataggtactaaatttcatactaaaatatctaatagctgaaggtaacgggttttatactagaaaatatattacctcccggtattttcttatggatggtaaaattacccatatagagaaggaactaggtgtaactcctctgaatcaactagaattgtaggctcgctttcactacccttgttctggaaaagggttattctgtctatccgaacatggtacacacaagtgtcccgtgcacactaactaataaatatcaccgaaaattctaaaaaaaaatgtacatgcacttccaatagtatcacacctaacttcaaattcattatacttagagagagagaaaaaaggacaaatttctgacacatttatactcttaaatatataatatttttccttttctattatggctaaaatatactctctctatttcatattataagtcgctttgattttttagtcaaacctttttatgtttgactaagtttatagaaaaatttagcaatatatataactccaaatcattttcattaaatataacattgaatatattttgataatatgcttatttttattagaatgttgttatattttaaatatatttcgtattagaaagaaaaattctaagcgacttataatattataaaacggagggagtaatgaatttgaagttgatactttatatatacgtgcaatactattggaagtacatgttcaatttttttcctagaattttttgtaacatctgttaacgtgaaacttttgtggacatgatatatatatctcttcctattcatacatgccttggttggtgatcattctagaatttttggaaagttgatcactctagaattagcatggacacctaaaccaaacaccacatgggtggtattgtttctatctccaattctccatgcagtcaacatcagctctagagcttttttgctgcaaggtttgcgatggggcaaaatatgcctaacgtaggacggcaggatgccaacaaagctagaatggaactacagcttgtgacaatgccagctttgaaaaattcagtcaaagacaaatcaccccctaagctagtccaagaacttgaccttgatttcaacaatgctgcaggccaatctccaaccaaagattgctgggacccaattgtgatcttaccaactgaaacacaagaacagtccttcgaattaaccgttttaatttactctttgatcaatagtctctaattttccatatgcaatactaaaacacccttgttctaatccagctagctcaagaagacgatcaaagcagcttcataatcacagtcaacaagtgtatgagctaggccttagacaaatataccatacatgtataggaagtttgtatttctaattaatgatccaataaattaagtagtaatcactagttccatctcagaaacacatgtgccagattttcttgaggcaaatgtataaatggaaacatgtttcaattagctgttggtcaaattaagagtatggacagagaggggtgtgtgcttacatccggtggggatgctgatgacgacggggaagacgtgcacgaggtagacgaagctccgcggcgaggccagccgccgcagcgcccacgacagcgcctccatgcttgacccgcccttccccaccgccacgtacacgtcggcggcggcggcggcggcaggaggagccagcgacgccggccctgcctcatcctccatctcctcgatctcccacgtgctgatgccattgttcccatctctccccctgccggcgccgccgctgccgccgtccttccccggccgtccaccggcttcgtcgccgtcctccacgacgccgccgccgccgccttcttcccgagactcctcggccatgtggaggagcgagcgagacgacgtacggcgacgcagcaaatgaagacgaagggaggggaggagaggaggtgttgggttatgtatgaattatgatatgacactgcatgctgtggcgaaggtgtagaggatgtgtttg

SEQ ID NO: 58381 - DNA, 5743 bp, Oryza sativa
tgcgggaggtgaccggcgagccggtcggccagaggattgagataatggcctagagaagaagaggagaagcgtggctgacagtgagcctcaacgtttttcatttctacgcttgacactgacatgtcttacaatctgattcagccagttagtagggtccaagatgccatgtgggacaaaatcacccagggagtcgatttggaacggttttcaaagttgggggacaggttatacccggttttgcggttgagggatgccattcaactagagacatttttggagggaggaaaatagacttatcaatgaagatgagtgctcttgattatctaggctctaagcccaactgatgtgacgtgtcagaagcgaactgccggagacgaaatcacgtcgaatgaacgggccaaaacggtcgttatgcagtactacattgtttccatttctacttttatagttttactatttttattttcgttttcatcagtaaccatttccatatagttcgattggtaaaaatcgaaaacaatcaaacgctatgtaaaagtaaatggcggtagtagaagatataggctgattgctagtcagaggcttgccgtacacggtggttcggtgcatggtctcgggtcgtcgtcaaagtcgtcgcaaaggttagtaaaattgggccgtgttattcaaaattttttctacaaaaattttcaaccttttcgttacataaaatatttggacacgtgcatagagcattaaatatggacgaaaaaatcaattgcacaatttacatgtaaatcacgagacaaatctttttaagcctaattacgccatgatttaacaatgtgatgctacagtaaacatttactaataatggattaattaggcttaataaattcgtctcgcagtttacaggcaaaatctgtaatttattttgttattagtctatatttaatactttaaatgtgtggccatataacttaaaaaaaattgggcacactgatctacatgtctttgcggcaagtgagcaggaaaattgagctctgtcttcaccatttgcagtacgggtacaatcaagagcaggtcaccacgagccgcggcgcataagagcaggtcggtcagcatatggcaataatgcaataaggcatcctcaatatttaaggtcactatggctataagatggaatccacatcatttgtatgttcatttgtatatagtatatgctacaatgtgtatagctttttcttaatcttaaactgggacccattcattaaaaaattatattcaacatgaatgaaagagcacatgcatggtgcaaaaggtatgaactaattttttatttcttatggtctagccttaagcttaaggttggccatagccatttttttcactttctcctctcccaatgcataaaggtggaacaaaaatactactttattctttaaggttgttttgcatgtaatattgtggatgccctaatgctctagcgcttcgtctgaaaactttaaaaaaccagcaataacttcagaacttgtatttttcttatatactagtgaacttgtaaatagaccaatcacaacaggagtctttgtaaatggattgtaagcagatcatgtgctatctccgtcctaaaatataataatctagtactccatccgttctataatataagggtccgttctataatataagggattttggagggatgtgatcctgtccaaattcgtagtaatatgataagttacgttcctctaaaatctattatattatgggatggagggagtaatgaatatgacacatccttacaacactatggaacgaagggagtaaataatatggaaaattttggttttttttggtaaaattcattacagcccctgtatgatggctaagagtgttgcatgatcagttgatcgccttcagctaaatgtctctgagataaattacagcacaaaacgaccccctcaagttaattggaggtacactctgccgtgccatactgctacgcatgtgacaacaacaacaaatgagtcaagaacgccgccgtgtcgcgtgacctcaccgatcaaccgaacgaaggagacatgcacgcagtttccagctccttcgccatgctctcgaaggcgacgcgcgagctgccaccttcctccaccgccgccgcggcggccgcggcgagcgcggcggccttggccctcacgtcgccgcacttcgccccgtccacggcgtccgcgagcgcgcgcgccagcgtcgccgcgtcgggcacggcggccgcgccctccgcgacgcgcaccgcggcgccgcgcaggtcgaccacgagccgcgcgtcgatgaactggtcggccttcatcggccaggcgaggagcggcaccccggcggcgacgccctcgagcgtcgagttccagccgcagtgcgtcaggaacgcgcccacggcggcgtgccggaggatctccacctgcggcgcccagccgcgcacgacgcggccacgcgcggccgtcctctcctccagcccctccggcagcacggcggcgtcggcgcccaccgcccagacgaaccgcgcgccgctcgcctccagcgcggcgcccagcgccgccgcctgggccggcggcggcttgtacatgctcccgaagcagacatacaccaccgaacgcgcgggacacgtatcgagccaggagaacagctgctctgcttccggcaatctctcctctccccggcagccggagtcggcgaccgggccgaccgcccacacgcggccatggccgaagaaccgtttgagccactccaagaactcgcgctccatctcgtcgaacgaattcaccacggcgccccaagctctggcgttgaggcggaagccttcaagcgcgacctcccaatccggatcgcccgcgacgtagctcctcaccaccgacggcacgtgctcgtacgggaaagccggcgacccggggagcgtgtcgaggacgaccgaaatcttggggtccagcggcagcgcgccattccagagctgctcgagcgcggcgacggcgaacgcgccgctggcgtagaacacgacccgcgggacgccgaggtcgtcggcgaggagctgcgcccaccccaggaagaagtcggagacgacgacggtggggggatcgtccgggcgagaccgcgcccaggagaggagcggcgcgcggatgccggagagatggacggcgaggagcgcgtggttggagttctccgggagggaggcgtcggggagatggaacgggagggcggcggcgaggggggtggatgcgaggaaggcggagaggagggggaggtcggaggccgtgacggcgacggtgagggcgacgccgtggcgggtggagaggcggtgggcgaagtcgaggagcggcaggaggtggccccgcgacggcaaggggaggacgaggacgtgcggccgccgccgccgccgggagggcacgccgttggtggtggtggcggccatgactgagaaaaaggcgggaagagggagacagggatgcgtgtgtgggccgtggagacaggagaagtgggaactcgtaggctgtagccggctttgagtgagtgggtgtcttgctgtcaagcggcgtctttttcttggttgacagtggactccggtcaagtcttttactactacttattcgcaggtcaattttgagcttttgatttttctgcacggaataaaagggactggaaggagtatatactccctccgtcccaaaataaataaacttatagagtttaaatttatgtcaaaaataaaccaacttatatttttttaccaaccatcaatccacaaaacgataaattttattacttcaatacccctcacctacacatcattcaatacaatattcacattaattaagggcattatggtcttttgtttctctccttaaaaactccttgggacgttaaggtttgagtttattttagggagagaggtaggctatcaaaaaatctcgaggctcgcgagctgctcgagcttcagatgagccgagcccgagcctcccccaaagctcgcgagctttatcgagccgagctcgagtttctatcaagctatgaatttttgttgttatttcataaattaggagatcaagtatgtgttaacgaccaaatttggtaatatcagcatcggaaaaggagattagatcaaggtggagtcgaaggtggagattaatccgagaacagagcaagaatcggctgaagtccagatcggctacgattaggatcggctgggtctgagtcggactaggtgagccgatgcaaccgattctgacagtataatttggtgtatgacattgggttgaattgaggtgcttcaagatgattgccgcacatggatagagtcctgagatggcaattgtatctattaattaggatgtttttatgtaacttccttagagatatgtttgggcaaaagtctgccgcaaagacttatggtatcttagagtttgttagagatagtggtcgtgtccggtatggacatatcttgtaattctcgggtataaatagaccccgagccatatgtaatttttaacacacacgttcaatacaatctcggcgcatctccaactttttgctttagttttgtttcgacgagttcttgctttcggtttgagctgcatcggtttcgatcttcaacaagaggtaaaacttgttatgacggcttgtgttctcgggattagtgcttccatctttatgacactctaatcttgtctacataattcgtcaagttatcatatatcttatataatctttggcaatatcgtcatctaacctacaatcggctaacatccgttaatagaaggcagccgattaggttaaatagcgacgttgtcttagattatataagatatctaccactttatgaaacacctagcggcttgattgtctagatattgttcttcttttcatacttaatgctacatcagttgagtttgatctattaagtcgtgcttagaatatcaatctctagcctgtactctggttgccgattagggtagtatcggagtttcagccgatcttatctgatttaactatattcgatctatatgcttcaaagacatgttaaatccgccctttatgtcaagatcttattgcatttaagtatattaagcttttgtttggtatattatatttgttttgatatctttatataaagtagtatcggagtattagctgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgcatagatttagttccttactatctatttataaccgtcgatcgattcatatatgacatcggctcaaagataaatgatatctcatcggcacctagtcgatcggctatcatttatagatttgaccacgaattctttgtctctatttcttgttgattataggatcaaatcaactggcacactcatacattcgaaggcgagctttggacctgtactgaagttaagcagatttcccaggcctcgtgttttctatcaacacgcttttggcacgcctggttgaagcatctagacccccggtgttaattttggtaattaatgacaagcgctaattgtggactaaccgttgtctttgagctatacattttaagttaggtccacatcatatgtgcgcatggatgattatcgatggattaaaa

SEQ ID NO: 58382 - DNA, 4883 bp, Oryza sativa
tgacgccatgggtgacctccttccttggggcaaggacatatgcttctttgcttccaggggcggatccaacgtgaatgtaggggggactcatgaataccccggagcaccccttcgattttttcaccataaatgataaactaaaggtccctaaatagctggatattgaagaaactgtgtaattgagcccccccccaattttttttttcctggatccgcccctgtttgcttccttcatggcagatttttttttttttttgctacacctggtgtattggatcttgggtaataccaaaagttcatcatagttgggccaattgggccgcctatatgcttttcaggaatttcagcctatttgttttttttaaaaaaagaaacaattttgaattggcaatacttcatttggagttcttagggagaaaaaaaatatgttagtgctgattttattatcatgtagtattagtaataagcatctgtgtaaggtgtttgtctatgtccatgtggcttggatttgggtaataccaaaatcagaattgggcctgttctgttgggcattggacttccagggacagcagcctttttattttctttttaacgaagaattttgaattgagaatgtttgttttgaaattagttcttcagatttgatatttcttttagctgcaattcctttcagggagagcagtctttctttttgttttaaagaagaatttgaaattgaccattattgtcctgaaaaaagttcttcagacttgatgttacttttagttgcaattccatttctgtttgttttaaacaataattcgaaattgacaatatttgccctcaaattagttcttcaagcttcatgtttgttttagttgcagtttgcaaaggtacttcttcactttccaagttttaaagttgtacttctttttcagcatagttcttcatgagtcttatctcttcagcctacctagcaaaacttagtaatttaggcatgtttttttttttggtgatagggaggaaaccatattgctaatccctttttcttcagttaatcttcttgtcagttctgaactgaagctcaaacagaagggcacaacgatttgtacaagaaaaccaaaaccatctgggactctgtgcttgggtagcattattcagttaagagatgatgtacacatcccatgagtcaagtgtttgcagatcaagcaaccagacaagcaaagcaaacgtggagaatctgtttgcatcttggggtggatcaaattctgcataattttttaatactggtccaataccagtacaggctgctgatttgttcacacgctggtcaccccctctgaagatattgttccttggatgattgtccttgctggataaagctccttgcataatggagcacagttaacaagggggaaggacaataagtttcacaagtatcaatcagttatatgatggtaatataaggcataaaggcttttccggcacgcggaaaattagtaggaatgtctcaagaatttcagaaaaaaaaatctcattcaaggagttagggaatttcagaaaattcagagtagaagacaagatcatgtgagatcaatcaactgtacaaaagaggtccccagcttgttaggacaattccaagctgggattcaatgaatagtcctagatcagggtaccaggctacaaaaagagtaaaatgcaccagcggtccttcaacttgtcagcaggtttcacttaggttcaccaacttgcaaagcgcatatcgagatccctagggttggtttcttctatcagcccggtccagagccgtgtttgaccgtgatctagcatacgtggcataccacgtggacgatcaaatagattttattttattttttctcccttcttccttctcttttctcttttatgaaaagacgatgacgtgtatgaggcattttcatcttttcgacaaggaagaaagagaaaaaaaagaagaaagaagagagaaaaaataatttaaaaaatctatgtcatcgtccacgtggcatgccatgtaggcaagaccatggtcaaacgcggctttggattgagataatacaataaaccaagtttagggaccttaatgtgcgcttcgtaagttcgtggacctaagtgaaatctcctgacaaatttaaggaccgctggtgcattttactcctacaaaaaagtcagtctagtgatcacaaatccacttatactactacccaccatgcattgtgttcatcatttctgacagacaggcactggctcactagaattctcactcctgttaataaatcagaaacttaagttgcaaatggtggttccttcttgagatgatcatcttgatcttccagaagaacttgactggagaagagaagagacaaggtgttgatgatcctactgtaactcatggatcaggagaagatatatagtcacctgtgatagcttatctgaattacttactgcgtggttccaatctaacagtagcatctcctgatgttgagacctcgattagatggatggatgttgaggctaatagttgttcatccgtgtggtgccaatctgacagtagcatctcctggatgctcttgttcatggaatggcgtgtcgtccatgcattggtcaggcaatttgacaatttgttcatcgtctagcagagaggatatatggtcaggaaagagttgatgagataaaattgcagttcgagtacggttatactgccgtcttacctgatccaataattggatggagaatgttgtgccggtaagtaaacagtaacaagttgtgaattttcattatctgctagctagagtgtcagctctgaagaatatatcagcatatgtagaaacatgatgaacattagtttcagctgatttgttttcttgttactgtcatacatctctggtaataatagaaatgggataggttttccactctgtctgaaaaaaataattcagctgatattccaatctcactcacctcacctgctgaattcccatagccaaataaattgattccataccacctattataggggatagaaaggggagaggttttcctctctgtctggccaaaaaatatttcagctgatattccaatctaactcacctgctgaattcctatagccaaagaaattgatttattagacatactccctccgtttcgaaatgtttgacaccattgactttttatcacatgtttgaccgtttgtcttattcaaaaaatttaagtaattattaattcttttcctatcatttgattcattgttaaatatattttatgtaggcatataattttacatatctcataaaagtttttgaataagacgaacggtcaaacatgtgctaaaaagtcaacggtgtcaaacatttcgaaacggagggagtaccaattattgtatcttcagattagtgagctgcatcagaaagtagtatgcatgatggaatcagagaaacaggagtagcagctgcagcatctctcttccaaacctttaaatactaatccaacaatgttacttttgcttaccagataagttaacaccacaatgaattatcaaatcccaaatggtactgaatcaacacaatataatatggcatataagttgacacaaatgcaaacgaccaccacaaagtgataatttagtccaaagagaacataaaaaaggaagatgagaggaattcagaagaagagttttgagtcagtcagtatcaaggtcatgtgattgatgattcagcatcccttgaggctcagtggcctaatgagctgccacttgtcctaatgactccacattttcctgtcaatttccacactaactctgaaacaaagctcaaaacacagagcaaaaatcaaagaccaaaacttccatctttctctctagaccaaccaagaacactgcatttccagtaccaaaataaaacaagaaaaacaaagaaaactacttcctccgtttcagattataagatgttctgactttggtcaaagtcaaactgcttcaagtttaatcaagtctatagaaaaaaatagtaatattttcaatccaagctaattttattataaaaatatatttaattattaatttaataaaaaaactaatttgataatgtaaatattactatatttgtctataaactaagtcaaacttaaagcagcttgactttgatcaaagccaaaacatcttataacctgaaacgaagaaagtacaagacaactacaagttcccagctttctcttcccatttcgattgcggccatctatgccatcaaaatcgtcgtagcttcactactctctcccaatcatcactaagctccaacctcctctctgtcatctcccatggcggccttcttgcgaacgctgcaccggcgaagaacgcgcaatgccgccgccgccgcgttcttggctctcgccgtcgtcgtcgtcgtcttcttcttgtccgtgttcgtcgccacgcggaatgaggctgacatcttcttcagtggcgtcgcggcggcgagctcgtcgtcgccggattcctcgtccggtgggtgcagggagctgcaggcgctcgacggcgatggcgcgaggtgccggtatctgcgggcgcacgcgccgtgcgcgccggtggggtacgtggactacctccggctgctgtactgcgggttcgggcgggcgccatggctgggctacgcggcgctcgcgctgtggctgctcgtgctcttctacctcctcggcgacacggcgtcggcctacttctgcgcctcgctggaggggctctccgccgtgctccgcctgccgccggcgatcgccggcgtcacgctgctgtcgctcgggaacggcgcgcccgacgtgctctctagcgtcgtggcgttcgccgcgggggcacgcggcggcaactgcggcggcggcggaggggaggatgccggggatgt

SEQ ID NO: 58383 - DNA, 1514 bp, Oryza sativa
gaccaggggcggtcagaccgaccacatagtggcggtctgaccggcgtaccctggccggtctgaccggccgcaagaaggcggtctgaccggagcataaggccggtctgaccggcggcatttgcgcggtcagaccggccccctggaggccgggatggtgctgctcgggatggccgatacagagccgacggagccgtattcggtcagaccgagccgaggccggtctgaccggccaccccatgccggtctaaccggcgaggccggtggggccctctgatagggctacaacggctagttttctagccgttgcagagtagcacggtctgaccggccacatacctccggttagaccggcagagcacagagttgggggatttcgcccccaacggctagttttggtggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcgtctccacaccgggtcattgcttgttactcttggaggttgccgcctcctagacggcctgtggaggagttgcccagtgacctccccgagaagattgtggaggaggcccggcgccggtttgtgagtggtttggagttcaccaccttcggagtgaaggaagaactaccacgagtgatcgaggcttgggtagtcctctccgtgggtcggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttacatttctagagacacacttgagatcatatcaccctaggattgcaaaacattgacataggagcgtgatttactttcctagagatataattgagccactatcaccctaggtttgcaaaacataacttagttgcttagttagagttcacccttaccaagcctagcaacttaggttagatttgattaggtgttatttagttttaaatcgcctattcaccccccctctagtcgacatctcgatcctacactggtgggactgattagaagtcaacaagcaattcttcctcatggccgagaagccaccgttgtcgccatcctcggctagcccaagcactgttaaataaaagattcaaaagttggggttgactgacgtcaatgaaggaaacgtcgtgcccatcgatccggagaaattcacacctgagcagaagaaggattttgaagcaatgttgcagcaagcccgggatcagttcttgaactcattcatgcagacccgcaagggaacattggttcagaagtatatattattttacttaaaaattaagctcggtagt

SEQ ID NO: 58384 - DNA, 1539 bp, Oryza sativa
ccgggacagtcaggcaagactagagcccaagcaacagggcaccaaccctctgccatgacatcttgactaccgggcagcagctcgtgtagccttcatttgccctgtagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccataaatagagtgtccactagatggggttttgtttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacgaccgcgaaccacgcttcgggaacctccggaacgacgaaagctacgcgaagcacacaagcaaagctacaagcctataaagaagcaataacaacacataaaaagaaagcacacagttctttaggttgtaacaaacattaggagacttgaacgggtcgattcggagctcgtatgaccaggatatgatcatccgaagtttaatgctgttatatggagatttgcggattattataattaagctttgcaattataaaacaggtgtaagcgctagcctggaaaagacaggaaggctgcgccgttgacatgcggaccccacatgtcaacctaaaggaccgcggtagaccgagtacacagagtcggtccacgggtcgacggaagcggatcccgtgtgtcaaccgaggcgagtggccgacaaacggactccactagacaccacacggactgcacacgtggaaaccatgcggctaccgagcggacacactaacacggtcaccacgcgcacaagcgaacgactgccgacgccgatacacgggtaccggggccgacaaccgcacaacgggcacgggcgacaccgaaaggacgaggacagggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgaggacgggggctgcagcgaccttgacgaag

SEQ ID NO: 58385 - DNA, 2221 bp, Oryza sativa
tgtcggtgctctggtcgtacgtgctcgcgcgggagctcgtcgcgctgctggtctccatcggcgtgccggccggcgtgaaggccggcgtgctgggcgcgacggtgctggcgtgggggaactcgctgggcgacctggtggcggacgtggcgctggcgacgcggcgcggcgacggcggcgccggggcgcagacgacggtggcggggtgctacgcggcgccggcgttcaacacggtggtggggctggggctgtcgctgacggtggcggccggggcgcggcacccgaaggcgtacgcggtggagggcgggccggcggtgtacgtgacggtggggttcctgacgacggcgctggtgtgggcggtggcggtgctgccggcgagggggatgaggctggacgcggtgctcggggtgggcctcctcgtcatctacttcgtcttcctctgcgtcagcctcgccattctcacgccattgccttcaccacattaacttcatttttcttctttgcaaattgaattgcaaagatgatgatggtgatgatgctagattggttgggttggttggtgtcaagtgttaatttgggtgattagttattaattaattgcatggtattttgttcatgcagaattgggaagatgaaatgctttgtagtagtatatgacttgtcatgaaatgtaaatagaagagcacatatagatgcaatgaaataatgcatagtagtactagctttttcaccggaatggttgaatagtgagatgatttgtaataattattcgagcatatagatgaacaatttaaataccataaagttataaaaatgaatatgagatagtttgctatatatatatatatatatagttttttttttggaaaactacgttatttaaaagttcagaaaacgtgcgcattctattagtctgaaatatatacaaatttccgaaatgttttcttttctctgtgagtacgtactactgaactagtacagcatacagaatgtgtactctacagtgactgaagcgtgtagctcgatcaaacaatttgattagcggaatttcgtagtcattaaatttgtttttagtggctgggccacaataataatttgattttagttggacttgcagagtggagtccttgctgggcttcgttttctagttgcattacacgaacgtgtatgatacgatacgattgcctatttgccatgtgcttctcactctgatacgattcccatatctgacatctagtagtcatcaactatatctaatctcgtggttgtgacgattatattactggtaattagtgacttaagagctttgtaaattacttgacaacgaggcaccagtggtctagtggtagaatagtaccctgccacggtacggacccggtttcgattcccggctggtgcattttgttcttcttttatttttcacagtttttcaaattttggcctgattaaaaaagaaaatttttgggtgttacactatatgtcggaaagagtttttgacacgaatgaaaaaactaatttcataactcgctagaaaatcgcgagacgaatcttttgagcctaactaatttgtcattagcacatgcgggttactgtagcatttataactaatcatagactaattaggctcaaatgattcgtctcgcgatttcctctaactgtgtaattagttttttaatctatatttaatgcttcatccatatgtccaaaaattcaatgtgatatttttagtaaaaaaaagttttgggaactaaaccaggcctttaacaccgagttttttttaaaaaaaatctttttcccttagaaaggagagagttttatacccatcaaattttaattcagagtttttttaattccttctcccttaaaatgaagaggatttttgtaccgtttccgagtcggagcagcagtcttgccctgactatttacgtgcacgtgatcgaactcaaacagtggatggatcgatcacccgggatgtcacggcggcggaggaacgacggcggcgaggccgatggccgcgccagcaagacggcgcggcggcggccggcgcatacgaagatgaagcacctctacctggtgctcgacgacggcgacgaggctactactacttacaccatccacaagctcgacgtcgacgacgacgcgggcattatccacgcgcccgacgtcgaccggccggcgactcggttcgcggcggcgccagcggccggtggtggccaaatgcact

SEQ ID NO: 58386 - DNA, 10368 bp, Oryza sativa
caggtcgcgtcccgcgacggcgcggggcccccggagtacagaaagacgctcgactacgacagcgtgtcgtcgtcgagaacaaagaacggcgcaacgcgccacgctcacctacatgggcgacggcatgttctgcgccgtgaagacctgtgagacgccgccgacatcgtcgtcgtcgtcggaagaaggtgacgccgacggcggcgtgaaggtccatgtcacggtgttcgggctcaagtacaatcgccggggagagctgcaggcgagggttcgccgcgccgccggcgcgttcccactgcccaagcaacatgtcccatcgttttctcctgtagccttctggatgtagcagctgcttgcagaaattttatttttatttttttatacttttttatgtattaattttattgatataccttttgaaaacatatttccgaaaattttatgaagtagtttgcttctcttgcattacattgtggaatatgatcagatcaatagtttcatgcaaattaaagtcttacatgatgatatttcggccactacacaccagatattgcccccaaaaaaaatgattgcacaaagttaacatatggctggacagtagatttcaccttttctttttatagatgtcccccagcttctattaaacttcaacagatgtacacacacaaaaagcaaagtctactgggtatatatacttgtttacagtacacaacagactcaatattgctatagtaaaaaaacactcatatccacaccaaaacaccacccaacatctgaatccctggaatcattcacaagcagcaatcaacatggttagcagcttctgagtattacagattgcattgatgtttaaagaaagaccttaagcctcttccggattgtgatataaaaaaaaggccaacacacaaaaggctagcgcgtctggtatattagaagtagcacatgcaaaatcggttcatgaacatgcaaaaggcttccaggttgtgataagctccactttcaatatacttgtacataagagaacaacaataaagttgaactggtaagaatggctgtggcacatgcgcacaaattcacagacaaatgagtagagagtttggtcatagtaagggggtgttcgggagagaggggctattagcccctctctaaaaaaaacataagtccttctcatagggatttatgtttttgtgagaggtactaaagtttagccccagtttagtccctccaaccaaacaccacctaaggaatcatgaataccatcacgatccttctgtacagactggccttaagtgactgaaaaaggtgtttcagtgtctgccctgaataagctgaattgtgcagggcttcaattcgcgtatatgaacagagtgttgtcagggaaatgatcagttgagttctttcaatgtcacttgtaaatgtctgctgtcttcgtggtcaaccttttggattccagaatctgtgtggcttttagtgaattgacctgaacattagcacaagaaatcagatgtatcaaacaaatgcgtacatgcgaaggtctgatttttgctagagtctacagattcactacacaccaaaagcagccaatggtataatactataatgcaactaagaaagaatatgaagattagaagacaagcagtactcactttagcgtatatccttgcttaaacatcaccttctggaaatcgcccatgagtcttggaaaattctgtgcaactataagtacaaatacatcctcttttgctcttgcactgtgctgcctgatgtttctgagaagtttaagaaggccacaaatgtcatcagaataataagctttccttcctgtggcaggatcaatgaaatcaagtgtttccttcaaatgcgtatttccatctggagcttcaacacccttcttccatttggtgtatttactgagtttggtcttaattttctcgtacgttggattatctgttgtctccattttctcaaacatgttatggagagacatgaagtgggcagctgatctatatccatccttcaaagtgatatagtcctctgctaaactgtcataacctctggcacaacgatcaatcagctcaatccactgtataatgtccaaaggcaaagtggtgaccgaaacaaatacctcctcgcgagtcatcttcacaaatctatctgtatccttttcaatgtcaccatcctcaagcttgttaatcactccctttgacagattaccaaatctcatgttaccacaggtatccattagaaaattttccgatgtaaaatggccaccaaatgtcagtccagcccagtgaaaattcttgagtagtacatatgcgttcctgatcttgcatttcacttcatttgacgttgtgtaagaaatatgtctacacatattcttctcttcttcttcagttgatgtgcttgctccttccttcggttctagtggatttgtccatggaatctgttccggtggcgacttgacttgaggtgttatggtttgaagaattaacctgtccttattgaacttgcagtagttcctcaggctggtatacattgtttcatccattttgcagacgaaaagattatggtttagatggtatgccttttcttcaaatgccctgtcatactcaagtttccttcttacagatcttctttggtaaccataacatggtcttaattttttgcttgttgatacgatagtgtcccttgcaccttgacttgttgctggagtcttgattagagcttgaatagcctgtaaattatttgccatcacaatgattaactaagatcaattgccaaaataacaatcagcagatgtgtttccatgtcaaatttttttttcacaagataaccaatcaacagatgcagctatttgcctatcaagacattcaaattcagcatatgagcagataatacattctaggacaaatctttaaatgtagcaatgcaaaattagtgctcgctaccttcttgagagagagagagagagagagagagagatgctagctacttacaggtgcatcattttctgggatctttattccttttatatagcagtcgtcaatccattggatgttaaccaccttcttgccttcaccgttccatatcagaacagctccctccgaatagtctccctagcaatttgaattaaatgtcaagaacgaaacatgtgttacactaataaaaatcggtagtaatttttttaccgccatagcaacatgagtgcagatgtcatagtctattgattgcagtacgaagcctcctagtacttcaattttccttttgctctgcatcatttagttcagaatgttaataaaacctggaggaagtaaattgttatcaatggactcccatgctgacaagccagccatattagtggtagaaaccaaaatgacatgctgcacaattttacagggtttcaaaattgaacgcagataaatcttacagagccaatcaacaaaattagatacgattcgactaacaaaattcgataaaggaaccttagatacattagtgaagtatagattactcctctaattcgttatcaggaaaatatatggagataaatcctctaattctttatcagcttgtacccttcaggcccaaagaaagggaaggacaagtcacaaaactcaccagattctcaaatagacaagcagtttggaattttggtgcatactaggaatatggcttgcttagaaggagtaaatactaaggggctgtgtagcagaaaactaagatggactggaaatgagtgattgtgtgatatgttccctactgttgataatcatgagcgtaatgtttcaatcttcagagcactgctttcaggtagaaagaacgcaatcttttcgcggaaagtatataaaatggaacttgttttttaccttgacattagatgagatggcataaatatcaaaatatgcacacgctgaaaatgcagtacgaaaaggagaagttcctgagaagatctggttgacagacacaatacttctgtaaaattgctgatatgttcaatttagtttaaatttcatcattccataaaagtcacatgtgtagattccttaacctgctgataatttgacttcatcctgatagcctaggcaccgataattaatctttaaaaaacaagtgtaaggaacgggatgtgtgctgtgtgcatgttgtggcctgaactaaggcagtaaaaatcaattaagctcgatgtccagttccgcatttcccttaaaccctaactctgcaattcgatgaaattggggaacacacgccgacatgtgaattatgagcaactagaactggggacattatctcacctgttcttttagaaggtgtgggaatccgtgaagtatgaaacgcatcccggcgaaagggcgattgattctgcccccgcgatctgctcccgccgctgatccctcgccgctgatatggcctcgcgcctcgagatcgatccccgactcctcatcgccgcttcggcgtccaaatccgccgccgcttcgggctcctcccccggccgtggatgtatcccccggcaccgccttgttcttgagccccgccgcgtatctccccaccacagccgccgccgccgcaaacgatttctccccatccgcagcggaccgcttccctgtctctgccttgaccttcagccccaccaccggcttgcgctcctccacctcccccgcgtatttcctcctcgaccccacctcttctccatccaccaccgccgcgtcgcacccctcctgcttcacggtggctttgctccgcgccaccgccgcgtcgcatccctcctgcttcacggtggttttgctccgcgccaccgccgcgtcgcacccctcctgcttcacggtggttttgctccgcgccaccgccgcgtcgcacccctcctgcttcacggtggttttgctccgcgccaccgccgcgtcgcacccctcctgcttcacggtggttttgctccgcgccaccgccttagcttcccccccccccccccctctccgaccgcaacggctccctcctccgtcgccgttttggcccgcgccttcggcttcgccaccgccaccgccgccgccgccgccgtagcggggtcccatcagcggcggcatgacctagccgcggcgcttggcgaattgggggcgaactgcgagaagcgagcgggaggaggcgagaggcgaaaggggaggggagacgagcgggagggagcggaaatttcgagttcgttgggctattggctacttgctgagctgtcctttcgttttgtctacccggtccggatggggccttgtgggtttttcactttttctttttctttccttttctctctctctgtttttttttgtgacgatgggagtaataaaacagtaaattccttctattttcttgcggtgaaaaattccttcagatatcagtatcacggccaaaggtgccacaaacctactgaatttaggcggttccaaaaacaaaaatttctatgctataacatcgaatgtttgatacatgcatagagtatttaatgtaggcaaaaagaaaaaatcattacacatattgcatataaattgcgggacggatattttaagcctaattgtatcatgatttgacaatatggtgctacagtaaatatttgctaatgacggattaattaggcttaataaattgttttgcagtttcctgacggaatctataatttattttgttattaggctacatttaatattttaaatatgtgtccgtatatccgatctaacaaccaaacccaaaaattttccccaactaaacaagcccttaggtggtgtttggatccagcgacttaattttagtctctgtatttagacactaatttagagtattaaatatagactacttacaaaactaattacataaatgaaagctaatttgcgagacaagtttttaagcctaattaatccataattagagaatgtttactgtagtatcacataggctaatcatggattaattaggctcaatagattcgtctcgtgaattagtctaagataatggatgggttttattaatagtctacgtttaatatttataattagtgtccaaacatccgatgtgatagggacttaaacacgttgaacggtactcccttcctcctaaaatagaaggaattttgggtgatgtgacatactatcctataccttataaatctgaacgcaaatcctttatattttgaggcggagaaagtattactaattagtactaatatttcgttgcggcaacatactgacatgtacatacgcagcccgccttgtcaggtttgccaccatcagccactaccttctcaccacaagctccgtataccccaccgacaacatcgacacaccgctgcgtgctcgtcggtcagctgaaggaagatgatgcccctatgtggagatagaggtggtgtgtggcttccgttttccagcgatggtggtgcggcgaggggccaggaatgataatgataaggtgaattaggcttgggtagcagcggctattcacattaattagacgactgtacggctcgggcatccaatcaatttggagaaaaatagaacgctgatgtcagcgcccaatttacgtgcaaaactattttaaactgatttttctcttaattacttatctaaatcattatccgattgtaccattaaattcgttgcaattaaatctttaaaacaagaccacacatggatatattccgacgaaattttttttagcttattattaaattattttaaatattgcacgatgttcaaccaagtatatcggaattgattcacttagtagatcgaaaatgtttcgcttgtttaaatcaggtgttgtttcaccgtatataaaaataatgtttcagcaaatagctaaagaatgttttagttcacagcaacatttgatccatacgtagtgaaacattataagtacactaggtgaaacatttttcggtggaataaaaaataaaacgaattcccttaataggggttcccaaaatatataggtttttttgttataatgaaatatttcagtttactgcaacattagatctatacatagtgaaacattgtgaatacacttggtgaaacattttgggtaaaaaaaataaaccaaatttccttaatatagagttttcaaaatatctagttgatttgttgtaggtggagacaggtactgtagtgggcctagcggcatgcaccgcgcacagggggcggggtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcggcacggcacggcccgggcggcccgtcaggccgaaagcgccggcggcgcgtgacagggcgggcggcggtccaacgggaaggcgacacgtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccagctcgaagagatcgagaacctccggtgtgtggcaaagcttcgacgagataaaggaaacatgccccgacggaagggagatatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagagctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtacaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatcaatatttttaaattttccaacccaacaaaaaaataccattttttataaaaattaggcattaccagatcattactttttt

SEQ ID NO: 58387 - DNA, 6634 bp, Oryza sativa
ggcacacgcggcggctcccggtcgtcgctggccgacttgcgcagcagcgccggagcaggaggaggtggcggccgcgacgccaactacgacacgctcgtgccgccgtccttcgtgcgcaccgacggctgcggccgtggcgaccgctccccaccggtccacacgttcggcttcagcaaggaccacgacgcggtggcgatgcacaccatcgccgaggtcaccggcgggacgttctccttcatcgagaacgaggcgttcatccaggacgggttcgcgcagtgcatcggtggcctcctctccgtcgccgtgcaggagctccacttcgacgccgagacatggagaggaccggacagaccacgagcgtggccggcgacgaggaggcggagtccggcgtcgccgagcgctccgtggaggtggaccaggagatggtccgggtggaagccatcgacgacatcgcgctggagcagggattagttatcgttttttctgtttcggtagtagaagatgatgtgaccatggctactatggatacaaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatctagcctcatctcggaattctatctcgtttggccgcaatcacagaagcaaggtgctgcgtcacctgtattgggccaatgggcttgtaactttgtttgggaccctggcccatgtggggcccatgtggggtgcaccccaatctggtgaagcacgacccttggaccctcttggtcgtcctcccacctctataaatagttaggtaccccttcttgggtttcttgggttttgatagattaaagtttagccattgctacttgcttgcagcgcgcgtgtcggctagaccgtccgtctgcttgttcttcggaaccccaacttatcattcgtatttaactcctatttgcaattcagattgcttttatcttgttcttgcttgtttcttcgatttgcttacaggaataaggttgatttgtaccggcaagatcaacaacccacggagaggtgtatcgatcgctaaggcgcaacgcaacgtcttgtacggttgtagtcgggtcatcaacgtttcttccaaatcgtagttatcatcaactcaccgaaagatcgggccaagaacagccttgagtgtcgagacgaactcagggtttatcacgtggtatcagagctttcgttgctcggtgagtttttatcttcctataaccagaaaatagccatacaaaaaaaaatccgtatcatttacctagccatattgtgccattgtattgttcttttcagtttttgctttgttaaattttgtgttgcatcgtctcgtcgtgttgctagtcttagcgtctagttcgtttagagtttcgagttctggtcacgttttataccagagtcgtcgtcgcctccgtgtctctgttatcgtcggaacctacgaaaacggaatcggctcgctgccacggttctatttttgtagttttcataagtttctgtcggttagtttttgaagttgtggagctgtatctgggttccagttgagtggttgcgcactgtcccgtgttttttttctgttgcgcgcgaggaggaagaaacgcgcaaggaaggagaaagacgtgaggaaggagaaagaaaggataacaaatcggtttttggaggaagttttgcagattagatcagtcggttggtttgtcggttggtttgtttccttctcggttggtttgcttccatctatagccgagtctgtttcctcctagtccccacccccacgtgattcccgtattactatcccacttcggtggagtccgactccctgtctctcttctctcggtttagatccataccgtgtcttcccacatagctaggtgagaatttttgaagtgtcggattggagatccgtttgcaaaaacggaaccttcgggacgagtacattccagttttgtataattttaattttgagtttggacttttacatttgagtccttgtaaattttatatttacgtttgagtccctgtaaccttacattaaggtccttgagtcagtttttgttaaaaaaatcaagaaaaaaagtgagaaaaaaaaggcagaaaggtgcataaaaaaagaaaagaaaagaaaagccgcacaaaaaaaaacaacagaaaagaaaaggaaagaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagctaggaccaacacggtacttgactttgaaccattattcaactttgcattctctgatttgagcatttgctatccctttgctacatatttaagcctacccagagctccacagatctgattgcagccgtacagcaagtgtttgccaacgcatcgatacatccaacctccattggggtgcttggttaagtcggtgtacatcaccattccgcttgctttggtaagaacttgtaagagcttggttaaaagcttgagtgtgtgtgatatttgagctgccactacctagtagttgataggagcgtgcatatttttgtgtgtttcttgtttgcgactaaccatggcaggattgcgtaagggaatacgagaacatcgacttctacaccttcgacgagatatgacgacttctccacgtgatgcatatgaggtacacgactataattttgaacaagttgcatctaaattaccattctatgatgggaagtatgattctgttgcatacattgattgggagctagcagtagacaatgaatttgatatatatgatttttctgatgctcaaatgattaaggctgctagtaataagtttacctcttctgcattattttggtggacttatgttagtaataaacctgaaacttaggatgaattgaaaaccatgatgagaaaacgctttgtgacatcttattacaaatgtactcttcgggagaaattagaacatctgaaacaaggtgatagaactgttagggagtacattcatgaatttaaggtctgtatcatctacagtggtctcaaagagtgcaatgaaaatacaacgcgtagatttttcaatgggcttgattctgaaattcaggttttgcttgataatgtgacatataatcatattgggcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctgaagaaagttcgcaaggtaaattaaatggtgctgagagaaatgaaggtgagtattctcaaggtgagctacacttgtccacttttcatgctatagtagagcaaccattagtggaatcaatttctgagttgcctttgtcacaagttgatttacttgctgttccttgtgataaagaagagttgtgtgataatgtttcacttatatccatgctacaactagtgaatgaacatgttagttctactatttctttgtgtgctgattctaagcatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttccggataaaatatgcaagctagagagacatgttactgctaatcatattgtctcgagtttgtcttgttttgattgcaagaaacaggttgttttcagtggactacgcgaagagcaccatatggaaaaaccgaggacagttttccgtgaagaaggggaggatgatgtgaccatggctactatggatacgaccattgctcacatcattaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgctgtgtcacctgtattgggccaatgggcttgtaactttgtttgggaccttggcccatgtggggtgcgccccaatctggtggagcacgacccttggaccctcttggtcgtcctcccacctctataaatagttaggtaccccttcttgggtttcttgggttttgatagattaaagtttagccattgctacttgcttgcagcgcgcgcgtcggctagaccgtctgtctgcttgttcttcggaaccccaacttatcattcgtatttaactcctatttgcaattcagattgcttttatcttgttcttgcttgtttcttcgatttgcttgtaggaatatggttgatttgcaccggcaagatcaacaacccacggagaggtgtatcgatcgctaaagcacaacgcaacgtcttgtacggttgtagtcgggtcatcaacgtttcttccaaatcgtagttatcatcaactcaccaaaagatcggggcaagaacagccttgagtgtcgagaggaactcagggttcatcagaagagatcaagcagggatcggatcgtgggatggcacggttagtcattgatccggcaagatcgcgcatgtaacaacctcctgtgtggagaagaataaaaggaagaagagaactcagaaaagctgcacaatattgcagcaccaaaacattgttcttctctggttttctgcattgtcgtttttcgtcagacactattcatcattctgaaaccgtcagacaagctaggatagccactgaaatcgcgtgtgtttgctgatagctccgtcgtggtctccttcatgcagcggccggcgggaagctaccaccatgtcgcctgccacgacggcttcaaggtgctccacctgccgtagaaggcggcaacgagcgacgacacccacaacgacctctagctccgccgccatgggcaggagttcgacgatgatctcgggttcacgctatgcaatgattactactcgccgccgccgaagttggtggacttcgtcgccgaccatccgtttgcctccttctagctactccacgccacgaccccttcccgtgcggccgctcctcggcgctgctgcgaccggccgcctcgccgcgtgacgccttgcgaagacgatggattgcgacctctcctcgacgatgaagccctgcaagggcgaggagctcgcctcgccgccgaggtgttgtcctgctcgtcggcctccacgcgcgttcgtcgacctccctccgtcgcctggagagaaaggagaggagagagagatgaagagaggggagatggggagagataaggaagaagaggaggggtgaggatgaaatgtggggcccacgtgggccccatcatttttattaatttgtgtgtgaaactgacatgtgggtcccatgggtttattattatttttggatcgaattgccatgtaggcgccacgtcaatgccacgtcagatgaagaccgagtcaaattggccatgtaggcgccacgtcagccaaaaccaccctcaaaaccgccgaggaacctaatctgcactggttttgatagttaagggacccattgtatctggtttttcggttgagggacgaaaatcggattcgttgacaaattaagggacgtcagataaacttattcccacagatattagcctctctagaaatgggccgataaattgaactaaattttctggttcatttgttggtatgggccagtatttgcattcccaaccgaggcctaagatcacacgaaaattcttagcttgaaggaaatgttccgtttaaaaaaaggaataatgcttgctttgggtttcggctccatcggttggccaaatgctcattataagccgtgcagcttatcacagtaaaaaaaataatttataggtaaattttttatatatgttttttagcaatttaaaaatcaattctgaatgataaactacaatgaagaacctcaaaataaacttcaaatttaattcttttttaaaattcaaattttaactacggtttaaacaatagtgcaaaagatgagagacgaaagagaactgtcgagttgggcctgtacaaagattttggcccaactcactccaactcttttcttggagtgaaacatagggtctgtttggtacagctctagctcctaaatattgttccaggagttgagtctagagtggagtt

SEQ ID NO: 58388 - DNA, 11661 bp, Oryza sativa
accggctagcggagccgctttagatagaacgatggataactacccgtctcgtgggcaaacgaaaggtttacaggacaaacctagaaaggattccgcacgatttacgacgcgaatcgataaagatggacggactagaataaaatagattgaaacattgaaaaagcgattcaattggcttatgtgtagattgtagattgtgtatgcaattgaaccggccttgtcccttatataggggttggtcttgcgtcctacaggtcctcctccacgtccaactcgagggtagaaaccaatggaaacctgaaacataccttcccgagcaaggaaacccaatacccgatgaaaacagacttgagctcggactctgccggtcttaccggccacatgccgccggtcagaccagccctcaagccacagtctgaccggcccatacacggcggtgactttccaaatcttggcaatttttacttaattcgagcctacgtgccaaatttgggtgcaaacaaaaagtttcaaatctaactatagtataattataatataatttcactataaatatactataactataatataacttgtatataaatattaaaataatatatgcaactttatatctaattaacttatatatatatatttcagtgtagttacactatagttacaatatagctacaatgtaactatagtgtaattacattgtagttacactacaactatactatagttacatttgaaagttttttttcccaaaaagcttgcgtacagttttttacaattccgtgaagcggaatcctatatttataacatacatctagatcatattagaaccctaacctcatgtagcgctgcgctttgagcacataacacacccgcatgtatatatacactatctcccggtcaaattcgttgaaaatactagcactagatattgatatagtattcgacataaattcgccacaactattctgaatatatgttcatcaaaactattaaaattttaattatttggatgtatttttgtatgatggatagactttatgtcaccacaacaaacaatttttagtacatatataatatatttatattcaaagaggttaaacgtggttacgtgccttctaaaaatctaaagtgacttacattggagatgggctatttagcgagtgcacacctctttacttgagagcaaacattgataacacaagtgttttggtgtgtataagagttatttgtgaataactctgtataagaattatatatttaaaaaaaaataactttacaaaatttgaatgcatgtttttaaataaggtatgtccaaattaatcattctgccaccatacacactctcttgcagtggtttgatttactagtctcaacttcgatgctagatatttttcacccccaaattctcttcaaaccagataaactataccctcaatcgatttggaggcgttttattcctatgcggtacccatgtggtattgcattaactatgcggcaatcctattagtagcattgtcctacctcctcctatccctccccctccatctctatctaaccctaatatacagtttcactgggagagcaggcaacagcgctcgtataggaagaaggtacacaccttcctctcttcatgctaatcaagaaggtccaaagaagacgacctgacaatgagcttgtagggtccaaccatggtgctagcttgtggcgaggagatcaagttcgatggccatcattgtcgtctctgtggctccatccttcgcattgtaccgtcccatggaggacaacacctgatgacctcgctaagggcacggcggaataggcttgtggagactagcaacaagcgagcttgtcaagggtggtggtggagagagctcaacggtagtagggtgtgctcatggagacccatcccttctcttccaggggtagcgcaacacattgaggacatgccacaagaggtggcagtaatggctcttcattatgccgccatgtaccaatgcccatttccctctttccctcggcagtcagcttcgtgcacgaattgttgtaacagtggaggctcaggacaggcccacaactgtggaggtagcttgtcccgtagatcagttcaattggcaatagagggagtggctacagagatggaaaattcaaggagggatgagaggttagagttggccatcagggaaagtagcacccaacttagaccaaagctttcatgtctttcctcactagtgtccgagtagatgtcgctagctagataggtagatttgggaagacaaattggggagaggaagaatctagatttggaggtagagatgggagagaagagaggaacaagattatggataggctagatataacttttaaatatattttatctttgttgcctgaacaactacatggtaaaactgtttccatgctttcatcgtcctcatatagcttgaaaggggaagggttatattaaaatagaccattttaacagttgagagtttaaacatctggtattaaagttgatggaaaaatcgtcacaaccgtatatgccatatatgttttgtttttgccatggtaggtctgtgatggtggtgctcatcataactcgttacaggacatgacttatgccagattttcgttgattcttagaaaaaaatgtgtgtagtccacaaagtattgagggtataaaatgtattcatttattaatcttaaaaaatctatattttcaatatgctctggttacaagatctgtgtattcatttatctaaaaactgcggctactcagtgattctttgattaaattaatggatgtctataaccacgcattccatttgtttgatagaaactgatttatcactaaaaatctttacgttttatatcgtgtggtggctgagagatcgtgaatatgctttgtagtagtagttggtgattttattatttctatcctaaagaaaaaatgatttaaatataatgcaaaatttgctttactaactaactctcactttctcttctaatttcagtgggccatgagcagtagtgacattagagacttcaccctacaaatgaaaattattatttatacgatattatcatgtctatcgagcgtattttgggcattatatgcttggttatttaacctaaaaacaccaaattactacatgataagtgatcatcccgtcactattatatataagacagtaggtcatttttattgttgtttttgtttctttactaattactaagaaatcgacacgctgattggtgtgtcaattgagtagtatgtgtgtacggtctttaaaaactacatagttaacatactaatattttttttatgatttggagcatcagtgagattagatttggcatagaactctagatatgaatccaacaccggaataagtgtttgttttatcataattgttgtgttttttaaaagttgaaagatttacgtattatttattttataatgtaagaaaaacatatgtttagaaaatggttatcaagattatagagtttgattcaatcctagaaagaatgagcaaattgtttttgtcatttagttttctatctattatttttatttttagtttctcgaaacataggatatgtagtcacgatacttgccccgaataatttgtaaagaattttacgaaaagtattttttctgtctttttttttcttttcctctctcttttacgtgtttgcactagtccggtcacacactgttgggttgtggtaccgtgtggcctagctacgcacatggaacagctttttttctctttttttttcagttcaccgtcgtatcttacgcacttgccaattttatagatagggtttcttacccggagctctttctgccacttgtatctcgccatgtgtcgctcaactaatggatggtgaggacaaccaatcagctagcacaaaaccaatcagtatgagatagatatatgcaaagaggaaagatattttgggaagcctctgtaatctagatgttgtgccttttgtttgcttctccgtatttctttttttattgatattctatatttatctcaaagaggataaataattgggaagtctctaggatttgtatctattgttttcttttggctatttttttatgcatagttttattagatttatcacaaaatttaataccaccatgtggcctaatgagacgagctagctttagaaagatagattggtcagaaacaagatgcccacagttcagcttggggcttagaccattcacagtaggcctccgtggcattcagcctcaccaccaaaaatagaatattcgctgccacgtcctccatccacacaacctcctcaagtccgcgtagccaaagttggctacgggttcctcgcaggtttgcaggtgggatccactgtcacaccctgaaaatcctaaatttataaattgttgtttaaatggaattattagaaatgattttaaaagcctagaagaaaagatttaattataaataataaattccaatataaaagtgggccagataaaattttattaaatacttcactcgattctatagttcctagatttttctgggatttatttgagccaagaaagtatttttaataaatggaattgcatttcatgaataatttataaaagaaacttttggctttgggccgaaagtcggcccaagtctctctctctccccgacctaagcgcgcccggcccaagtcagcccgccgagccgagccgccgctctccctcctctctcccgctgacaagtggggcccacctgtcaggccgtcttcaacctcccgccgcagccgcgccctagccgcgcgcaagccgccgccgcctccttccaaattcgcccgcgtctttccatctccgagcaaatcaatagaggggaaatgatcctcgggatctcctcttccttttctcttttggaaatttcatctaaattcgtttggaaatcccggatttgatctcgattcggattcgttttttttccctaaccctaaaccttccttctcgccgccggccaccgtgggcctccatcgccgccccctagcccctatataaggacccccgggacctcctctcttcgccgccaccctcgccttagccctccaccaccggtagagctctagccgcgtcaagccgtgcgccgccgtcgccgccgcaagtccagtcgtgcgccgccgccgctccggtcgtcgtcgtcgctcgggaaggccgccgtcgggttcgccaagtcgtcgccgtcctcgtcccatcctttgtttccgccgaggaccgccggaacatcgccgtcgtcgtcgacccgaacgtctccgccgcttcgacctcatcaccgtctccgtccgttgccgtccgccgtcgtccgagccttcggtgagttcgccgcgtcaccctctacttgttggtgccctccgtttgcgccgccgcgccgtcgttcactggcgagcacgaggtgccgagccgccgctagtgatgacgtcatcgtcgacgtcagcgcctggtctaacaatgtctttcgtgattagtctcacagctctcaccataataaatgatgctgtaattggtaataacttgtttagctcctggtttggagatagagctgtgcagccgggaatggttgttcagaatggttgggcctatgcaacgagtatgttgtatagtgttggattaatattgtttaagtaaatactttactgttttattaaattctgaagtatttattaaaggccatttatgcaaatgagactatattataccatcctttgttatcccctgcatttgcatatttgctgcgtggcttgttgagtatgtcatatactcaccttgcaatcattcatcagaggaggaattctacagtgatgctgaaggtgtggaggattaggcgtagccctggtcaagctgcttgtcggatggagacgcctacgccgtttatcttattttccgctgcttcaatttttattgtttgagaggaactatctacctctataatgactttatatttgcttattaattagagtaataattgtactctattattaatttgttattgtgtgtctcggctaattcttggacgagggtttacacacatgtaagcgtttggaattttggatagaaattctgggcgtgacacccacactcgaccttcgtgccgtcagggaaaggaaagagaggagagagacctcgtcggcatccccgcactccacgccgccgagctcactactccgctcgacgtcggactgtgtcgccccattctacgctacggcagccagaggaggagggggaaagcgcggcggaggagatgagaaggggagagggaggcatcggagaagcggatgcgctcgaggtcgaggccaacgtcgattcggagttggcgccgtcgccgctcgggccgccccgcgccatcgccactcgggccgcccggcaccagcatcgcgcgccatagctcagaccgccccgccggccgtcaccgctcacccctggcctgtgtggggaaagaaagaggggggagagagagcggagaggaagatgaaaggaaatgagagagaggagagggaggggaagatgaaaagtgaaaaaaaataatactagtgagacccactacaagtaacttgtactgtggagcatgtagcctatcttgtttttaggtggtgtttaggatgagagggacttaaataagtccaaacagcaccttaatctacgtgacatgaagaacagcaaaaatgaatgatgccctgctaatgcccggctaggggcgtatccaggtcaggaccgtacatctagagataaccagcagccacatagtacagactacagagactgctggtggggcctgcttgcaagatgctagtggtactaccagtactgcatgcacacttggcgtagtacgaacgagttgactgcgcatccaatccaataatggagcgaagcacaaatcagcaaggggtatcctccatcagattcctggactgaaccaatcaggtcttcctcctccggttgaattgctgcatactagtagtactagccaggacaccttttatttacgcttaattgctttctcgatcggaagcaaaacgctagagcaggtccccatcactgtagctcaacatgacatgaactgagccctctctctagttactgtagctgctaccaaccaactaatttgtagacgcagtagtgcttccaatggtctgcatgatggagattacacgtcctaattgtctagaaaccaattaaagaaactgcgacgcgcaatcaacctgcactaggctaaagaaaattaaggtactaatcaccgacaatatatttctttttcaaaccatcgtactcatcggtgttcatataaacagctggtgtaggggctacaagattcattttcttattcaaacagaatatcagtttgctatttaatttgtcaattcttaatttttatagtttttagtctcataaatttgcacaacacagcctaaaattgtaatgtacaaaggaggtgcggcattatagattgatgccaactaacatatacatacactagtacataaagaaagacacatacaagttggcactatagttaccagaacagctaaaaccattgcatatagcgttcttctcaccttcacatgctgaaaaaaactaatacctttaagtgactatagatgccggttctaaagaaaaaaatgacacctttatcttaggtaccttttttttaaaaaaaataaaatgaaccagaacctttaatatattataggtgctgtaaaaaccgagccaagcatagatctgattttttttggtgcacatggccctgggaggggggcatcctcatccaccagcgccctcctctcgcccatctctctttatctctctatctctctctccaactctcctccgttttctgccggctccctctcctcctctccttccgttgcacggttgatatttcttaatgacattactagaaatataattcacagcactgacatagaaatattcatggtatattaatggttacagatatgatccgcaaacgcacggatataccattataacatttcacccggaagtattccaagatatcgtatttatttaatcccaagagaagataaccgaatactcggacattaaacccataccattgtacctctctggtaggctagctacacaactatatcggtacaagtataaaataaagtcggtactcagataatataaatggaataaaatatcgaagatgtataaaaaagaatattctattacttcaatgagtcttacaaaagaagagagaaaatccgctagagccatacccgaaatctcctgaagactcgaggactaagaaaactattctattcctactctactagcactaagatactactaaacttgcgagagggagagagctcttcttcttgagtgtgtgttgaagtggagggagtgaagtccttatatagcctcccaataacggttgtggcggttggaatggacgaaaatgccctccaatcgtcattggggagtgatccacaccgtccatcgcaaaccctacatcgaacggcttcacggtgggttcggccgaaccatgggctgggccattctgtcccatttttggcaggcagcctccttaactccttccttatccagaacagtgaattttgagcctattggatcgtgtcaattatttgttcttggcccatttatccataattctggatctcgacaacgtctgattgattgatcgtttattttttgtcgattctcctccatttatatgtgcttctcctgcatacatgttagtagcatagtatatagtggaaatagatattttatttagaaattatgcattgcaagcatagctagtcttcattaattgggtaatattgacggtcgaaattggtcgataacgaccttcaacaacggtccactgcgcccatggcctctcacccaccacacccgtcaccatggcgacgccggtgctggcagctggcgaccaccactgagctgaagaaggaactgaggaggatttcggtggaggtgtacggcaccaaggccagcgtcctcaacaccgactgtgccatctgcctcggtgatttcgccgacatcgataaggtgtgcgtgctatcaaggtgccaccacggcttcacgaccactgcatcaagcgtcgacggctgcttccgtgacgtatctagcattgccagcatccccctcacctcccctgggaagtaccccctcacctcccaacagcggcggcctcctctcaccttcccacgatggcggtgtcgagtgcgaccagatctgaccactgtagctcaagggcggcggcagtggacttctctccttcaactccttgtttttacttctttggattttttttggttatgtggacgttgattttgtttttgaatgttgattgtgcgattgtgttcatgttgatcgattcaacggtttagtggtgattgggagctgcttgattcattggatcgattcgagccgatgcatcaactcgcctttttttttattctttggacctcaaaggtgccagttctaaaaactggcacatttgatttctctcattagtgccgtcttttaagtgtcggttgggtaaaacgacacctatgcggggtttccaaccagcatttgtgttttttactgttaaattgtattctttttagaacatagataagtacatataaagcctactgcacattctggttgaaactgtttgttggaaaaacctatcaagaaacgctggtatgacataataaaatcgataggcactactacgaaaaccatctttcgtggcggccatattgggttttcgctagcggaatttaaagccgccataaagccatggccagtgaaaatcaagatcttcgctagctgttatcgatcgccagcgataattcattttcgctggcggtcgtcttaagccagcaaaaatgaattatcgctggtggttggcttaagacaaccgccagcgaaaatgaattatcgctgatgggttacactgtgccagccgctagtgtaaatgctagccaagttaaaaaaaacgacagatggagcgacaacacttcacccgcctcccttcacataaatttacccaagcattcaaaaatccacaaaaaattacattcaaaaatttccattcacccaagcattcaagcatcacaaaaatttgaagtcgccgtcgcggcgctgcccccgtcatcacgacgcctcccctatcggcgtcggtggcagatccggcctcccaggtcgtcgcggcagcggatccggcctcgcccgtcgtcgcgatggccggatccggccggccccgagctcatggtggtagaggcgacggcagcccgcagcggtggtggcgacggcagctggcggtgatggaggagggagagtgagaaggagagcccacggctggatccgtcacccgcgtcgttgtcgtcgccgagactggctgccgccgtcgggtccgtcgcccgcgccgttgttgtcgccgagactagatgccaccgagcccgccggatccgtcgcgccagcaccgtccccgccgcagagcccagtcaccgctgccacccatcccctttgccgctaccggagccgtcatcgcctacgccatcggtggagagggatgaggagagggctgcgcctcggtggggagggacgaggagggaagagtggatctggaggatagagtggatatgggagaggggagaggaggggatgggagggcagtggcagcgcggggagccgccggtcgtcgccgtcgccgtcgccggtggggaggccgagagggaggaggggataagaagaggaggggatgtggagagaaggagaagaggatgaggtaggtgggtggttttaatgtgaccagatatttttggtatgagctgggttttctctggcagttctgtttattggccgctaggaaaaattcgaccgccagtgaagattatctattttcgctagcggcgcacctaagtgaccaccagcagaaattgtcatattttcgctgacggcagtgttagacgagccgccagtgaaaattcattttcgctggcggttggtgccccccaccccctcgttatgactttgctagcggtttttacatttttccgccagtgaaaataataggccaatgccatgaaaaatcgtttttctagtagcgaggtctgaggacaatctgaacttagttgaacattggtaggatgtgattgtcaggtaaaacgattaatcaagaaatacgagtttgtacgtgagagttagtagtaaaaacttaaacccttcccccacaatagccaacttgaacttagtcctctttccttgaagataaaaagaccacattgaaaatcccatcgtttcgctcatacttatacttatccacttatccgtacagcttattaacaatagaaagataatttatggaaaaactttttttacatatacatattcttaacgattcaaaagtaaatgttataaaataaactacgatgaaaaaccataaaatgaacttaaaactaaaatttttagtttataagtataagtataagtgggacgatggggctattgactataagtacacataacagtctcgttgatgctggatataacagtcgcatactgttatagtagttacttactaggtaaccaagacttgcatggctttttattcattatttagtggtattagctagggctgcagg

SEQ ID NO: 58389 - DNA, 4928 bp, Oryza sativa
tctagggggtggccatatcccagtaccgcccaccatccaaacacctccaaaatttggacggccatatcctatcccagccaatctctccatccaaacacatccttaagagttcccgttaattttgtccgctttagacaaatgtagacgtgtgcacggcaaatgagatcggcatgttgtaggattatttacaccaccaagtggtatgagaaacagagcctcacccgatccttttgtctgcaggagacagccactcctacactcggtcacgacaaggatgttgtggttgtctatattcattcgtaaaagttaagtgaaggaagtatctcacaaaccctcttctacaatgtcacattaccatcaccggcagatagagaagccacatcatacgattgtttacatgatatactgtcacagacattattaacttatgacgcaaaggctatatggttgtccacgcatcatcatctgaaaatttactgaacatgatctagccggcgcgttaattcttcctgaaatgcgtgatctggacgttctccacgtccagcttcttgaagttgctgttcttcctggtgctgaagaattcgccccagttgtaggggttgtacctggccgggctctcgtcgctcacgacctcctccagtggctccaccatggtgtggcccgccgggttgaagaagaaagggatggagaacctctccttctccacgttcaccgccacccggtgctccgcgctctcgtacctgtcattgctccacacctggacaagcgcactctcaattttttcagtcaaattcaaaatgcaaataaaaatgatgtcaaatagtaacaattaaactacaatgttgttatatatttattaactaattctcttttaaaagtttgtcaactatgaataccgttataattgtagtgtaattatattataacttgtatataactgtaatataacgtgtatgcacataattttaaatcgttagatttacttcaagattcattcaacttggaacgacctccgtttcgtgaaaatagcgtgttaccgtagaaaacttatatgtaagtttcacataattttaatctattagatttactttgaaatttatttaagttggcaagaaaaaaaaatcatatgacgcgcatgggtgaaaagatacggtctcacaatctccgctttcgcgaaaataccatgttactataggatttctaaaacttacatataaggacacacaagttatgatacaattattctttcattgtaatatatttatgtccgataaattgttagaagaaaatttgttgataaatatgtagctgctcaaaaaaaaaagtacctggatgatgtcgccgacgttgatgatgaaggagtgagggacgggcctgacgcgcacccactcgccgtcggatcggcggcggacgtcgaggccgccgacatcgtcctggtagagcacggtgagcgcgccggcgtccttgtggcggccgacgccgagggcgaggtcggggctcgggcagggagggtagtggttgagccggatgaaggtggtctggtcgtccttgaagaagccatggaggcggtcgggtctcaggccgaggctcctggcgatcagctccagcagcttgaacgccagctcctccaccgcttcgccgtactcctccattgcctccctgctcaagaattcgatgaggttgaactgaattgatgcgaggatgaagaagacgatcgatcgatgtggtgacctgacctgaatcccggcaggtcgtcgggccacttgttgtcgaacaccaggtcgccgtcggccacggcggtcgtcggcggcggcggcgtctggcgcgggacgaggtcgaacacctccttccagtccctgacgttcttggtgtgctcggacgcgtagtaccccatcggcgccgcctcgctccgcgccacggccgccctccgctccggcggcagcgcgaagaacgtcctctgcgcctccgccgcgcgcgccaccgcctccgcgggcacaccgtggcgcaccaccacgaagaagccccagtcccggctcgccctcccgacctccgccgcgagcgcgtccaccccgtcggcgtcgccatcgccggcggcgaggagaggggagaggtcgatgaccgggatgccgtcggcctcggcgacggacgccttggggcggtgctcgggggcctgcacgaacgcctggtccatggagaggccgcccatggtcgatcagtagctggtggcgagaagctgtagcacaagtgttcgtctcgtgtgtcagcgtgtgtgtgtgtgtgcgtgtggcttgggtttgatatcggcgaggaaaaaggacgtgcgatgggttaggttggatagctcagttcatggctggattcaatgaatctggatgggtttcagtgtgacgcacatttggcttgtgtggtggaggccttctgatcggtgcgtgttgtctgtttgttgtagtgacgtcgatggatgatcgaccgagctagagagccgagttggcgacactgcgacacaacacacgatcgacaggaaaaaggtggccggccgggttgagagaaataacacgtacggtaccgatttgcaaatgaaaaaaaaatatataaataaaacttttatacacgtgttcataacgatctaaaagtaaagactataaataaactacgatgaaaaaaaaaatctcaaaatcaacttttaatttaagattgaaaattcaaactttagctaggagtaataagtacaagtataagcataaatgaaaaaaataaggttgtacgagttcactcaggatacagttttaacgccgctagcgccgccgccttacgtgtttatgtccttggcacgccgggagatcggccaccggcggcgagcttggacgccggcgacgcgaggcgtccttgaggggatcgaacggtcgtgttcagtgcgtggctcaatgatatgatgcgctgcggttggtgacaaatggctgggagcggagagagcacgacaaattatggttgtagcttcctcgtcaggcggacgcgacgcgagcgagagtattcacccggagctcgcggtcagtggaatctgaaatcagcacagccaccgtagtttctctccttgcaagtcgcaacaacgtacgaccacctgtgctagctagggagtcagagtaactatggaagcgcgatgaaatcatattccctccgtctttaaaaagaaactaacttaatatcaaaggtgatattttttctaaataatatatctgaatagaatattgtccagattcactgtattaagaaatatcactttcaataatatgttgatttttaggacaaagaaagtatgcaccaacggggtgctggtgtgctcgtgggctaaccaaaaaattgggccggatgatgtagtggtgactgtggtgttagttgttgtgcagagaggttgtggctgtagcaggagaggaagccgaagcgcggcggggcgctcatctcatctcgtcctgtacgccgtgtccatcagcgaggccgctcatgcatgtgcgtcttcctcgctcgacgggtgcttcgccgccgcggccaccgtccgtacgtgctcgatctggaacgtgaacgtatacctggaagtgaacacaaagaacaacaaactaataatgatatatgttatccatgagaaaattaggccaaagctgttgaaaatatggtcacatttcggtatattttaatccaaattattacgataataatcatgactttaacagggaataaaccagtacaattatcaaacagatgtaacaaataaatcatgcttaatatataaaaagtatagatattcaccataaggcaatgcactaaaaacattgcgccaaacataaacttagtagacatgaaaagtagtgtagaaagattatacccagtcaatgtccctccgctggattgtgaggcagaattgcctccgttggtgttgtcgcctggagcgccgccgttccctccagctcctggtgcaccatcgccagtggaagccatcgcgatgcagaggaagcagagcagtcacgtcgagatgctccctaaaaacttgatcgtccgcctacccgtgcaggtttctcaggtggacggagttctggaggcacctactcgtcctggatctcccatgcgcgcaagagatcagaaccggagaagacagagtagcagcgcaggaaacataagagattcagcgacaggaggaggaagtgtgagagacggagagcggaaccggagctctgtcgcggtggtggctttttatagcgcaggagggggcgcttctcgtccattaccagagtaacagtcgcgcccgcattgaatcatattcaattcccatccgttgagccggttcgaaaggaattcaattggcctcgccacggccacgcccacggcctcaacccggcccggcccggcaggcgcgcgcgtgcgcccgtgtggcagtccgcccactatctcaaccggtcaacaggggctcttctctagctccctattttaaattgagatctcttcacttaaattcctgaggtagttttattacctctaacatttattgcgggcctatggattttaattgaattaaatcaggcctaacccatttattccaacaatccccaccaaatttcatggctcactagaaatgctctcgatagcccatttgttttttataccagtgtttcggtggaaactgttaagttgaacttacacctaggaaaagagctacaccagatcacaactgaacaatggactatgccttgaattgtcagtcttgtgtaattcaggtttcactcaaacccttaactaatactgggatgccgtttgcatcccctctgtttggagcgtatgagttatactcccggccttttcatgagtatctagagatcacccaaatcttatagactgtgactagcagttggactcatataggtgtgttccttctaagatgt

SEQ ID NO: 58390 - DNA, 1820 bp, Oryza sativa
ggcgaattcgagctcggtaccctcagcttcactcaacatagctatgccttccagattcaaagtaaaatcattctctggagggggaccaaaaagctgtttataaaaatttgttatatatttcattagatcactctggcctttaatctccccctcttcctgatccagagaatgaatcatgttttttcttttccttccattggctttagcatggtagtattttgtgttatcatccccttccaaaaggttttttttctttacatctctgcatccatttcaatctatcctctcttactactttcttcaactcttcctccaaatcccctctctcttttctttccagaatagtcattccatatgcttcacattttttatcaatgtcttctattttttccataatttcatgttttttccttttgtacattccttcccagttcatgttccaaccttttagtttctttctcattttttgtaaactccattgccatttatcaatactggatccatttatattacaagaattccaaacttgctcaaccacagtattaatatcttctctcatgagccaaatattctcaaatttaaacagaggagactgccacttttctccctcaacattgatcaaaagaggagtgtggtcagagtaaattctctctaagacccttccacatgccaaagggaacttaatctcccatttatcattaaaaagaattctgtccaatttttcaagagttacactttgtttgttattagcccaagtgaattttttcccttccaaggccatctctctcaagtttgcattctcaattatagaattgaacataagactccatttattcacccctcccctcttgtttttttcattctctcgtctcaggatgttaaaatccccaccaattaacaggggttcatcacacccataacaatcctgagctaacaccctcaagaactcctccttgtgttcaggctgggcagccccatacacagttattaatctccacacaaatttgtcatttctattttttactttaacatgcaacaaaaaattcttcttggaaacttccataatttccattttgtcttcatttattcccaccaacatacccccagatctacccctgggaatggtccaattccaactaaacttaccccctcctcctattaaatccaagtctttagcagtgaaatcctgcttcacagtttcttggatgccaatgaaatcaactttatgctcttttattaaatcattgagatgctttattttatcatgatcacccatacctcttatattccaaaataaacctttcatgatttcttttttgtttttttcttctcatttttgccactacatttaggagtgaccttgaaaatctcaaggtttcctctgttatttttcctcctcttttttcctgatgaattgctttgagaaagcctcaacatgttttcagcataatcaaaatcagacatacaatcatctgaatgtaagacttcatctatatttatgtctatgtcactcaagttttccccaacattttcacactcccctttctgagaagtatttagtttctctttcaagaacagatttattctagccaattccagatttgtatccacagcttctagagcacatcctaaattaacacctagcagactagccatttgagctagagagaaattactttcatcaactatagatgggatttgtttgttacctttgttgatgaaagcattaagagcctctttcctttcagctgcagcatcggccacctttttgtcttccttctccaaaagtcttagacttttcttcctcttctcctctgtca

SEQ ID NO: 58391 - DNA, 11344 bp, Oryza sativa
ttcctttcagctgcagcatcggccacctttttgtcttccttctccaaaagtcttagacttttcttcctcttctcctctgtcatgtcttcattagtatgagacagaacaactcccaccgctgcagcaaagtcacttgattcttgtgattccatgttctcctcactccccaccagttgcactcttggttcatcttcatcataaatcacctcctcactgtcattttccactctctgactagtaccacttttatctgccatcccttcttgtgtcttctttgttttcttatttttctcctccccagcatgtgcttcttctctgattccaccctctatcatccctcctgctacatctttatcaagttgaatctgcttgactttaaaatgttcttctagttgtactctcagagccatctccctgtctatctccatctgtttgagcttcaccatttctgcttgagcactttcattgtctgaatcctcttccacaactatggctttcctcttgtccccagccttttccaaaaccctcatatttgatgcagcttcttcttttcttggtttcttattcctctgcatgtgatttatgttgccaggttcattttgctcctccacctccacagctctcttttcctgtgcacaatctctaaaccatcccaactccacaatctgctccaacttgaaatgagctttgtaaaccagcaacttaggtgtcaccagagtcatggtcagaggcaagctttttagtgtcatcattcctactctaattctgaccacattctttgtctttaaagctaccatatccacttctatcacaggtcctagattggaacccacttcatgtagagggtcgtaatccttcatttcatcaggtaccccctccacagtcacccacacttcatgtaacctccccactgcctcagcttcttgagtccatttcttcactttcacctgtacagatattccttttactctaattgagtcaaattcagctaactcatccaatttcatcttatttgggaatctcatatggaacaaccctttctcctgcatcctagccttccaagtccagttccacttgaaatgttgagtgaatccttcctccaaagcctgctcagtaagatcacctccccacataattgtcacaatagccaaagggttaacatgttctttttgcactatacccttagcactctgaatcagcacacagcccagacctggggcagcacatcccactactttagctacaggtttcttctgattcttcctaaaacaatcctctgtcctatgagtctcttttgcacatatcatacagaacactgacaatttgcaatctctagacaaatgactgtaactcctgcatttagaacagaaaatcctctgctgggaatgggattcaccaacctgatgcttggactcaactcaattttgttgctgatttggctttgcttccaatcctgaactgatagaatccatcttggcacttgtttcctggaaatttggacccgcttccttcctcccttcagttttcagcgtgtccttcccctgtgtcacaccctaaaaatcctaaatatataaattgttgtttaattggaattattagaaatgattttaaaagtctagaagaaaagatctaattttaaataataaattccaatataaaagtgggcaagataaaattttaatactttacttgattctatagttcctagatttttctaggatttatttgaaccaaggaagtatttttaataaatggaattgcatttcatgaataatttaaattggaaaaggtttttaaagttcccatttggctttgtccctctctctcctctccggcccagtcggcccagtcagcctgcagccgcccgcgcgcgcgcgctcggccgctgacaggtgggtcccacctgtcggactcgtcgtcctcctcgcgccgaaaccctagccgcgccgcgccgccgccgcctttccaattcggccgcatctttcccgatccggtgaaatagtttgaggggaaatgctccccgggatcttctctacctttttccttttggaatcgatcgccaattcggtttggaaatccatggattcatgttcgattcggatcgatctatctcctccgaaccctaaaccttccatcgcgtcgccggtcgctgtgggccttcgccgccgcctccttgcccctataaaaggacccccggtgtctccgctatccgtcgccacccttgcctttgcccgccgccatctgtagcaccctagcaccgtgcagccgtgcgccgccgtcgccgccgcagctccagccgtgcgccgccgtcgctccggtcgtcgtcgctgctcggggaggtcaccgttgtggtcaccaagccgtcaccgatctcgtccacccctccgtcgtcgccgtaggtcaccggagcatcgccgtcgtcatcaagccgaaggtcgccgccgcttattccacgacgtcgtcgccgtccgttgatcttccgccactgttttggtcaccggtgagttcgccacgtcgccctctacgtgttggtgtcctccgttcgcgtcgtcgcgccgtcgttcgccggcgagcttgcgtgcccgagccgccgccagtgatgacgtcatcgccgacgtcatcgttgccgtccgtcgtaggccggtcgtagaccgtcagatcttggccgtccgttgtggataggatcgatctcggccgttcgtttccgtgagtcgccgctgtgcacccggtccaccgcggaccctagccgctgacgcaataattcccttttccttttcaaaaataattcattattgcgtcataattcaattaaaacccatataagtgttttaatccgatttaatgtttaaaaaatcataactaattcatcttaactcagatttagttggttcaagtctctaaatttttctaaaattgagatctacatgttaaaaatatctacatgtactgttcatgcttgtttatgtgctgttttggtgattttgctcttttctgtttagattccgacttttccggagagtccgttttcgcaggagaagaatttgaagagttccaaggccagcaaggcaagtcacacagatcccaaccaaccctttgagcatattgatcccgtttaaagctattgtttctattcaactattgcatttatttttgaatgtcatggggtggaattaacctattgtttgttatagcccttttgttcttgattactttattccttgataccttgggttattataacttgactagttgagctttatatattggttcagctagatatcagatatgattgcttagccatgcttagaaacattagcacaatattgggataacttatgattcactattatttaatgatggcttaatgatagttcacgatggtcaatcgtgattggttaattaattaaattgccaactaaaacttgataatggtgggttgtgagcacatggttttgttggtcgtgctcatgacaataaaggaccggttcacgattttcggttgtgaaacattaaccgtgccaaccacaagccagcgtgggcaacggctttaccttttgtataacatggttcattccggagcaccagactgagaagtggcggagataagcccacgggggtcgctggggagtccatgccttgtttataagggggtgattatgatccaggaacggtgagctgtggtggattgtgttgtgcgaggggtactgtcacagctcctttccgaggtactgtggtggtattgaggcgcatggtgacatgtcatgaggctgtgtcttgtgggtacagtggtacacctctggccagagcacaactattcgaatagccgtgcccgcggttatgggcgggtctaacaatgtctttcgtgattagtctcacacttctcatcataataaaagatgctataactggtaataatttgattagctcctggtttggaatggttaattcctggtttggagatagaactgtgcagccgagatgattgttcagaatgtgcagccgggatgattgttcagaatggttgggcctaagcaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgttgcgtggcttgctgagtatgtcatatactcacctagcaatcattcatcagaggaggagttctacagtgatgctgatggtgtggaagattaggtgtagccctggtcaagctgcctgtggagtggagtcgtcggcgccgtttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccggacgtgacaaattggtattagagcctccttgaccctaggttgtgccaaatggttacccatagaagccctctaaaaatattagaaaagtagaactgttctcttctctttctcttttaattaaaccaaactaatggcacatgcagtttataattcctttaattgttctcatttaaaaatttatttattattcctgtgttattagtaccgtacatctattactgtactaatggcccatttaccagcaaaagttttacaacattgttttatttaatcttgctgtaatgaaataaatttagcatgttgattttataactttcttttattttatttcttttgaaacctgttgttcaaaagtgcaaaatttgtaatcttgtttccaactgtttcaacttatcttgctagcttggtttactttatttacttaccttttactttgatttttctaactttattcaaattaatccaaaaacttgtgctattaattggataaaggtcttaactccctcctttcacttgtctttagatgccgcgctacaagcctgagtacttgtttggtgttgagcgatttgtccaggagttgcgtacgatgtcctttgccataggatttgggactgcccctttgtatgcccagattcctcatgatcgtgatgaagagaagtgccgagtcaaagtcaccttgaacagtaatagtgaagatatcccatcagtgatgttcgaagttggaggaggaaactacattcatgcatgtcaggaggtggcaaggatcgccataggagagctccgcgatcgctacagtgatcagttggccgacactgagtatcgctaccatcctcgccaaccccagggaggtgaccgtggcagctaccttgagactgaggggattgagaatgatgctaccacaaggcatttggttgagatactgtgggctatggatgagacccgcgcggaggttgtgctagcagctcaagatcgtgaagaccggaatcgtgataagatttgcaagctagaggacaatgtggattgtaacatcccggcctagggtttaataggattaatagaatactcataccaataagttgcaacttcttttccggaagccaatctccaaagaactccagggttaagcgtgcttggcctggagcaatttgggatgggtgaccgaccgggaaattctttccgggtgcacacgagtgagggtagtctatgacctatgaaagctatcagatgtaagtgggcccggcctgggggaggcgggacgttacatggatcgtttgggcccggcctgggggaggcgggacgttacatggatcgtttggagaaggaactagccgcattgaagggagaagcaccaccacaaaaggccagggttcgtcttaccgcaaggaagagagctctattcgtccctcgctaccaattggcgccaaaggttcgtgtggtggaaaaagaagctaccccaaccctagcggatcctccggtcgtcaacgtaagtgatgatgaaggagaagaatcgaagcgcacccactcaaaggtcgaatggggagctactcaagatgatggagacgagccgaacgagccttcaatcaactccgatgccggatgtaagcgcatgcgtttgtttgctttcgagtgttaggtagttggtgagtttagtggtgtgagagtcttcagttctgtaataatgaaactcagttaagatcaataaaagttaagttagtagaaaaattaattctctgtcctaagtagttttccccggtttctcttcttgtgctcctgcccatgccagatggtgctcactcgcagcatcgggaatggccccaacatcaacaataacaacaacaacaatggagagaatcccacacttgcccaagtcctggctcaacaggcacagcttatgaacatgatgatgcagcaacttcagaaccagcagaaccagggaaataaccatgcacctccctagaacaagttggcagaatttcttcgtgtgagaccgcccactttctctagcaccactaatcctgttgaagctggtgattggctgcacgccatagagaagaagttggatttgcttcagtgcactgatcaggagaaggtctcatttgcatcacaccaactgcatggccccgcctctgagtggtgggatcacttctgccttaataggactactgctgaacctatcacttggcttgaattcaccgctgctttccggaagacgcatataccatcgggagtggtgtctctcaagaagaaggaattcaagtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctatttgccaggaggacaagtataaccgcatgaagcagaagaaacgccggattgctcacttcaaggcacaacaggggaatagtcagaagccgcgtcttcctttaggaccccagtccatgccacagggaggttctttgtctgttgttcgtccgcagcgtcagttcttcaacaacaatgctggcaacaacatccgcaatcaagctccactccctgttgcagctccaacacagcaacagcctgccaagaaggagcaaggcagcaagcctggagtgtgcttcaactgtggtgaaccaggccattactctgacaagtgtccgaagccccgacgcgtgaaggttgtccctgcccagagcaactctaccgcaccagcatcaaaggctcgtgtcaatcatgttgctgctgcaaaagctcaaggtgctccagatgtgattttgggtacgttccttgttaactcagttcctgcaacagtgcttttcgattttggtgctacacattcatttttatctatgagttttgcgggaaatcatgggatggaagtagaagatcttagatgtcctttgatggttagtaccccaagtaatcaagcactctctttgcaacgtagcccctcggtcagaatagaaattcaaggagtaccatttctggccaatcttattctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtttttaaggtcaagtctgaaccaaatagctttggaagagattcccatagtacaggaatacccggacgtgttcccggacgatttacctggtatgccgcctaaaagagatattgaattcagaatagatctggtaccaggaacaactccgatccattagagaccttatagaatggcagccaatgaattagcagaagtcaagaggcaagtagatgatttgcttcagaaaggatacattagaccaagttcgtctccatggggagctccagttatttttgtggaaaagaaagatcatacccagaggatgtgtgtggactatcgtgcactaaatgatgtgactatcaagaataagtacccgctgcccagaattgatgatttgtttgatcagcttaaaggtgccaccgttttctccaagatagatctccgatcagggtatcaccagttgagaatcaaagaggaagatatacataagacggcttttaccactagatatgggttgtttgaatgtactgttatgtcttttggacttaccaatgcccccgctttcttcatgaacttgatgaataaggtgtttatggaatacctagacaagttcgtggtggtctttattgatgacattctcatttattctcgaaccaaagaagagcatgaagaacatcttcgtcttgcactagagaagctgcgagaacatcaactgtatgccaagtttagcaagtgtgaattttggttgtctgaagtgaagttccttggtcacgtcatcttagccggaggagttgccgttgatcctagtaatgtggaatccgtaaccaactggaaacaaccaaagacagtttcagagattcgcagtttcctgggtcttgcaggttattaccggaggtttatagagaatttctccaagattgctaagcccatgacacggctgcttcagaaagatgtgaagtacaagtggtcagaagaatgtgagcagagttttcaagagttgaaaagtcgcttaatatcagcacccattttgattttgcctgatccaaagaagggtttccaagtgtattgcgatgcatctaagcttgggttaggttgtgttctgatgcaagatgggaaggtggttgcctatacatctcgtcagttacgtccgcatgagaagaactaccctactcatgatcttgagttagctgcagtggttcatgcgttgaagatttggcgtcattatcttttcggtactcgtacagaggtgtacaccgatcacaagagtttaaagtatatctttactcagccagatctgaacatgagacaacggagatggttggaattaattaaggattatgacatgggaattcattatcacccgggaaaggctaatgttgtagcagacgctcttagcaggaaaggctattgcaatgctacggaaggacgacagttgccattggagttatgcaaggaatttgaaatattaaatttgggaattgtcagtagaggtttcgttgcagccttagaagcaaagcccactctaatcgatcaggttagagaagcccaaattaatgatcctgatattcaagaaatcaagaagaatatgagaagaggaaaagctatcgggtatttggaagatgagcaaggaactgtatggttgggcgagagaatctgcgtcccagacaacaaagatttaaaagatgcaattctgaaagaagctcatgatactttatactccattcaccctggtagtaccaagatgtaccaagatctcaaggaaagattttggtgggcaagtatgaagcgtgagatagcggaatatgtagctgtgtgtgatgtttgtcagcgggtcaaggcagaacatcagaaacccgccggtttgttgcagcctttaaagataccagagtggaagtgggaggaaatcggtatggatttcatcactggtctacccagtacgtcatcaggccacgactctatttgggtgatagtcgacagacttaccaaagtggctcatttcatcccagtaaagacaacatattccggaagtcggttggcggaattgtatatggcaaggattgtgtatttgcatggcgttcctaagaaaatagtgtctgatcgaggtagtcagtttactttaaagttttggaagaaacttcaagaagagatgggttctaagctgaacttcagtactgcttatcatccgtagacagatgaacaaaccgaaagggtaaatcagattttggaagacatgttgagagcttgtgctttagacttcggtggaagttgggataagaatctatcttatgcggaattctcgtacaacaacagttatcaagctagtcttcagatggctccttacgaagcactgtatggtcggaagtgccgcactctgcttttgtgggatcaaacgggagaacgtcaggttttcgggactgatatcttaagggaagcagaagaaaaggtaaaaatcattcaagaaagattgcgtgtggctcagtctcgtcataagagttatgccgacaatcgccgcagagatttgagttttgaagaaggagatcatgtgtaccttcgtgtcacgcctcttcgaggggttcatcgttttcacaccaaaggaaaattggcaccgtgttttgtgggaccttataagattatcaatagaagaggagaggttgcttatcagttggagttacctcaatctctggcaggagtccataatgtgtttcacgtgtcacaattgaaaaagtgtttaagggtacctaccgaagaagctaatcttgaacagatagaagttcaagaggatctgacatatgttgagaagccaatccgtatcttggaaacaaacgagagaagaaccaggaatagagttatccgttttgcaaagtccaatggagtaatcactcggaagaagaatcaacttgggaacgagaagatgaattaaagtcagctcatccgcatctgttcgccagttcttccgaatctcgaggacgagattctgtttaaggggggtaggtttgtcacaccctaaaaatcctaaatatataaattgttgtttaattggaattattagaaatgattttaaaagtctagaagaaaagatctaattttaaataataaattccaatataaaagtgagccagataaaattttaatactttacttgattctatagttcctagatttttctgggatttatttgagccaaggaagtatttttaataaatggaattgtatttcatgaataatttaaattggaaaaggtttttaaagttcccttttggctttgtccctctctctcctcttcggcccaatcggcccagtcagcctgcagccgcccgcgcgcgcgcgctcggccgctgacaggtgggtcccacctgtcggactcgtcgtcctccttgcgctgaaaccctagccgcgcctcaccgtcgccggcttttcaattcgggcgtatctttcccgatccggtgaaatagtttgaggggaaatgctccccgggatcttctctacctttttccttttggaatcgatcgccaattcggtttggaaatccgtggactcatgttcgattcggatcgatctctctcctccgaaccctaaaccttccatcgcgtcgccggtcgccgtgg

SEQ ID NO: 58392 - DNA, 11029 bp, Oryza sativa
  unsure (1)..(11029): unsure at all n locations
aaatatatttgatgttagatttaatgtaactaatttgatgttgtaaatattattaactttttctataaacttactctcaagtttaaatatttttaaaaataaagtcaaagtgtcaaataatttgaaagagagtgaatagatgattataattttttgttcacaatgaacaccgaagtgtcagtaaaatcaagtcaacctccagtgaatcttgggttcatagtcacccatcagtttcccttactgccggtaactgcacggttaccgaggttaccatgcttaccacgggaaacggtaatggttaccgacagtaaaatttcaaccaaattcaaaatttcccaaaaaaaatgaaaacaatccaaaaaataatcatggatgtgattcttgatttttagtggcaaatggtgaagaaatttttgaaaaagagtaaagataaaattaaatttaagggcaaaactgataatagtttagaaaatggaaaaaaagaaaaaaatatccattgaggcccaatagagaaggaaatatctccataatatacaagaggtcatgttgaattttttattttacatccaaaagttcggtttgcaactatcctatatatttttctaattatccctagtttctacatttaagtgggttttcaattttttttagcattgttacgttcatctacacaactcacggttaccgtgcaaaccatgtagtaaccacaaccaaaccgtgcaaccgtcaaattttttaattcaaatgcttgccgacgaaattcatgcggttttctcggttactgcgggggtgcgataaccgctctccaagtggtaagggaaaccctagcatccatacagcagctgcatattctgatcacacggcggaacacgaggacggccgggatcccgacaacaactctcgaatccacgcgagctccttgtcccagctgaattctcccgccggcggcgctggaaatgccattgccatgtctgggcacggcacgacaccggacgccgtccagaaaatgtcgccgccgccgctaatggagcatggctctgccgccggcgccgggaacggcgaggattcgccgggctcgccgtgcttcgggccaagcaactcgtcgacggttgcccccatcgccagcgccatgatcacctcgtggtccgtgcgagggccgtccctcgtctgcacgagcgtctgctcctccggcggcggtgggaactggacggacggatgaatgctgccgacctcgtcgccgttgactccggcgggcatcacgtcggcgtgccggtgccgcgagctcgccggagcatggatcagatcgtcagccgcctgcttcctcttggagcccgaggtggacgccgccgcggcctgcaggcttgcctctacttgagcggcgcgaggcgaccggtacatcttgcagaggaccaggccgccggcgtcggcctcgccgccgccgccgccgccgtggtcgacgccgaactccgtcatgcaccacccgagcctggtcaagcggcggccggaccccctctccctcaccccgtaggacagcctgcgcaggtgcccgacgcggcgcccgccggcgtcgagcacggccttcttgcccgccctccgggtgccagcagccacagtgcccggcctccccgttggcgccgccgccgccgccgaccgcgcgctgccgccgcctggccccgacgccgccgccgccgcggtgcaccgggcagaagaagtagtacaccgcgccggcgccgtcgccgcggtcggtgccccgggcggggacgtgcctggcggcgaggtcgggcggcgcggcggagtagacgtcggcgtcgtggatgaaggggagcttgatggtgtcgtcggcgatcttggggcgcaggaacttggtgatcagctcgtgatccggcggagagaaggtgaggccaccggccatgggtgatctctagtttcccgcgcccccgcgcgcgcgagagctagctagggttggaagcgatcaagcgatcgatcaacgtacaatcgaggagtaggagtagatatttgaattcaggtaggttaatttgattcgtgttcatctctaattcggctaggttattcgttttcatctcggataggctggtttggaaaaattaattgggccttcagcttaattggctagggtccaatttgactctcgttagttcgttggcttatagagtacgatgcattcaaatttgaatgtcagaagttaattaaatttggaattgcttcagacctcttccgttgttttttgtttttaagaactggcctctgtaccaccaagattgaaagtataataaaactgttactctaaaattgtttttcgtcatttaggtcgtgtcttctgcttataaggtgaagaaagaaaaaaaaacatgctggtgatggggttcttttgagggagaaaattgacattatgtcattgtcaaaagttggttttgctaaaataacatttttcaaatagacttcgttaaattaccactctttaatgttcatcattgctagaatacctttttggatgaaaatacccttcttacccatcttctctcccaaatatgtgcttgtcggtgacaatagagaaacaccagtgacaaaggagtggttcgggatgaaggcactgagcagcgagccgacgagcaaaccgtggtttcttgagctctagcatgatggctggtgtcctccacctcttgtgcctccttgagaccacttaggccccgcgctgctgttgaggtaggaagcggggatggcggggagggcaacacagagagtgcgatggagagagagggacctgagtggaggcaaagcatgagtgcggcgagccgtacgaccgtggctgcaccaaagaggtagtcaacaagagacaagcgcatcggagcttgatagaggcgcccgacccctcaagcacatccgccgacgtaccacgggctcgtcgataccttctgctcctgctgctcgtggccactaggtccttcgtctatggggattgccaccgggttcatcgacatgatgcctccacttcttctcaggtgggatgatgaagagaggcgcacatgcggatggttgtgtccgcgaagaggtgctcgcccacatatggctgtgttgatggagagaggtgttcgcgcacgaatgatggtgctggcggaggggtgctcatatgtgggcagcgacgctggggaaaagcgtggtggcctagtggggagctaggggtatcccgttccactactcaaaacgggatgctgtcccctagcgttcccaaaagttaatggtcaaatagcgattttgcaattcatttagtacctgtttcatattactacttaccattacaaaggaggtatgagagcgatccaccatatgcatacctagtactcatgatgcttctttgagccgtcatatatgtttcttcttaaattctaacgtaggaattttgtattacacgtaatatgacatgcacatgcttaataaaatgctattgaaagtatacatgcttattattagtggacacctggatttaaaacttgatgagcggtattatgcactcatgctgcatgattccatcactattcactacactacctataacctacaagaatgactagcgcatagcgctccgtccgaacgggacattcagatgacacctctgtctccctaaccaaggttaggatatagatgaggataaagacggactcagctagcccaacgaatcaatgtgcatggctctcaaaaaaatccgcatgtagcaattaatggttgctctccacgttgagcgctcctccttgagtttgtaggtcgggacatgcatttgtagtgcttcatcaactatattattaccatccatgtaaaaaaactatattattaccacactattttagtagtactaactagtatcaggtgatacttgctagctattatctgatacctgataggtatcacctgatactggatattttattacctgtttcatattactacttaccattacaaaggaggtatgagagcgatccaccatatgcatacctagtactcatgatgcttctttgagccgtcatataattgctagctatatccaccatatgcttctttgagccaccatatccaccatattcttatcaggtgataattgctagctattttagtagtactaactaggatcaggtgatttctacccggtatcaggtgattactaccaagtatcatgtgatatttatgaggtatcaggtgatattacgagctatcatctgatacctgataggtatcacttgatattgggtaggtaccaggacatataataccttagagcaagtttaataggatagtcaactattggctccaaatcatctatagtcaatttaatagccaattcatacgatagttacctataaacatgtactacataattaatgtctggtcccacctgttatacacacatgtatcttggagtccgtgctgcagttggctacaaatttttagcccgctgctcttatctctcctcttttatcttcttaaaatatgtttatagctggcttatagtatgctattgtacctgctcttagagatattaggacctgataactaaccggcatcatcatcatgctaatattaggatttgatattagcattctcataataagaaaagcacaattcttaaagagatgaaccataaagattaaaaaattaccattagaaagtcccatgtcttctcactttaagtatggacatgtcttctcactttaagtatggacacgttatgttgatttgcttagctttaccatactgtgctgtcaccaactcaggtactggtgtagcctgcctcctcatatcacgtgcccatgagcacggctgcatcacaccttggttagctgcttgtgtccgtgtgtcgctaaaggtatgattatgtacaaaatgagaatgacttatgtttgtatcggaggaagcgatcatacgagacttcataaaactaggatcccatgtagacggtattctgtacaatagtttttctgtatatccatataacaagaaatggtagatctccctttttttgcaagataaaatcaaagaaactgtgtttttctttatatttttgcaaccactgaaccacaaaaatactagtagggcagataggtcgaaatatatcaaaacaaaactccaaggcatgattgttccaccggccccctcttttctgcttgtcatcacccgcctacggcctatacccccacccaccccaaaccccaaaagcccagataaaatcccaaggaaggcgaggagacgccgccatttttcacacccaacaactaatccatccccccctccacctccacgcggtcagcgctcgctcacgcgacacgcaccaacccctctccccgccgccgccgccgccaccaaacgccgcctccgaagaagaagaagaagcctccctcgcaggcagcagggtatttaatacgccgccctgctcgtctcggttcctgggaacttctcttctcctccgatttggcctgtcagtgcgctccgctccgctcgcgcctatccgcggattatcatgggatcgacggcgctcggtggcggggctcctgctcgcctcggcttggcccccaaggtgcgtcacccgctgcgcttccccttctcgctttctttcggctcgttcacgattactgaattggattggattggattgtgcgtctcttattagttggttcagttgtgccaaggaaattgtgtgtgtctctctctatgcttatccagcgagctgtgaacctgacgagttgtacctagctacttctagttagttgacaatcgtagcttaatttgcgtcatcacttcattcgacgaatcggctgttaactcccattatcgccccttttaccactgaataacacagaaaattatactgctagaaatgaatgatagaatcgagaatgtggcgaagctaacaagtgctgttgaaatgtaccactgttgaaatgttctgtaataaggcatcctataaaggggggggggggtcttgctgtatcttgcactgaagttggtcacaagcactgaattttcctttttcctgatgcacaggatggagtctttggatctaatctgaagcaatgcggtggtttcatgctcaaaacaacccctaaggtgaatttttttttcttctttgtcatattttgtgaataagattggttcgttatactcaaaatactaaaagaaatggtcttccctgcaggttggatcctcttcagtccgtgtgagggcatctgttgcttcttcaccgcagaaacagcactctcccaagacatcaggagttaaatcaggggaggaggtgcgcattgcggttctaggtgccagcggttatactggagctgaggttgctacactctttctcctattccggctcaccacttctttgatatggtcccatttcattgaagatttctatcctctttggttcgattgctaatgtgttcaaatacatttgcattggcagattgtcaggcttctagcaaaccatcctcaatttcgtatcaaagtgatgactgcagatagaaaagctggcgaacagtttggatctgtatttcctcacttaataacacaggtaagatctttttctcaatccttggtgcataggtaaatgttttggtggtacatacaattattgtgccataaatttttgctggtcaaaactgttggataatgttgatgctcttttttcatgcaggacctgccaaatttagttgcagtaaaagatgcagatttttcaaatgtggatgcagttttttgttgcttgccacatggtacaacccaggttgttcatcctcgacatgccttatctgaatttccttttgttatctgcttaattgtataaagaaacagttatacattctgtcatatgagtttaagattttagaaattcttttaagccatatctgattgtaattttttaccaggaaattattaaaggtttaccgcaggaactgaagattgttgatctctctgcagtatgctctataatctcatgaattttctacgtaggtatcatttctgattcttgacagtcaatcattcttatgggtgacttaccatgtttgtaggattttcgattgcgtgatatcaatgagtacgctgagtggtatggccattctcatagggcaccagaacttcaggttttcctcgactacttaaacctagaaacctttttaataactaccgctgattatgtaatcgtgctattccttgtatctttaagttcaatctcagcatggattataattatactgacatgctcaatcccctttttgtatgacaattttttggtgttttgatttggacacctgtattcatatcataatttcagttatttattttgtgtcattatgtttgtttatatgaacttatttcctatatggtttatttttctgtttatttagcaagaagctgtgtatggcttgactgaagttcttcgcaatgaaataaggaatgcacggcttgttgcaaatccgggatgttatcccacatctattcaacttcctcttgttcctctaataaaggtgggggactaattatcaatagttcttagttgtgcaaatctctgattctaattgcatcaataacttgtcaactctagaaataggagtcctcagttatgtcatgcagttacattgaatctacaaaaaatcctctaattttggttgcacggaagctatattgatcataattttaagcttgtgagccattcttacatccatagtatctatatttttccttagcagtttgcttaccgtgcaggcaaaactgatcaaagtgagcaacattatcattgatgcaaaatctggggttagtggggcaggtatgcattttgcatgagatactctgactattaagtaattatatatatatatatatatatatatatatatatatatatatatatatatatatgccatcattattagctgatatgctgtgtaacacatgtattttgtaggacgtggagctaaggaagccaatctctacaccgagatagctgaaggcattcatgcttatggaataaaaggccaccggcatggtaattttgtttttttctagattagctgaaatcaacattaattatgtgaccttatactgctctttaacagaattttattctcctgtgataaatgaatatactaataatagagtgtttgcttatatttatcttgttagttacctttaaggtagcctttctttattaacacaatgtgataaaaccatgccagttcctgagattgaacaaggactttcagaggctgctgagtctaaagtcactatcagctttactccanatctgatttgtatggtaagcacatttgcactcttgttgacttagtaattccaggctctgtagttccctctgtgctgtaccaggaatgtatagaagttgctaaatcaaatgactcatctgtatatttaacagaaacgtgggatgcaatctactatgttcgttgaaatggcacctggagtgactgccaatgatttgtatcagcatctcaagtctacatatgaggtttgttgtctgatcatgtgggttaaattaactatatgcatatttgacagaaccactgtattccactgaagtgaattcatcagggtttagattcttttttagagggaatatccatactcttgatatcaaaagtatttatttactttatttattctgcccacatgcattttcagggtgaagaatttgtgaaactgttaaatggtagcagcgttcctcacacacgccatgttgtgggatcaaattactgcttcatgaatgtctttgaggacagaattcctggacgtgccatcatcatatctgttgtaagtgtctttcatctacatgtttctcaagcatttagcaatctaatgtcatagacttcagatgcataatcctatttcttgttttcaacaatgcagatagataatcttgtgaagggagcatcaggtcaggctgttcagaaccttaatctgatgatgggtctgccagagaacactgggctgcaatatcaacccctatttccttgatcctctatgtctgtgttccgtatgttctttgtcgggatgatactttggagttcagctacccatttccctctgtttactgttgagacaaggtgctcaacatcagagtgtaaccaagacaaattttctcaaagagtagcttggtttgtgctgttgtagtttttatagagataaatgacaatttagtagtttaatgagaatattagctcggtggatttgggcattgaaatcctacgggtatatcctgtactgctttgtggttatgaaatcaaataaaagtgtaaacctcagtcaagaggcatcaatcaccccgccttcattggatgtagatagggatatatattcatatttttactcgatggaatttgttttgcttgctaatgctttatgatgattgaagcattccttagtttaaatgtttctgagaagtgctcacatcctaaaccttgctgcaataattcaaccaacaagttatagtgaattgtattttctaggctataaaaataccattacctttgtttgggtcagctttgaatttctcttgttaggtctcaatttttgaaatgctttattaaagccctaatgatgtaaatgggcccttgcggtaattttctcacctgactccaaatgacaaaactagcattttgaactgggttactatgagtttcagtttaggtatttgtttcccatttcatatttactactatttttttattttgtgaacgttgcacatctcagcaaaactttctttctggttatactgatagtacataacctacctctgagttctgcccaaaatatcaatgtggtacatatattgccaggaggctgtaataagcagccaaagttgcacatggtgctacggttggtaagcgctagatatcttagaaacaattccagaaatctgatctggcaagcatgagcataatttgtggtccttaggtagcattcctcaaggaggtcctcacttgtatttctttgttggagaccttgttattggatatagttaggggggtgtatcttgcagatttttccagttaaaatcaattgttgatactttctttctggttatactaatggaagatgccatgtaccatttgacttgaacttgctagatgctaggaaatgcttttgcaacaatgtcagcctttgaccttcagttgtttatgtattatctctgacttctagttcatttctagttcttaaatatttcttttgtttagtttgaccacttgcataaatttaaagtaagatatatgttcgtctgtttctattcagctaatctgggggtatttttggtagtgctatactgtaggtgggccaattgagcatatggatggaaaatgccatttaactgttgatgcatcctactttttcacatgaatacatgattgtattacctttatgataaaaaaggctgattcacctgctgttatgttctttcattttcatgataatgacataaatgtaggcatttgggtattgtgttttctgcagcaggagatgctactggatttttttttcatagctcacgaatcatgatgggagtttgggaggcatgctgctcttacttttattttttatttaagtttgttatcgttttagcttaccctatttgctgcagtagtaagtttcctgtattgttgtcgcaaatgtgtaattgcaaacttgttaaatcagtagtagcaatttgcatgttcagagtaccttgttcaccatttcatgttattgttttgtatatatggttacacaagttagtaatgaaaactttccacatatcaaaatcttaaatgcttgtctaactagttgatgagaagcctggcaatggaaataaaattcagaaaaaagtaaaagtatgtttgtgccataaatattcatgctatagttttgaaatatgtttgatgagaaaaattagttactgaccattctattatattgacatttctgttgaagtcaacctataatttttctgatattttctgatatcaaatcaggcttgcaattcatt

SEQ ID NO: 58393 - DNA, 50103 bp, Oryza sativa
catatccgggtttccgattccgatttcgattcaaaaaaaatatatgaaaacgaatatgatagagctagtttccaaccgtattcgatccgttttcatccctactagcaggccctggctaaccacactttggtgctttgagtgcagttttttagcctctgtaataacattttgcacaatgataaacctaaagtctatgccagttttgtatctgccatgaactaggtactgcagtttaagtgcttgtgcatatatattccccaggttatgtcagaatttcactgttgtaaactagttaattcattgggtctatgtctccaggacatgcttggcagagttatggggatattgtagccttaggctgtgtttgaggggaggagatataggagattgggaagatacgcaaaacgagatgagccattaacacatgattaattgactattaagtattttaaactttaaaaatggattaatatgattttttaaagcaactttcctatataatttttttgcaaaaaacgcaccgtttagtagttcgggaagcgtgcgcgtggaaaacgaagcaaaactcactcacaatcacccagatcacccaggaaagaacacagccttaattatttcgaaagctgcataccaagttgggatggtttttgatcttccacagaactttctcataaatcaatcgggttattaggacaaaaccctacgattcattttcagatgtttttttttacgtgtatacaggatcgagcactacaccaactgatcatttgtactttgataagaaaaaacatgataaatcccggagggattcatttgctatctttgccatagtcaagtctgtagtacatcttttcttgtgctggtgtgatgtaaaaatccatatcagtctagcacgatttatctggttcgatttcgagctgtgaagattgtccagacgttctagtcatatcttaataataccgagacgccaccttcataaaacacacaccataaataatattgggtttaatttgcctcacttctatattgcaccattgtctgtaatcgatctactccatcccacactcatgtgcaatacacaatctacgagatcccactcaccggcaaacaccgacgattgggagagcatttctcttaaactctctacttcaaagtcctgcactaggaaaaggatattgggaaaaaattaatatacttttaatgttaaatagggatccactaaaacaaacgataaaatctactaagacagacgtaaaacattaggtcgaactcttcttcggtgtaaagaaagtagttgtgtatagtcatcactgcaagcgaataaggtgtttgggaagtgctacgtgtggcttcccgctgtatattcacggtgacatgccttcatcatttctcggttgtgacaagtcatcgtcaacattttgtagcatgcgtggtcaaagcggcacccttaattatattccgtacatttgatttattcatgtgcgattttatctctaggttatgtgcatgagatggttttgctagtttacatgtttgatatcaacatttatatgttaaaatcaattaagcccacatatgcttatattttcttccacttatacagcctatatatatgatctattcatacattgcagttttctcatccttactacttcctccgttttatattataagactttctagcattgcccacattcatatatatgttaatgaatctagacatatatgtgtgcctatattcattaacatctatataaatgtgggctatactagaaagtgttataatctgaaagggaggtagtattatatatatgtactctctctaggactgggagacatgaggaaccctggatatacatatgttatcctttggttgtgttcttaccttcaagttcccaacccctctccctcgttttccgcgcgcacgcttttcaaactgctaaacggtgtgttttttttgtaaaatgtttctatatgaaagttgcttaaaaaatcaaattaatccatttttttaaaaaaatagctaatacttaattaatcatacaataatacatgcttcgtttcgcgtgccggggaggaggggttcctcccgaaagccacctttggctcagctattatggaggcagcagtcgtaaggacaagtgcagctcccctgctgctgttgctatcaggctgtgttatggtacttcgtgcccttgtacagctccaagtacccaatccggtttgcatagcccgagtccactagatagtacttccctgcagcggtaaacacctgtacgttacacgtgatggaggttagaaattgcaaacatagaataggtagcagtgtacctggaggtggatgagggaaaacatgattgtatgtactcattgcatcgttgaacaccctcatgtcatgcacaaaacccggccatccagcaagcacgaatgtaaatatcatgtcaaagtcacaacatgccatgacattctgcgttgtaatgtggtgtcgacatatgtgctgaaccaaatgatctttggaaacctgcataggaatgtgggttccatctatcgccccaatacagtcgttgaaataaggatagaacctaaggtacctcagtctcgaatgcaatgttgcaaactgtgggtcacgtggtttaattatatcagcagctagcttcaaaaggcttgccagaactttgtggaacatattgtgaactgttgctaatgatcgctcaaatctgtcctcaacttgcctaaccgactgtggagccccagccatccaaagaaacaatcctaacgcctcaatacttttagatttcatgctagacttgagctcaaatttgtcgaccaatagatcatgaagactatagaacatatcagaggtcattctaaacatgttgtaacaccgcttcctgtctgcatgcttcttctctacccattccaacgcactcattgttgtgctaacatctctatattctgactggttgtagtacttgtcaatgtgttttgcaagatgtaacgtaccgtacagaaacgcggtggatgcataatcgtccataaagtactccatcataactctgccgaactctttgtcggaatcttcatcctttgtatccacaggttggagccgcacatcctcctgtaataaaagtaaaataacaacggtaactttcaaacatcctcatattaagaaatgaatttggaaagacagccttactacaacttatatttaattgccaacattacgcatgacatagtttgcaacacaacagtagccaacataccataaatgacatagctaacagacatagcagcactaacagacatagcacctcatagcttccaaagcgtacataacccaaaagatataactaaggctgatacattaacatgttaagcaagcattaaaaggtctagttgtcgacccgtgcgaggtgctcaaggagggcctttcttccttcaggattggacagctcaaagacattgacggcatctcgatccttgagcatcttgaacatggcaacccacaagtgtggagtcgcctctgtgacccagcactccctactgagtgccatgatgcgctcagccttttcccccgcgcgagagtcatcatcatccctcctcttctcacgctgtgccgaatagctgtccattgctatcgctttctccttctgcagctcgtgtgcaccttcaattcgttcaccacggcgcggacggctgggctcttcaacttcttgcttggactagtagccctactctgcgtgcttggtgtgctcctcatgctgtgcgacctcttcgtcccaacactgatggggcttagggggtcgaagtcgtcatcgtcggattcttcgtcatcctcgctgtcctccacatccacaatggggttggccggctgggttgcgggctatgtaggaacaaatgaagtcgatccgttgacagccacccccatgaatatgcggtccatttcttcgagatagtcgggcatcccattcttcaacttcctaaattcagggtggtcctgcacaaaatgaatgcatcggtcagatgcataggaatgatcatgtgtaaaactgcgcaacgaaaaagtgaagtttttgtaccttagtgttgtcatcccaccacttgtctgaagcaaccatggtgccgtcaggtcttcggcccaaaccagtgtctgtacgcaacctcaatatgaaggtccacatatttttcaaacccctgtatctaaatccgaattgctcattgtcgtggaccaaatcagtggtggcataaaaaccctttctgatctccttccaacctgctttactcattcttccccttatgcagttgccattatctatttgcttgcaatacagctcgcaaaaaagtttggtgttctcatttgtccacgatgccctgtcgttgaaatcctagagggacaagtaaaccgggaaagcaatgaccttgcgacatatcaatcaatcggaattaaacaccgttatcacaatgaactcggcgctcactatgtcatgttattgcacaaaattgtaccacaatttttgtaatagctgtattactaaccaactaacataagagctgtaagcagtaatacatagaaattaaccatacgaactaactgtagctgtaatacatttcgcaagtattgtactagctgtacttgacaagttacaacaactgtagtacgtagcaactaatcagatgaaccacttgttaacctcaaatgaaatgggaatccacacattgcaacacctaaaaacgtccttacctctgtcagccggcaccgtgcaccgcgacccctacctcggcctcgaccctgagatgcggctcgagcttgaggctggatgggaggcacgaatacgcctccatggcctgaacctccaaatggcggtgccattggcgcttggaacccagctccaatcgcatgcggcccgtcaactcctgccgccgacatccgaccgccccgtcgcggcccagatccggaagctccttgagcacttggccggcccctcaacccgagcgtgcgatgcacggtacggggagggacgcctacgctaggagggcattgactgccatccccttcgccactgcgaagaaggtcttggtagccgtgcatggtcgaccacttgtcgccgtagttgaggtcgagagccccgaagttgaaccgggagggttctggctgctggaagaaccctcgccaaagccactcgagttgtaggacgtgcggccgccatcacgggagagatggagaggctgcgcgaggaagtcgtgcgtagggatgctggcgccgaatcgatgctcggccccgtaaaggaggatggtgctcccgccgccgtatccgccaaggttgttgccgtcattggcgtctccgtagccgtggccgctgtcgccgttgccgtacccgccgccatcatggctgtcgccgtagtcgcccccgttgttgctgtcgccctcgtacaaatccattgcacgctcccgtcgattccgctgcacgcaccgccacggatgtgatggatctggacgaggaacccttcgattcacccagggtagggttggattacagcggcggggaggacagatgcgacgccgatgagttcgagagagagtggacgcaggggagaagaaccttagggttagcgcgtgtgaagaggcgatggggaatggataggatcggcgggttcggcgcctcccaggggtataatgggccaccctaaccctaggctactgttgggccttaaatgtgcaatatggccgaatttcaggtgactacccgtttagttctaaagtccagactgcaccccttgtaccgagttttttggcactttggccctatctaaacacggcctcaatgtagcacgaggaagcaagagaggctcgagaaactaggttctagttatttgctggcatgtgctttgatgtgtccatcggaagccattgatgcttttccactatgaaggattctggttcatcgagggactgaatgtattcctttttttttcttatagcacattaggaatatgggacaattgatcgattgaacacttcattctccgcggtttcttttgtttgaaatcacaagtttctccatctacaaatgaaagagacataggttttgtagatatgcaggatttaatttgcaacatcagctcaatcatgtagacagggcatgatttcctcatatggcatgatgactacctgtgtacaaattgttagagtacatatatatggtacttagaaatgtattaggatagtattgatttgtgtaatttttttcttatatgtaatcttttcttatctctaccacgtatattttgtatatatcggtccctgagcttaatacgtacatgtgtaatatttcgtagtatttttctccgtttactattctacacaaatatattatttccataggccttttgttagatgtcatttagcgaactgtctcttgaaacgtcatttagccgtgtgtaagagggcttttacagggcatcgaagaaagtcttcaatgattttcgtggcagtgacagtccgaatcgcacaagaccagaggagctttgctctgctagttttcttttgttgcacacggctattttcgactcgacacctctgattcatggcagcgttcgtgctgcatacagttcgctcaagcgtcttgcctccttttctatcatgtggttacttttccagatgaatacagagacatttagagaccataggaaaaggtacgaattacccccccccccgaatctcaaaaccggacaaattacccccttggctcaacccagagtggttttgctcctacgtggcacatacatggcgccacgtggcaatccaataaataaaatattaaaaagctgtgggcccacttgtcatgtactcctacctcacccctctctctcttctctctctcatcagctagggggcacgacgggcgtgccgggagggcgagcggcgatggcgaacgcgaagcacggtgtcggcgaccgcgtccgtggcggcgacgcgtgagtcgcgcgagatggagcttttgcaggaggtggatggctgcagtgtggtggtggtggtggcccaggcagagaaggcagcaacggcggtggagtgcgggtggcggtgaggggagggagagacggggagcgacggcgagggagggggtggcgcgagcttgtaggggcaacagcagcggacgacgacgacgagacaaccttccccgccgagccgaggtcgtcctcgggcaccgccggggtgccgtgctcgccgagagaggggaagaggagagagaggtgcgggaggacctccgccgcctgccgcggtcgattccttcacgtgagcttcatcatgggccacgccgcacgccctgaacgccccctccacgcccaccgccggcctcggggtccgctctcccgactgcgctacggagagacagagagaggggggaggccacttgccgtagtcgccgtcgtgggccacgccgcgttccatcaccgcctccacaacgcccgccgccggcctggggtccgctctcccgatggtgccagagagaaagaggggaagagccttgcctggcgccctgccgcagttgccgccgctcgccatagtcaccacagctggacagacgacggcggcgccaccctgcttagctcgcgggatggaggatcggcgtagcttgctcagcccaccgccagcctcgcctcctggcccgcccgccggcctcggtctctacgcccgcccgcctccggcctcggatcctcgcccgccgcctgtagccatccccgccgccggccgccagtcggtgtccgctcctcgcccacccgccactcgcagtcacctccgtgcccgtctgccgcctgcagccgcctccgcgcctgtctgctgcccgcagccatcccctccgccggccgccagtcggcgtcggcctccgtgcccgcctgcctctggcctcggctcatcacccgtccgccgcccgcggccatccccgccgctggccgcccatcggcgtcggctcctcacccgctcgccgcccgccagccgcaagatctgtcaaccgagagagaggagtgaaaaaaaacgctaaaaggtgggccccacctgtttttatttgtttttgctgactgtatcgccacgtgtgtgccacgtaggctgaaaaccgcttcaaatcgagttaggggggtaatttattcggttttaagtgtttggggtgttaaatgtccggtattatagtttcgggggataaatcgtactaccgcaatagatcagggggtaattcgtactttttccaattaccatatgtttgatgcatcgatgcaggctgatcgtgcatgcatgtttaatttcttacatgcctgtggttgatcatcaggataccaagtctccgaccacaacgtgttctttatgggaaaactgataaacaaatttcatcacttcagttaaacggaagaaactggatatataaatatggatgtctatgcctgattctggaagccatacagatatacagacaaaaacatctcgagcgagcacctgacaggcatgcacagaacctcccaaatggtatactattggtgcctagaccgatctctgcacgctcttgtaaccacagatcaatctgtagcccgaggtattgtgccgccgactcctgcaaccattggatcgatggtgcaccattcaatctactattcaatatttaatatactaactaagtcacttgggcatagttttagatcttggacccacagtaaatttaaaatttttacgttaaattatagcggtgcaaagttttaaattttatctaaatcgggaattaaatgatttatctaaatgttatcaacgtaatcgtagatctagattcattgatttgtaaagctagaaatacccatctctaataaatcttaatttgatccaaaaatgtaccaaaaagatctaagtacattgtcagatttatacaaacgtattggtattgagttgcacatttgcataatataatttagttggatttctcaccacacaacgcaacttactattgctttcatgatatgccacgttgataaggtaaggatcctgctgcattatagggactatagctagtctagagattccgtgaacgaggtggaaacaaacaagcacacagattcacaatattgacagaaaggtattggaaaaatacttgcggcaatctattcgtcaagcgaataaatttttcatagatattaataaataatgttgaaaaaatgctcgtggcaatctattcgtcaactcgttttccacattggagtatgccgtgggaaaacttgattcaaaaccacctaaaaatgtccgcatgtgattaaatgtccggatttaaccgatgaggtgtgtgttgtcttttttttttcatagttgagggcggtataaatcatattaattttttcctatagtagatatggaaaatctagttattaaccctatacaaagctgtgttgtttcacattttatacaagtttaggctatatgtattgtaactatagtcggttaattaagaaacaagaaaaatcgcataatttgatttggttactttacaatgaggaggtacccttctattgtttgaaaaattcctaagagggtaaaacaaatatctaataaataaacccattcaaacaaagatccgttactctcttacgtttcgagacgtatcttggtcgttttttgttgcgttgttatcatctttcgttgtgatttatgaacagcttctgccagaaaccagagttgctggcttctagaatagcaaaggcagcggcacgcgcggaccaagccagcgattgattggagacccttcccccccccccccccccccccggcgcgcgcgcgcatgtgctgacaattaagcgtcaaaatgaacgtgtgcgttggtgtgtgcgtggacaaatacctaactatcactgtgaattcagccagattggtgcgttatcgcacgcccaagttgcccaagttgccgagatcgatttggaacttgatcaaatccaaaacgaaaagtaggagatcgatgccgcagtgcagcccaaaactacgtacgctaggctacgtcctatatatatattcacctgctttaatttgcatcgatcccaacttaaactgagtgacgccgcgccaatatgcagccgcgctgtacgctcatccacgccgtcgccgtcgtcgcggcggcggcggcggccgcgctgctgcttcctccgctcgccgccggccagccgtggccgacgtgcgacaccagcgccggcacgtacaaggccgggagcgcctacgagtccaacctccgtgacctcgccgccgcgctccgcgcgggcgccgccgcctcgccgtcggcgctcttcgccacgggcatccgcggcggcgcgcccgacgccgtctacggcctcctcctctgccgcggcgacctcagcgtctccgactgcttcgactgcggcacccgcgtcctcgccgacgtcggccgcgtctgcggcggccgccacggccgcgccaaggacgtggccctcgtgtacaaccagtgctacgcccgattctccaacaagggcgacttcctcgccgccaccgacaacgccggcggcgagacgctgctcatcagcggcaccaacatcaccggaggcgccggcgtcgtggcggcgtacgaccgcgcggtgaccgagctgctcgcggccaccgtgcggtacgcggtggaggagaacccggcgaggctgttcgccacggggcagcgcgtgggggacgacgcccgcgacccggggttccgcaacatctactccatggcgcagtgctcgccggacctgccgccggcgtcgtgccgcaggtgcctcgacggcgtcttggcgcggtggtggcaggtgttcccgctcaacggcgagggcgcgagggtcgccggcgcgaggtgctacctgaggtctgagctgggcgtcggcccgttctacaccggagctcccatggtggtgctgcgggcggacaaggtctagccagcgtcgtcgccattggcacccgatggaagctgcggtagctacagcctacagttctacgcaccaaaatggtggaggtgcaccctacctatggccgacaaagtgcaagcaaatctctacacgtatacctatactattattaggacattccgacaaaatgtccacgttcacccgagaaattttagtgaataaatctggacatcgatccagttaaaaccaaatttacaacggttcaataactaaaataattgatatgcagctcttcgccaacttcaggtagaggttcacaaataaaattcagtagttgtgggagctttatcttgtgttggtgtgtattagtttgtgcttacttaatattttgttggtgcgcttctaaactcactgtgtaagattgcttttgtgtgaattctgtaataattggatatagctcattaagcaaaaatcgagatgttttattccatcacctataaaaaagctaaaataatcgacaaagctttcagttagacgtccaatcaaatagaaaagatagggcatcatattacctatgtctaagctacatggccgctatatgtgcatgcagtagcctatcttcctactcactagcattctcctcccttccgatgtcttttctacgtttttaaaatagcttgacatgagttttcttttaaattatttatattcaatttacaatccgattatatcttgaatttattgttattaaatatgtaaaaaaagatatcacataattatattcttatgaaagatatgtaaacttatgttttaaccatgaaaattcatgttcatacgcgatactgaaatgtttcaacatatgtttcacataatctttcagtatttcaatcactattttttttcaatgtttcacccgtggacaacttaaacatttcacccccccacaaaatttttttttatggaaattaggtgcctggtatcaatttcatgttggtacttcctcccgttccgtaatccttgatgttttggataagattgagatcaacaattaaaactttaactatcaatactccattcatttcacaatgtaagtcattctaacatttcccacattcatattgatgttaatgaatctagacatatatatctatctagattcattaacatcaatatgaatgtgagaaatactagaataaattacattgtaaaacggaggaagtaacttttaaaatatctagtttgaagaaactacaacattatgcatagattaattttgaaacatgcattaataaatttaaataatataataaaaatatagttaaaaatatgttctcgagaccgtattattatccaacacgtcaagaaatataatagaactgaggggagaatttagtcagatggtttatttatacgaaattatcattaaaaatgcttcctatcggtctgctgataaagccaacaggttgtgcctccatcttgcgcttgcactttctgcatccggcgcacctcgtttctctctctagctgcatgcgtcatctcttagacggatagtctgtctactctctctatctccttgagcatgcagtggctgtctgcattcatgcatgtgctgcattagtaactttaaacgattttacgtgtcagatgcaaatgtttccactcatatttgactttacttatcgattttatgaattctttccatggatttatcactgggctcaatgtttcatgtcacggttgttggtgttgcagtttgtagtttttaaacattccatttctctgaagcgtttcactaagtggtgaaacaacatttggttctttttcgaaataaacaagatgcccaagccatagtctcatctaattattacatattaaaaaaatttccattccacacctatggcaacagttaaatattttgtccctaaacttcaaattttcctcctctctctataccagacacattccatcattccactcatttgaatgaacttttagccatggatacatgactcaacatgttgacgaggcctggcacatttgttgagcacttgagctctctactatggttttgctctttctatctctctcccctgcacacgagagatgttaatagttgtgcattgtcttgtcagcatgctaactcatctgttcatacagtgaagagtttcatgtttagagatatgagtattaatgttttgacccattgttgtagttgagcgacagaaaatagctagttcattgtaatagttgggaggtacgaaggctacacttttcttcattataaaacaattataaaaacatgtgatgtgcttccttcatgtgaataaaggagtcacgcattaaacatgtataatgcatccaaacaggtgtgcacaaaaactaggtatataattattgaggtttctcttacctccttggaaaggtacctcctcactattcaaggggaaaaagaaagaaaatcggtggaactgattgaaagaacagtatacaattggtaaggttggactttttttttccatgggacttgggaggtatatagaggcatatatacctcacaatgttagtcatgaggtatatgcctccatatatataccattgaaataatacatttacctatgactctaaaaaacttctcaaccctattccaacctctaagattagttttggtacctctcttcatgaagggcatatctatatatataaggaggaatacaactcttcaagggtggtagatttttaggtcatgttatgatatgccatatgtgctatgatttgtactttgaggcaagccatacagtacttcttcccaattgatcatacggtaggtagttattaagagatgttcactttgaagtgtacaagacacagccgtgcatacaagtataaaccatacatgtgtcttgctaccaaaatagaaacaattcagacaacatcgccatttctgattcactcattatatatattgtcatattgcagtctgcttctacataatctacatatacatttggactgggaggtcttgaaaattgtctctctccatctaggaaaagcgaaagcttttgctgtcatgcagcctcttattaagagatcttccgaaggttggcaatattgtgaaagctaatctcttcagaggagcgatcgacgttttaatgggatgacacaatttggaaaagtataaatgttagttagtgcttgtgtgtttttttaaaccaaatgcatgtaactcccacataatttattaatgaataagtcctacataatttattaatgaataagcccgtctggcctcctgaactgtcaagagactagtgcactgtttactatattgactatgttaaacaaatttctttgctatccgtagttgtttgtgttcatgcaaaaaattaaatgcaacttttttatcgtctttgcctctggatcatcctacatcaattcagtttttctatatttccgtacgttcaacattatgtacataattaaagtggctttagctcaggatgacacaacaaccctgtcagactgtgctgagggtgatgttgggtttagtcccacatcggtaattgatgatggggagcacgacttaaaaggtgagagacgcggtacccacctatcatactagttttttaggttgcttaggtccagaacctaaagttgtggctttgattgggtctgtggtggagcaggtccaatgtcacatgggtggcccaagattggtgggccaggctgcgcactctaacaggtaaccttgtatgtatatcaaactactagctaaatacccatgcgttgcaacgagggggctcatattatttgtcatcatttttacctcatttaaacaaatcccctgttggaataaatattgaattaaggaaaggacaaaaaaatccttctaccttatcattcactggtggagaaaccatcttttgtcggtcggccgaatttcacaatagtcccggttgcaataaaaaccgggactaaagataacgggcatatttaatctttagtcccggttcaaatgctgtcagtgcttgtcaggccccccgggatctttagtcccggttagtgttaccaactgggactaaagatcccggtgatctttagtaccggttggtaacaccaaccgggactaaagtcccacccctttatatatgtcttcttcctcctccagcccgagcaagcttcaaaatttcttcaaaatttcttcaaaaaagaggggaggtcatgccaaaatttatagtgaatttactttggtgattatatacaaatcggaggtgcctaaaaggttagcaacttcatcctccaatgtttttttggtcatattacatttggagctatgttttgcacacttttttatctccaaaattttgttgtaagttgatgagagagaaaatttgtgtgggaaaagaaagaatatatagaaattttgtttatttgctaaataaggttttataaaatagttgagtaggaaaatatagagaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgttattattgtacgaatgattatttgtgtacgatttttttttcatttcatgtagatggatcgtcaatggatgtacgctgaccggcggtccaaagagtttattgacggcgtgcattattttttgagagtggccgaagctaacaagtagaatggttttatttgttgtccatgcaataagtgtaagaatcagaaggagtattctgcatccaggactattcatttccacttgtttgagtcggggttcatgccaagctataattgttggacattccacggagagcaaggggttgaaatggaagaagatgaagtggaagacgacaatattccagactttgctcagtacgctggatttgaaggaaatcaaacgggcgaggaggaaagagatgctgattataacgatgttgcggatgatcttggtcagatgttgcaggatgccaaggaggactgcgaaagtgtaaagggggcccataaattggacaagatgttagaggaccacagaacgtcgttgtacccaggttgtgagcaggggcacaaaaaattggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctaggactggaagttcagaagattcacgcatgtccgaatgattgtatcctatatcgcggtaaggagtacgagaacctagaagcatgccctgtttgtaaagcactacgatacaagattagacgagatgatccaggtgaggttgacgggcagctaacgaagaagagaattcctgctaaggtgatgtggtatttccctataataccacggctaaggcgtttgtttaggaacaaggggaatgctagaatgatgctttgtcacgctgaagaacgtcaacaggacgggatgctgagacaccccgcagatggttcgcagtggcgaaacatcgagagaaaatttaaagactttggaaaggacgcacgaaacatactgtttggtttaagtacggatggcatgagtccttttggagagatgagcagcggccatagcacttggcccgttacgatgtgtatctacaacctccccccttggctatgcatgaagaggaagtacataatgatgccgattattattcaaggccccaagcaacctggtaacgacatcgatgtgttcctaagaccactggtcgaagatcttaaactgttgtggaagaaggaaggtgtccccgtgtgggacgaggacaaacaggaggagtttaacctacgagcgctgctgttcgtaaccatcaacgattggcctgcacttagcaacctatccgggcagtcaaacaaggggtacaaggcttacactcactgtatggatgaaacagaaagtacgcttaagcactgtcggaaggttgtgtacatgggtcatcgttgattccttgcagcaaacaatccagtacggaagaaaggaaagcactttgaacatacggcggaccaccgtacgaagccaaaacatcgtagcgggaaaacagtgtttgctacggtgaaaggtcttaaagtagtgtttggaaaggggcctggtagccagcctatagagtgcgaagatggtcacgtggcgatgtggaaaaaaaaaactccatattttgggagttaccctattgggaattcttggacgtccgccacgcaatcgacgtgatgcaccttactaagaacctttgcgtaaaccttcttggcttcctaggtgtatatggaaagtcgaaacatacactggaagcacgtaatgatctgaagcatatagaacaacgtggcgaccttcacccggaaccaaaggagaaaggcagccattacttgagtccagccagctacactcttagcaaggcagagaaggaaagtatgtttcaatgcttggagagtatcaaggtaccatctggatactccacgaatataaagcgaataataagcatgaaggagaagaagttcacaaacctaaagtctcatgactgtcacgtgttgatgatacagctgctaccagttataataaggggtatcctcccagacaatgtccgggcaacaataacaaagctatgttctttcatgaacacaatttcgcagaaggtcatcgatccggataggttagaagcccttcagaatgatgtggtgcaatgtcttgtcaggtttgagttgatatttccaccttcatttttcaatataatgacgcatctgctttgtcacctagtgaaagagatcggtattctcgggcctgtgttcctacacaacatgtttcctttcgagaggtacatgggcgttctgaagaagtatgtttgtaaccgtgctcgtccagaggcaagcatcgctaagggggtatggaacagaggaggtcattgaattttgcgtagaatttattgaagaccttcgcccaatcgagttacctgaattacgccatgaagagagactacggggaatggggactctcgaaaggaaagcaataatgacggtagacaacaatttattccgtaaagcccatttcacggttttacaacaatcttcattggtggctccttacatcaaggagcacttggctctagttcgcaccagaaacatcggtaagtccgatgcatggattacacggcatcacattgatactttccccgcatggctgtgacaacatctcatgggtaacgagacgattaaccagcaactggccttcctggcgaggggtccatctggctcgatcgcaacattccaaggatatgagatcaatgggtacacattctatacaagagcccaagacatgaagagcacgaaccagaacagtgctgttcgtatcgatgccatgggacacgatggtacaactggcacgtattacggtgccatcgaggagatatgggaacttgactatggacctctcaaggtccctctgttccggtgtcaatgggttaggttgactggtggaggtgttataattgatgacagtgggatgacaacggttgaccttaacaaggttggatactcggacgaaccttttgtccttgccaatgatgtaacgcaagtttttaacgtgaaggacatgtctagcaaaggaaagaagggcaaagggcctgacgagccgatgcgcaacgtggttctcccaggcaaaagaaaaatcgtcggagtagaggacaagactgacgaggattacgatcagtttgatgggcaacgccctttcacggtgacgattgaccctagcatcctcctagcaaatgaagacaccccttactcacgtagcgatcacaaggaaggaacaatagtgaggagaaagtacgtgcggacaaccgtcaccgccgatgtattgccgtaaatgttgtaaactattttggatgtattgaatatgctagttatatatgatgattaacaaatttaaatcatgcatatgctaggtacatataattattagaatttttaaaagttttaaatcatgcatgtggtatttacatatgttaattacaatttttaacaatttaatataatgcatatgctaattatatatgattattagaatttttaaaagttttaaatcatgcatgtgggatttacatatgttaattacaatttttaacaatttaatatcatgcatatgctaattatatacgattattagaatttttaaaagttttaaatcaagcatgtgggatttacatatgtttattagaactttaacaatttaatttcttgcatatgataaataaatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgtttattagaatttttaacaatttaatatcatgcatatgctaattttatatgattattagaatttttagtaattttaaattatgcatgtgggatttacatatgttaattagaatttttaacaatttaatatcatgcatatgctaatgatatatgattattagaatttttaaaagttttaaatcatgcatgtgggatttacatatgttaattagaatttttaatgcattatttactattttagaaacacatattcaacgaaattcaatattcagtgctattatctttagtcccggttcttaaccctaaccgggtttaaaaaagaatttggaaatagcgggaaaatatctttactcccggttggtgagaacaaccgggagtaaagatatctttactcccggttggtaacaacaaccggaattaaagatagatttctaatcccagttgttgttatgaaccgggagtaaggttgttctcatcaaccggaagtaaagatctggggggtatatatattcccggtgcgccctcgtcttctccaccaacacttagacgtttttccatcgagatcgagcatcggcttctccttcgccgccactgcttagggcaaccccgcgccgacgccggcgtcgtctctcaccgttgcctggcggtcctcgccgcctccgccgcagacgccgccgccgcctctcttgggtgagagcccccaccctctctctctcgatgtagctctctctctctccaaaccgccgccgcgtgcctagctatagcttgttgccgacgccactacgccacgccacggtcaaccgccactgccgacgaacgacttcggcgtggccgccaccgccggcgacgctgacgccactgccacgccgccgcccctgtctcgagatcatgccgccgccgcgcccccacgccgcgggcccccacgccgccggaccgcgcccccaccgttgcgagatgccaccgccgcgagacgccgccgccgccgccacgctgccgctgcgcccccacgccgccgggccggccctcggcaccggaccgcgcccccaccgccgtgagacgccgccgccgcgaacgaacgcttaacgaacgtgaacgaacgcgaacgaacgcttaacgaacgtgaccgaacgcgaacgaacgcgaacgaacacttaacgaacgcgaacgaacgtgaacgaacgtgaacaaacgcgaacgaatgcttaaagaacgtgaacgaacgtgaacaaacgcgaacgaacgcaaacaaacgcttaacgaacgtgaacgaacgcgaacgaacgtgaacgaaatgttaaagaaatgttaacgaacgtgaacgaaacgttaacgaacgcgaacgaacgtgaacgaaacattaaggaacgcaaacgaacgtgaacgaaacgcttacgaaagtgaatgcacttgtactaaaagtgtgagaacgaacgcgagcaaaacgtgtacgaacgagataattaaacgattattaaacttagcatacatatatgattatatatataggttaaaacgtgaaatacaataaatgtaacttggccctgtttagactaatatattttcctagtaatgttgtagagaagacgtcgttgtcgtccctcaagccgaagtggtagctagccatcgaaggaattcgcgcaggcaagtgttgtaaagaagtgattgttagagatttaatataagattattagagttttaatataagattattagattattagaattttaatataagattattatattattagagatttaatataagattgttagacttagcatatatgattattacaattttgatataagattattagagtttgaatataagattgttagacttagcatatatgattattacaattttaatctaagattattagagtttgaatataagattgttagacttagcatatatgattattacaattttaatataagattagtagcgatttaatataagactgttagacttagcatatatgattattacaattttaatataagattattagagatttaatataagattgttagaggtttaatatacggaacttaattagacttagcatatgtgagtgtcagagattgttagagatttaatataagattattagaggtttaatatacggaacttaattagacttagcatatttgattgttagagattgttagagatttaatataagattattagagatgtaatattcgaaacttaattagacttagcatatatgattatctagggttctaatacacgacacttagacttagcatatatgattatttgagttttaatacaagattaattagtagagttttaatattacgcttagcaaatatttcttctatgaacagatggctgatcgcgatgaggaacagatactgtatgatacaatcgcagagggaagcagccaatactggaacgaagaagaggggaacgaggatccaaaccagtacttgaacgaggagcggaacgtggagagggatgcagaggggaacgaggaggggaacaaggaggggaacgtggagagggatgcggaggggaacgaggaggaggccagtggaagtcatccctccgctggacagaagagggcacgcggacaacgaggtgccacgaagaagataaagggtcggcacatcataactgaggtggacgaagacggccgacctagtgccccggcagaagcagccaagaattttgtacaccacatcggttgggttgtgagggataacgtgcctgtcagcaaggtgtactggcgcaaaacaagggcacgcggggatgatgacagctttgtcccggaatcagagaaagagatgctgtggactacaatgctcgagacgttcacgctccctgcgggtacggagaacatagtgaaacagtggactcttaagaaaatggcagaacagttccagactgtcacgtcctgataaattcatcccgaaataaaaatcatcttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggtttataaaaagaaaaatccctaaaaagtctttttcccccctttttccttcttgggccggctcggcccattccctccctctctctctcttcccccgcggcccatcggctctctccccgcgcgcgcgccgctgacgggcgggcccgcccgccgccctcgctgacgggtgggtcccgcctgtcatctccctcctcgcgccgcgccgccgcccgcccgtgccctagcgccgccgccgccgcggattccgccgcatcccgccgtccccgcgcgcattaaagagggggaaattattccccgcgattccctctcccgtttcccccgttttcccctctctctctccctcggattcgtccggattcatcccgcaatcgtcgccggcgtcttcaatggcggccgagatctccgcgccggtttccttcctctccggccgcgctctccccctctcggcgctatatatttgctccccgtgcttcgctcttccgtttccgccgctcgccgctcgctctccccgtcggattcgtgctcgcgccgtcttcctctctctccgccgtcgccgacgagctccggttcgccgccgacgtcgctccgcgcttcctcccgactcggcgccacctccgtcggcttcgccgcgtcgccgccgaccccgtccacccctccgcttcgctcgccgaccgccggagcaccgtcgccctcgccgtcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagttttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgctgttatgtggaggttattagagtaaaagccgtttcttttccgttggtcgtgtagacgctgcagcttcggaagatccgctcttcgtggaagtcgaagccgtcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctatttatggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaatcctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcagcaactaaaatgtggaatggttggcctgggttggcttgggacgagctggaacccaggtcgggttgccagttcggtccaaatcatcgtaggccttgggtcaaggcaggttcgtgagggttcacggccttgtttaataatactgtgtagctctagaatcgtctttacaaaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacagaccttcaagggagatctatacaagaaatacatcctgaagggactaacaccgaacttcgacgtattcccaaagctaagggatcattgggacgagttcgttgcttacaagacagggcaacaagggcaagcgatgatggtcaaaaacaaggaaaacgctgccaagaagaagtaccatcatcacttggggtcaggcggctatagcgtcgcaatgccgaagtgggaggagatggaggcaggcttgattgagaggggtatcgaaccggccaccgctaaatggccggatcgatcgaagttctggtactatgctcacggtagaacgcttaacccagttgatggctccctggtcttcagcgatcagatacgcgaggctgccagtcgactaacagacgcagtggaagcctcttctcagggcacgttccgacccgacagagagaaggacgagctgtcactcgccctacagactcccgagcatccaggacgaacacgagggaaaggcgtgattccctagaagattgtgacggagctcgtggctcctcaccgggagaccgcgcaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatctgtgtatgaaggagctacaaagtgtgagccgacccctccctcgttctaggctctgaatctggaaaaaatcaacccccttccctatgggcagggtcctccttttatacttcaaggggataccacatgcacccctctctttccaaactggacttttcttctcttcataaatggacggagatttgcacggttgtcctccgaacatcctcctgacgggacggcacacacctacctccacttctgccggaggcaggcgcgtcgtgggaacgtggctgtctgccgacgacatgaccggtgttagaccggtcacaaatcggtcattcttgcccaccacgcgtcagcctagcaacgtgcatgtttgcccttcttcatgtagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcactgcactacgctgcatgcagcgtgacacgttcgaccaaaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcttggtgacaggtgggaccggtctccatggttgggcagaaacccaacggtctcaaatcatgcacatcggtaatggtgacttggctgtccataatgggcggtctcttcaagactgccacattacttgagcgacgtacgaatctgggtaaaccgatttgcttcgcctggagatatggtaacgttgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccgggcacagcgatggcaaaggtataaagacactgaggaacggatttgctcccttcctttcgccactattccccttgccttcgccgcttgagctctaactctttctctgctgcgcctttccttcgccacacgcgctcgttctcaatcatcccttcctccggcgccatggcacggggttccgctctgctcgacggaagcgtacttccgccttctcgcatcgtgagcgagaggcacgccgggctgccgcgccgctttatgccggaatctgccaccggcagggagatagtgatgctgggcgagggacgcccggcaccagactacccggggcggtccgtcttcttcctccccttcgcaatggcagggctggttccgccattttcttctttctttatggatgttctggatttctacgatctccagatggcgcacctcacccccaatgcagtgatgacattggtcatcttcgcgcacctgtgcgagatgttcattggggtgcgcccatctcttcggctgttccggtggttcttcaccgtgcagtcggtgtcgccgccgtcggtggttggtggctgctacttccagccgctggggccggtgttgaaccgctacatcccctgcgccctccgcaagaagtgggacgactggaagagcgactggttctacacccccctcgccaacgaagcgcgcctccgacttccaagtcagcccccggcgcaggtctccagctggcgggcgccggtagatctgggggatgactatgacgccgtcctcgacagcctggcgggcctgcgatcccaggggctcacaggggccatggtgtacggcgactacctccgtcgccggattgcgccgctccaacggcgcgcccggggcacctgggagtacaccgggtccgaagactacatgcggacccaccagggagtcagatgggattgggctcccgaggacttcaagatcgtggtccaaagggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttctgggccccgcgtcgggggctcggggagcagccgccctgccgacgcccaggggaagaggaagctgggaggaacacctcccccatctcctccccgagggggcggggcggtgcgtgccagcagtcggcgcccggagggggccgcgctgacatcgcagcccgagggggagcgcaagaagaagcggccccgcaagatgggggagacggaaccatcccggggaaatctgatttcccctccaaggtggtcatttaaccgaccccctcgcaggttcgtcccactctctttgcgaccgcctttcttttacccaaaagcaagttttctcttacccatcttgtttgtcttctggttttttcttttgcttcagcgatgtcccgtcacgttcctcccgccatcccaagtctggccagtccgaggccgaagatccggcggccgcagaggaacggaggcgagaatctgaccggcgagaggccgcagatcgccttcgggaagctgaagaggccgcccgggaggccgctcgggctcgccatgcagaggataccgctcgggaggaggccgcccgggctcgccaagccgaagaagctgctaaggaggaggccgcccgggctcgtcaggctgaggcgatggcgtcttccgaggcagctcacgacgaagctgctggcgcgtcgcttgggcccacttccccaggcgacgcccaggaccaaacgggtctgggggacatccccgagcccagcgcgtcctccggcgggccgagccgcgtcgcattctctccaaggcggctcttcccctcgtcttctgtcgccccgctgagcgccgagccccttctgcaggccttggccgccgcaaacaccgcggtgctagatgggttcagcgcccaagtggaggccctgcgagcggaacgagcggagctcgaggccgcatgggcgcgtgtcgaggaggggcggcgctcggtggatgtcatggtggaggtgggccgtaaggctcaccgccgtcacgtctctgagcttgaagcccgcaaagcggcgctggcagagatcgcccgagaggtggaggaggagcgggaggccgccctcattgccaccaccgcgatgatcgaggcgcaggacaccctccgccttcaacacgggagctgggaggcggagctaaagaaaaagctcgacgccgcccaaggggtccttgacaccgccgctgcccgagagcggcaggcaacggagattgaagcggcgtcccagcggcgtgaagaggccctcgaggcgcgcgccatggcgctggaggagcgcgtctgcgtcgcggagaaagtcctggcggaccgcgaggccgccgtcacctcccgggaggcaacgctggcggcgcacgagtctgcctgcgccgaagaggagtccgcactccgcctccgcgaagacgcgcttgccgagtgggagcgagctctcgaagaggccgaggccgaagcgcaacggttggcggactccctgtccctccgtgaggcagcgctgacggagcaggcccgccgcaatttggaatccgtccgcgccgagagagccgcactggagcagcgggctgccgatctcgaggcgcgggaaaaagagctggacgcgagggcgtgcatcggcggggcggctgcgggcgaaagcgacttagccgcccgcctcgcagctgccgaactcaccatcgccgacatgcagtgcgcgctagactcatccgccggggaagccgaggccctccgcttggcgggcgaaatagggcccggcatgctttgggatgcggtctcccgcctggatcgcgccggacggcaagcgggcctctggaaaggccagacaaggacgcactccaccaacctggaaggcctcgcttcgcacctcacgaggatggcctgggctcttcaacaactccccgaggagctcgagaagaccatcaagtcatcctcgagggacctcgcccaaggagcggttgaactcgtactagcgagttaccaggccagggaccccaacttctctccatggatggcgctggaagagttccctcccgggaccgaggacgacgcgcgtgcgcgggtccgggatgccgccgaccacatcgtccacagtttcgaggggtcggcccctcggctcgcgttcgcccccaactccgacgaggagggcgatgccagcggtgcagacgatcgtgacgacgaggccggcgacccgggcgcatcggactgagcccccaggcccccgcctgactccagtttttcctttttctttcttccaaggccttcatgcctcttttttgtatagatcaacttaatctggaatcaaaaatgatgaaaaaattcgtgtcaattttattttgctatgcgtatgagatgaggatgatctgtgccgtggtcctcttttgtgtcttagcttgatttaaggactcgtgcccaagtcccagtcctctaatggctcgggtcggggctagtgcctggggagatccacatgtcgaggctggccaggccgggaacgtggtgaccgagggttatgggtgacccgattgtgggtttttgccgattcccccccgaagttcaccacgccccggggcacggctcggttctgggccccgtttggcgattttagctgaccgaaccgagcccccgagggcaaggttgagtacgagtgaccttatttcaagtcaagattctacaaaaggaaaaaacggcacagacacaacctttaggaaattgaaactgcttttattgaaatgctgaaataagagaaataagaatgtgcatgcgtggtagcccccggccaaccctgcacacccgaggggggtgcggggttggcccgagccaaaacctgacactcgacccccccctcaggggtagaagcgacgaaggtgttcgatgttccacgggttaggcagctcagtgccgtcgcccgtggccagccgtatggagcccggccgggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaaaagagcttgatgcccatgtcttcgcagtagtcgccgaagagttcactagtgaattgggtgccattatccgtaataatacggttaggcactccaaaacgggccgtgatgcccttaatgaatttaagtgcagagtacttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgcttggcgtgaaactgacacgctctgcatcgccggaccagatcaactgcatcattgagagctgtcggccaatagaacccttgacgaaaggccttgccaaccaaggtgcgcgaggcggaatgggctccgcactcgccttcatggatatcggcaagaagctcaacgccttgttcctgaggaatgcacttcaggaggattccattagccgcgcgccgatagagggtcccttctaccagcacgtagcgtttggaaatgcgttggacgcgttcactcccttcacggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggacgtctccgttcggagaggtcaacgtgacccccgcaccggcgccctggagagacagagaaccgtcgaactgcatcacccagtgggcggtgtgaggcagctgagaggggtccgtgctggcctcggggattgagacggtctctggagccggggtacactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgatcctcttcgctaggggccgcatccccggggcgttcttcgtccaagtggcctctcggggcgcactcgtcttctgtgccgatgacctcggggtcggaggatgacaggagcggccttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcacccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtagagtagtaggggctcgtttggccccggggcgactagaactgggggagagctgagatatgtcttcaactgagtgagggcacgttcagcttcctccgtccaagtaaacggccccgagcgcttgaggagcttaaataagggtagcgccttctctcccagcctcgatatgaaacgacttagggcggcaatgcaaccggtgacgcattgcacatccctaagtttgctgggggggcgcatccgctctatagctcgtatcttctcggggttggcctcgatgcctcgggcagagaccaagaacccgagaagcttgcccgcaggtacaccaaacacgcacttatcggggttcagttttatgcgggcggagcggagattttcaaaagtttcctctagatctaagagtaaagtctcttggttgcgcgtctttacaaccaagtcatcgacataagcctcaacattatgccctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgcctttggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagccgcgggggaaatgatgttgagggccgctcccccatctatgaggacacgccccaacttcacgttgcagatggtgggggaaaccaccatcgcaatctgccctccccgggcgacgcacggtgggtggtcggtctggtcgaaagtgagggcaacctccgaccaccgcgcccggcgcgtcgcctcatgagtaggggccgcggccagaagctctcgcttcatggccttgaggctccggcgagagacgtgagcacacgctcccccatcgacagtggcaatggtggccccaggttcttggaaacctaggtcatcatcaccgtcatcgatgtcaacagcaggggccttctgtttggcctcacttcgccgtttaccggagggagttgccggcgacttgccctcacggcgttccttcctcctgtcctcctcccacttcctcgttcgctcagccaagtttttgaccgtgcgacagtccgcgagatcgtggagggaggtgttgtggacggagcaccacttgccgactgggcgctccctggtgggagtaccagcctctttctttttgtcgctcgcaggcctcccctttcgggtggcccgcggagcgccctcgacggcgaggacatgaccctcgtcgccggaatggaccgaccacttcttcctcctcctgtcacgccgccctgtctgagcggcggatccgggggcggccgaagctgccactccggaaccggaggggttccaggtccatgcttcctccttacgagccactcggtctgcgagctgaaaaagctccgcggtagtctggggctctttggaagcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacaaagaggcgccctccgttgcgcggggagtacgccggctattacgccggcgctcgatgtcgaggcgggcatccggctctccacgctgatcctcccgagtcggaggtgccgacgagggagtggcagccgaatggcgtgcaacagccgccgctcgccgcgccctccgtcttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcgcgccctggggcgtgctgccgtcgccatagacgaggaggcgacgctccccatctcgccgttctcctccatcgcccgcgatcggtgaagccgcggatctgtcgaccctctcgagggcctccccctgcttaggactttggtgtggaggaggcggtggagtacgagctcgacggcgtgggtttggctccccgtcgtcgccgctcacactcggagagaggtcgtgcgcctttgcttgcccggccattaggctgaacaagaaaaacttggcgcacacggaaaagtgcgagagctcagaaaacacacgctgagccccctacctggcgcgccagatgacggagctcgtggctcctcaccgggagaccgcgcaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatctgtgtatgaaggagctacaaagtgtgagccgacccctccctcgttctaggctctgaatctggaaaaaatcaacccccttccctatgggcagggtcctccttttatacttcaaggggataccacatgcacccctctctttccaaactggacttttcttctcttcataaatggacggagatttgcacggttgtcctccgaacatcctcctgacgggacggcacacacctacctccacttctgccggaggcaggcgcgtcgtgggaacgtggctgtctgccgacgacatgaccggtgttagaccggtcacaaatcggtcattcttgcccaccacgcgtcagcctagcaacgtgcatgtttgcccttcttcatgtagcatcttgcctgtaatggttgggatgaagcctggtataaatctaaccagggctaacgtgccatctctaagagattacacgctagctctggcttgagacgagtgcctagaggctttcgtcttgacgggatggggcaaggcgtgcgtcagaccgccagtcgccacctaacccgtgatctgaccggtctgtgactggtcacagaccggataaaggaacgcactgcactacgctgcatgcagcgtgacacgttcgaccaaaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagattggattcaaggaggacatccacacatacaagagtcagatgaggagcaagagagataccgaggcgaagattgcagatcttgagtacagggtatcgagctacgagctcagcatgcaagaggaggtggcccggaaggtggatgaacgcatggcagcatatcggtcacacgatccccagccgtacatacctcctccaatggtcagcccatcaggcaatcgtagcagctgcgcctcaatggggtaggtaggatcatatagcatggacgtcatgcaaacccaggacgaaaccacctgccccattgatgagatcacgcaacggacaccatgtgagctgcatattcccttcaagaacttatcaatcaaggtatgctcgatataatatatgatttttgacttgtacgttccgcaagttgctgcttaggttgattactaatagataacctctcatcacgtgaaggtggcatcggtaaaggacatcccaacggacatttcagggacttaccactgtaggccgattccagcaggatactcgagggtcgaagttgagctggtggaagccgtgtacgaggacctcgagttggactacttaggaggagatggtgagacgcatctacgagacacaagccacgtccggttcatcatcctccctgggcgacaagcggcgtctcgtgcaccatctcctctggctccgccgtctcctcctgcaccatctcctccagttccttcgccacgtcctcctgcaccatctcctccggctcctccgccacctcctcctgcaccatctcctccggctcctccgcctcctccgcctcctccacctccacctccaccgtgtccgcctgcacctcccaagacaaggtctcaccaagctccacctcctgccagcacaagggcaacgaagaaggccaaagttgacaccaccaaaaacaaggagccgccatacgattgtagtcaagaggagcttgacccttatgtggcaggagaagtgaagaggcaactcaagcctcggactcctgaaaagaagatacctattgacccgagcatgaagaatttcttcaagggaatatccaccacaaacaagaaggccttaaagctatcggactatgaccgaacacttaggaaagcctattacaagaagtctaaaccagttcctcagcttggagaacaaccaaaccaagtggtcgagccgttggtgaccggcgaagactttggcataatggatttcattttggacaccggtctaactgtggctcagttggttggaggcacaccaatcctgaaggcggaagtggcatacaagtttgaactcggtaaactgcttgtcaggcctgagcagctgcagtccctaccgacacaaatgtacaaattccatgaacgatacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttctgagcgcatggattttgtaagtatctttgagttcgatttgtttcgttcaataattagctcctagcatatatgtaagcaataataatttcctttcaaagggcccgacggcggggggtttacgatactgggttcattgaccctcggaaaatcaacaccgaaatgctcgacaagtacgagaaagacacagaggacaatctcgtccatctcctaacgcagcagcatttcaagacgttcatactattgccgtacaacacagagtgagtttttattgtcgttcgaacaaatttcattcccatacatataacatgtacattctgatatttatctcatctcacgcatattccagattccactgggtcctgttctctttcgacttggacgcatgcagagtcactgtgtacgactcaatgaataaagaggagaaaatgtgcacatgttctacattagatttattttttatatatttgaacaaacgttgttacacaataaattttgtgtattttcgtttgcagaggtacttgcttgggcgaaggaaaagagaccgagtgtaacgcatgcatggatgatcaaagaagttgattggggactaaaccaagaccttctccaagtctacttctatttcaccacgtcacttttggtccataaaagacgagagatcaagttttacacgttttggattcggattcgggcctcctgacagcatcaacttcaaatggacatagccgctgatctagaaggaatttcggggcccatgagtacttgttgaaaagcttatggaatctactttcagatggttttggtcccatgtcaaaatttccaccgagctgccgggaaactacaaaacaagtcatgtatctcatctggtctgaatctgatttgggttttaggccttgtaattgtgtctaaacgtgctgatgaagcctagagggggggtgaataggcagtccctgaaaacataaaaacaaatcgcagcggtaaaattcaaacagacccggaacttcctggtaaggaacaccagagcttccggtctgccaggcccagaacttccggtgttcagaacaaagaagaaattcaaatttcgaaacaggagactaagccaatcttcataagatgatgcacaggtattctaagcagaagatagatcacaaaatcatccacagaaacatcacagaaatagacaagagcgattttttaccgaagttcagatcttgcgatcctactctccgttgaggagctccaaagagctgggtctcaattaaccccttgcctcacttatgcaaaaacaccagaggaaatccacagccttcaaccccaaacacccctaggcaaatttctagaattgagtgactaccaagatccaactcaacctacttctagaaattcgccacaagtgtgggttgctctacttggaaaacctctagaatctcagcacaagaacttcattaacttacctcgttctctttcggaggagaggagatccttcacaaacttactcgggacatccacaatatataacggattctcgcgggcgacacctaaccgtctaggagatcatctccaagagtaacaagcaccgagatgacagcccacaagatattccaagtgctcacccaatatcctagtcttcacacctctccaaatcttcttctctccctctcaatctctctttctcacaagaattaggctcaagattgagtggagaaggcaataaacacttaggagaggctagcaacagctctaggttcgaaaagtgaaagtagaatagccaaagaatgagctgcaaacgagctggttatatataacggctaggtgacgtcatctagccgttactcacaattttgaacttgaaactagacaggaagttccggacctggaagacaggaacttctggaaaacagttaggaaaatctttttcaccagaccggaacttccggacctgaaagacaggaagttccagagttgcatttttggacagacggagtatttgcaaaaataactcctagggaaacttgtcacttggttcacactaagagtacttgacatatctcagagcaccacctggaacccctcttaatagtacggttttttctaaaactcgattgcaataaataaactatcctatgcactcctcaagttctggtccgctttgattttatacttttgggtggtctccaagcatccatcttccacactttggactaatgcacctgaaagtagctcaatgaactcattagtcccttaaccacatttgtcattaatcaccaaaacccactaggggggtaaatgtacttttagtgtcgtgggcttagcccaagggggtgtgcgccctaaggcaaccctaggacgtccctaatcatatttattcagtagccgtcatcgtttagagtcaggttttgcttagattaatctgtcaaaaacagtttcgccgctagatcggtttgtggaaccccaaattcgagtgcttaatatattttccttcacctaagcaagtacctctacaaacgaaaacacacaaaactcattgtgtagcaacgtttattcaaatatataacaagtaaatccaatgtagaatatatacacctttggttgattaatatataaggtagtcatgattatatccgagctagttatgtcctcatcaggcgctaccgagaggataagactgtgagagactagagagaaggaggaataggaagataagaagaggataagagtgtgtgagagagaggaggaggaataagagatggaaattaacttttaaggataagagcaaaggattatatacgtatattgatgtttagttccggttgggaacaacaaccgggactaaagttaggattttagtcccggttgatgttaccaaccaggagtaaagatctccggggatctgatagcctctaacacaaggtgaaccaggactaaagatagcatagtccccttacacttataaactgtgactaaaaatatttttatccccagtttttaatgaaccgggattattgtgtattttaggcaaccaacaaaaatgatttctccggtagtgatgctcactatgaaaattatgttttttaattttaattttgaaataacgaatataaattgatcaatatttctctgcatacacactagcagctaatagttttttttccatatgacctgtttttaaagccaggatagactttatagccagatgaacggatatgggttttgaagaaaaaagtggctcacaaaacacgccccttgtaacaggaaggttttgaatagattgatgctctatggtaggcaagaagaggagggaataaaataaaagaaaatatacgaggatgaactaagttcaaagatgacatagtactttattaaagaagcattcactgaggtattcggacgttgccttcactctctatctattttcaccatactattaaattgatgcctaagatataaaagtgaaaattaaatttgaaaatatacattttttttcaatattttgcgtttatatacctgcatagaaaatatttgcacaaatatacctctccgcacgatggggacgcaggaccgaaacggtgccgcgcttccattccatgggaccggcagtcctgcaggatggctgtgcgacaccgcctcactcccgcagcccaggagagcggtagcgtggtagagggcggctgcacgcgggaccgagcaggtcgcgtggcgccgtggcgcgggaccatgcttcccgtcccgtcccgcgcgtgcgcgtgtcgcggtcgacgcgagccatgcaaagcatcacctctcaagcacgcatgcacgcagttgatctagccaaaccccacaatatataggtactccctccggttttattttaattgacgttttgaacaatgacacagtctacaaaatatatgtttgaccttatttttctattataatatataaaattaataaatgcatgttaacttttactatatatgttttgaaagataaatctatatatattgttctagtttctttaaaccaaatatttttaaagttatttatggtcaaagttatataagtttgacatcaaccttgtccaaagcttattatagaaccggagggagtactagcttagcttactaattattccatcctgatctcctcagctccatccatccatcattgccaacttaattcttctaagagaaagtacaagctagctggttaatcatattgttaattttggcctcaattaggtctagaattaatcaaggcacagctagcggcgcagatgggcaggagcagggcggttgcgcggcaatgatgcgcgggaccgagccggtcacacagcgccgtgttgcaggaccgccctccagtgaggccatgcgaggcggtgccgcacggctgtcctgcgcgaccgccggtcccacggaatggaaaagcggcaccgcctccatcccgtatccccattacgcggaggaggtatatttgtgccaatattttttatgcatgtatataaacgcaaaatattgaaaaaaatatgtattttcaaatttaattcataaaagtgagttgcactccactttattgtgcattttagaaatgagtgagttcctccttttatagggcaattatgacggttatggatgtcggttcacccacaatcgccattctccatggacctccacgtgaaaagtggagatgagggggcctaaggtcggtttgaccaaatccctggttcgaccgacctgtgggtcttaccactctctactaggggtgaaaacggtatggaaactttccggattccagacctattttcgaaaacggaatctgtcggtcagaatttttttggaatttttcggaaaccaaaatgaattcggaaatattttctcgcaaatggaatcggaaattataagcgcagtttccatcggaactcggaatcggtcggaaactttccgaaaattttctcggaatttttggaaattgtctcggagttatcagaaattttgtgactgcaataccctggattctttttttaagcactaaatagcgaataccatagtgtttggctgttacctttttcaaaaatatttgttatgcaaatctaaaattacataagaatatttttttcctacattgggatttattaacaacattactcttttgaacatagataatttattcaattggatttatcagtttgagaggttttttattccgataaattttcgttaccgtattcgcgccggttcgttttagctccgttttttgtttcgataatattcgattctgttttcgtatccggtgtttccgattccgattctgattcccgaaaaaaaatatgaaaacaaaaacgataaagacggtttccgtccgtttccgtaccgttttcacccctactctctaccgtctttcaacccattaaatttgatattatattttgtgttcttttatgcaggagttagataactcccggatctaatgttttatcccaaattattctataatttatttatgattatataggtatatagccagctacaacgtaagaaacatgttagtattactactcaaatactccctccgtattttaatgtatgacgccgttgattttttaacaagcgtttgacctttcgtcttattcaaaaatttatgtaattatcatttattttattgtgacttaatttatcatcaaatgttctgtaagtatgacataagtatttttgtatttgcataaaagattaaataagacaaatggtcaaacgttgattaaaaagtcaacggcgtcatacattaaaatatacggagggagtataaaagaaaagaaaaaaacaagttagtactactacttaaatctctatctctactactcttattttaataccgaacgaaaaataccgggcgaaacaaaaagtccgatccagcaaagggaggaaaaaaaaccggaagaaaaaaatgtcccatccaaaaaaggagcgaaaaaaaccggcgaaaaaacaaatcagtccgatcaataaaatatggggcaaaaaaaaggaaaaaaaggaaacgaataggtaaaaaaagagcgaaacaaattaaaaaaactgtctgattccaaagaaaaggaaattaaatgtgacacggtaaaaaaatcgacaaggcgaaaaaagccaagcgaaaaaactgggccaaaaaatcaaaaaagtcggataaaaaaaggggcgaaaaaaaaatctgtccgataaaaaatagggaaaaaaaaggaaaaatcgaaatgaatccgactccgtcgccgcggtaaaaaaagggcgaaaaaaattgaaaaaaaaatatctcattccaaataaaaaggagttatatgtgacacggtaaaaaaatcgaatcctattatatctagaaaggtccgacactaataaagtggcgaaaaaaaccgttcgtaaaaaaatacacgagaaaaaaaataaagaagggcagaaaaaaacgcggtggaaaaaagtctaatttctattcattgttttagtagtccttttatatctcttctttatctctaatctaatctaatgtaactattaaaaaaagtttctaccatatattaaaaaggaaaaaaatgcgcgagaaaataaaaacggtttaaaaaacgcgtgaggaaaaaaatgtcagaaaaaagcgcaaaagaaaaacgcgttagaaaaaagttccgtagtcagtaaaaaaacgcgcgagaaaaaaatatttccatcttctgtaaaaaaaaaaagcatatgagaaaaaactgttagaaaaaaggttaagttgatgaacatttggtcggatagactccatcaatttttttccatctcctacacgacttttgtttcatcatctattctcctatgttggagaccctgcacatctttgtagacaattatcatattatttttgtgaagtatagctattattcttgataacatattatatggaaataatcttagaaaataaacatattttaattgttatttagagaaaagtgcacagtgactctattttgtgtggacttgatcatacgagtcagtgtaggatttgattggttgcaataatgagattaaaagaatattttagattatatgtatttcattggttgcaataataagattaaaataatattttagattatatgtatgttgtcacatgaataatccaattattttaaaacaaacatcgtaagcttgccatcatcgagattgggctattgcatttaagatattccaattttttgattttttgattgtcatatatggttatgcatgaaaaacgtatattatcattaagtttttttatccgttgcaacgcaagtaacagaaaagaaaagaaaaaatctcccgattcgtccctggtccacagccgcgaggccacacgaaattcgcggatatcaactccccgccccgccaccaccgcttccttttccaacgacttcttcttcttcctgctctaccttcttggcttttgcctctgttcctcttccaagatttgcgagatggtggcggtgacgccgggcaggcgccgccggcctgcaggatgcgccgcggggcaccaccaccagcaccagcagcagaggctgctggccgtcgccgcccgcctcgccgcggcgaagccggcggccactacggaggccgccgtgtacggtggcgtaggaggaggaggatgctgcctcgagttcctcgactgcgtgctccgggcgatgggcgtcgccaccccggccgagatcatgccccccgcggacttcaggtgggccgcgcgcccgatgcggcggcgccgccgcgggggctcctcgtcctcctcctcctcgccgcgcgaccgcgagccgagggacggccggatcgccgccaacggcgcctccgctgccgcctcgctctacacgatgcggggcaacaagggcgtcaaccaggacgccatgcttgtctgggaggtaattatttctttcatcccccattaatccccaatttatttctttcatcccccattaatccccaataacttcttttccatgtgttttctgtgatgtgaatttttttttttactttctttgagatgatgtgtgatgtgaaatttgttcgtacccccggcgaaagagaaacgtgttaattcgtgattgattgattgatgattgaacgtttacatgaaagccccgaactgtctgatatatctgcgatttttttttaatatatgttgttcttgtgtatgcttgagctggcctacacagattgatttttttttcaactttgacataggacatacatgtgtcgtcttggtgtagaatgcatgtttgattcccctacttcttgatattagaataccactttgttctgtctccatatggattgccattggatattgctggtggagactgtttcagatagtaatataatacaacctaattattattctccctatgtagaaaatttgttagcaggggaggtgctccacacgattctcatccttatcctttcttctttttatggatgatcttattcttatctgtttacacattgagtttagctcttgggccatccttttgctgtgtaattaatgtttgcttatcgttctgccccataacacctagtattatccttttgttgtgaggatcctctaccataatgttactaccattacagtcactagtatgtggatcctaccctcccattgcaccacacgtcggtgcctataatgatagtaccattattgtagaggatgtgaacccaccgagccttattgtctccacagtttgctgaagtaccacctggcatgccatgtagcatacaactattgtttttgtgagccagctagtagaatgatagctcctttcatgtacttttgcaatggcaacatatttgctgccctaccaatttctttattgtgataatggtttctgatttttccatatttacatctagtaaccatggaaaaaaatactataaaagccaaataataaattgaaagtacaatttttttgtgatctggtttgttgaaatttttggagatctccatgggaatgcaccatctgatgttcctttctatgaagcctttgtaatattaaaaccatgaatgatattcctttcagctataaattacataaatttatcaattcctacctgataatagtctgtaatcatatgaattatccacttccagttttcctgttctaccattccatttttaggcaccgcaaagttgattttgatggtgttttttgtttgacttccagaatttctgttcaaaggaagatacaattttttgtggtgtttttgatggccatggaccatatggccatttggtgtccaagagggtcagagatctcctccctataaagttgagtgcaaatttaggaagagatggacacaaagaaacttcaactaacattgtcacaagcagcatgactgaaggtggtggcaccgaacgcatggatagagatactgaaactcccctgggaacggaggagaatggagactaccccgagatgtttgctgcattaagaacttcattattaagggcattttatgtaatggacagggatcttaagtttcataaaaccattgactctgtgttcagtggtactacagcagtcacagtgatcaagcaggtaaaaatgtgtcaaa

SEQ ID NO: 58394 - DNA, 716 bp, Oryza sativa
tgctcttccccattttctcccgagccaaaagctatcagcaaaagtgcttggccaagaacttgcactgcctctccgccgaacccccggagcgacgttggtgccggtgcaagagtttgggttggcaagcccatcttagcatatgcttcggcgaagatcacgtcggccgaactccctccatcgaccaggattcgtcggacttcaaaaccggctatctcagctgagattaccagtggatcttgatgcgggaacaggactccttcggcgtcttctggcccgaaagagatcaactggttcacgtactgtggcgccccctcacccgccgaagtgatgctgtggaccatacggatctgcatcttcctctgccgtttcgacaacaggcttggcgggtcagctcttgtaatcacttggattacccttcgttgtgtatcttggcgttgttcggctaggggtatttgctcctgaactgcttcacggggtgcttcgactgttgttccttgctgcggccttgggtcttgcgcgttgccacgttgcctaatgtttaagcattgctccgtggtgtgcaaagagcgtccgtgaaaagcgcagtagaggtcttttcggaccttcttgcgggctggctgatgatggttgcttgcttgctgggcgtcgaacttcttgcggaaggcttgcacttcttcgacagccatcacagcctttgcccgccgatctgttctgaa

SEQ ID NO: 58395 - DNA, 13504 bp, Oryza sativa
ttttcgcatatttgtgtatgatctatgattctaaatttttttttagataatatgtgattctacatttatttctatgtttattagaaatataagatcggtattaggtattccgttattcatgctatgcaatttggctgcatatcagcatggcattggaagtttccgagttcatacttcatacagctaaaaatcagaggtacaagtaatccacacctttggtcccttgaattcatttttctttgctggcatctgagcttcattttttattcccctcattgatcctctgtgtggaacaaagaggcaagaggaataaaaactcttttgaaggcgaaggggcattgcagaaatacagctcatcccttctgctacttgtaggatctgagtcatgtgcagctcctattgttgaggagatcagaaccggatcatcggataattcagattttgtcgggttactgcaaggcagagtccttttgatttcacatgctcagtgattttcaagatatacaactaccataatctgaatattatttttctctcctgcaggtctctggtaatgtttgcctggaactattacttggataaccatcagacagatgtcatattgtctgacaattacatctagcaacagactagcccagtctttgctgtgtccagatctatccagcaaacagtttaatttactcccaaagttatttcttctttaaacttagttcagaaaaaggtatatggatcactggaatgcctgtattttcagtgggctatcttaccatgagacaatgatgaaaactgtgtgcatgtgaagacaaagctcgagatctgcggaggcagtgtccaatcctttttgagctctgaagaatgattagattcccctccatgttcgtgcaagcctctcctggtagctccttgagtttgtttattggacgacttcattgcagcaacattctctacaatacaatctcataacatctgatcctgcattaattgctaagataagcccatgtttgttcctgttttgaacataatgcagtatatacttgttttttcattgtcctttgatgcatctaaactggggatgattttctctccaatcattgaaacatgtccttgtgacacttgcctcttgagctctgattggcttgacctcttaactgtgtctgatcttggggcaagtcactatcctgtctaccaacttgtaacagctagcagttgaaatttttttctaatcctcataatgtgcacaggggttgctatcacccccagttcatctccagccgtgggcatctatttattttaagcatgatttaccatttcttaatcctgcaagttgctgtgcttccattcaaccttttgtcttttcatcaggtataaatgatcctgccataacctgcatctcttcttcaccgagcacaagtgtatcaaactatcaaacacagcacggtcctcacaccacctctaacatctctcacatccaaaacttgtatcagaaatggagtccggaggggtgatcgcggaggcggggtggagctcgctcgacatgtcgtcgcaggccgaggagtcggagatgatggcgcagctgcttggaacctgcttcccctccaatggcgaggatgatcatcaccaagagcttccttggtcggttgacacccccagtgcctactacctccattgcaatggaggtagctcaagtgcatacagctctaccactagcagcaacagtgctagtggtagcttcactctcattgcaccaagatctgagtatgaggggtactatgtgagtgactctaatgaggcggccctcgggatcagcatccaggagcaaggtgcagctcagttcatggatgccattctcaaccggaacggcgatccgggcttcgatgatctcgctgactcgagcgttaatctgctggattccatcggcgcttctaacaagagaaagattcaggagcaaggcaggctagatgaccaaacgaaagtgagttaacctgatgattttttatcatttttgcgataacagtgtattaaggctgctgtttaaattgctggtgtgcagaatttgcatgctgattttgattgaaatggatataatgcagagtaggaaatctgcgaagaaggctggctcgaagcggggaaagaaggcggcgcaatgtgaaggtgaagatggcagcattgctgtcaccaacaggcaaagcttgagctgctgcacctctgaaaatgattcgattggttctcaagaatctcctgttgctgctaagtcgaatggcaaggctcaatctggccatcggtcagcaaccgatccccagagcctctatgcaagggtactagagatgatcttctgaattcactgtctaaaaacgttacagattggcaatctcgctaatgctcttcgtttattggatgcagaaaagaagagagaggatcaatgagaggctcaagattctgcagaaccttgtaccaaatggaaccaaagtaagattctgagaaaaatatcatcagtatttagtactaactgtagatcgttctttttttttaaaaaaagtagtaactgtagatcgtaaaagaatgccgacaactcaaacagtatggatctcattctcctttcaggtagatatcagcactatgcttgaagaggcaatgcattacgtgaagttcttgcagcttcaaatcaaggtgaggcttttcgcagcccatatgacaacttcagattattccctctgctcttgtcaaaattgctcagcaagttgcatttttttttctggtgaaaaaaaaaaactcaagttgttggttttcttgcagctcctcagctctgatgaaatgtggatgtacgcaccgattgcttacaacgggatgaacatcgggatcgatttgaacctctctcagcattgataagaaaacacttctaacagtgtcgagttacagaagaaagcagggatcttacttacaagttacaacacaatttggttaaatcagttcgaagagttcattgatcgttactacttattactaacatatgcaaccggtttctggtcaataaactgtgctgcacaacataatcccaaaagtaaataaagccataaaaggcccgatgcaatgttcttcagaagctgtttttttttaactcgtcagcagttaaccgaaggaatggattgtatggtggccagaaggatattatatatatttacaggaaatcacatagatactggaatactggaagaggctctgtaacttgtcaagacaagagagggcaactttgttctttttcttcttgagaagcaactccaaggaggaatttctctttcattttccttttttcaaatttgctctaggagcaaatttttgtctatagcagtgtatgcgaagtgctagtaccatataatataatgtttttaccttgagcttgcatataatgcgtcgcatgatcgtgaactgtcgttaaatatacattatagttattctaataatgcaatttatttttgtatagtggtttcttttctatgatcccatcttctcatgccactatatttatttgtttgaatcgtaattttaatcatgaagaagcgtggcatgcgttgcacattttctcctcgtcaatggatgcttgtatattgcctccattacctgatcattattgtcccaacaaatgtttaatccagctgttggtttaaattatttattcgatcaaatctaccggatttcctaccctgttctgggtaggcataaaaaaagtactcaattgtttgaaatactgctacaaaaaaaatcaaaatatcatcaacataaagctccactacttgcctactacataagatgcatccatcggcacattatcgacattgacatagttaaacttatagagttaagggaaacactagtcagtcataaacagtctcaactattttcataatcatttttttactcaaaaagttaaagctggaaatcaaaatggcataaaaaaaatcagaaaaccaaaaacagaaatatatgaatgtaaacatatcggtattgataaaaactagaaataaatatcggaaacatttaattataaaatctcacatttaactttacataactatatattatatattatgacaaaataaattcaagattacactatgtaaattataatttgtctcccctttaacctagtcctcaagttagggataagttgaggagttaataagcctctaaactatgaatcaaataaaaaatggaccataaatattgacatatttagatatttggtaattactataatataaaaaatagtcattactgtaaaaatacgataaaatttgaaaatggtcggaccacaacaaaattgtttccgtctatgtttccatatttttttaacatttctaattttgtttttatcagtacccatttttacattgcttgaccggtaaaaatgggaaatgagtgtcggttggttgggaatttccatgactattttcacctataattataagttatggaacaataagttatggactttgggtgttcaaatcccggtgtttgcaattacgcacatgcacaatagaaaatattgaggccaggagatttaccagttaccacggatttgtcttttcgagagtaataatcgagtgcagtcacgtgtgtataatggtgtgtgcacttctcagttttcgatgtaataaaagaatcacaaaatggagaaaataacacttttagagctcatttgaaatcatgaattagaaaacacactaataggaaaataaaaacatgaaagataaattgtcttgtattgttgaattcctacatgaacagagttcacatgaatttacaaagcatgtttttttttaatatcatacgaaaaacataggaactctatgactgaaacaaacaaatcatacggtttcagatgaccatatatgtaaccatgtatgcaggggcggatccaggaacaaaaaattgaggggcttaattacacagtttcttcaatctccaaccatttagggacatttagtttatcattcatggtgaaaaaaatcgaaggggatgctccgggaggtatccatgggttttgtgggtgtaggggtcccctgcacccacgttggatccgcccctgcatgtatggatttttttgcccatagagcatattttcagtttttcacctgtatttgctgatgtggcaaatgtcggggcccactgtaactgtaacgttcacctgtctgtcatgggctggtttcacgcatggtagtgggctaccggccagcccattttgaggtggtttggttacgccaaaactttaaccaataagttcagtttaggttcgataacttaacaacgagttcgattttcgttcttgaactgaaataccaaaaattacggatccctcaactattaaaactggtacgttaaaaaccggtacaacgtagttcatatgacaatatagcgggtgttttgtcagacatggcaaatttacccgagtcaacaacactgagttagcataagccccacatgttagggccttttcacctatctctcttttcctccccctgttcccatctcaccaagcgacgagtggtgaggagaaggccggtggtgggcggtgaggaggccaatggcaggtggtgaggaggatgatgaccgatggcctgttcccatctcaccatgcagcaagcggtgaggaggacaacagggatggcgggtggtgaggacgatggccggccagcaggacgccgcctctagaggtgggtggtaatgacgctctacccacacgctccaactcctgtcccaagtgccaccactgcccgaggtctagacgggatgacgagatcacgggaggtggggcggctgcgattttatccgagatctgcgtgaaatcgggatgaaacgttgcggcatcatcgtcgtcctcctcatctctgtatctgcggatccagatggcccgacgacggcgcgcggctacagcggtcaggggaagaggaaggggccaccacgagcctctctcgccggccgccacccttctccctactggctaccgccacacacctctctcgccgtctctcccaccggcctctccgcattcaccatgtcttccgccaccgagcttctccccgtcggccgctgtgcacctctcacgccagaacgcgccattagttgtcggctgccaaccctggaggtggaggcctggagagagatagagatgggaagagaggggagagagtgaacttaattgacatgtgggcccacgctgacccagtgctgttgactcaggtcaatttgccacgtcggacaaaacaacccgctatactgttatgggacctacattataccagggatccgttgttatatctggtatttcggttcaaggatgaaattgaactcgctgtcagttaagggaactaaaatgaacttattccaaactataaactgtagttatccttcagtaataccgaaactgcagcaaactgctacttacaaagctgcatatgtagctcaaacttgtgaagcatatcctttactgatctgatcgactacagtattgactaattaacatccgtgcaaaatcttattgatttggactacttaattagctagctattagagcaagtatagcagtaggctataagccggctaaatgctaagttgtaggagagaagagaggagagagaggagaagcgggctgtaaacttacagccggcttgaacataagaaccaagaaactctgtgagagagacaagtgggccctgtattaattgtaaagagctaactattatatgagtaggctgaaaaaaagctacaaagaaccttatagctaacaggtcggctatattattagccttgctcttagacgaggaagataattagctagctaagtctaatcacgcagcgagtacttaataaacaagtgctgttatgctgtccaattcgggtatccacttcttttaacccagcagattaggcactggtcccttcacttccactgatactccttcttctaattaagtaaacttccagatctatcagctactaccttcttgtttttgtttagtgttaactatcttatcagcataggtaatttactaccttatcatgcatgcatgcatgcagtagcagcagcactgacccattattcagtttggttaaatttctctgaagccatgtatagatagacagtagtgcacaggtcgttttctggcgcccattttcttcgttcggttgccccttctagctcgctaagtgttgctgcttgcggtcatatgtatataggagtgtaaattgcaatgtgtaattagttttgtgttgcgaactgatctcacctacagagcccagccccacactgtcttgtactcttgtggatgagagatactcatactctccgtattcagaagagaacacagttacacagaagatctatatatatttatgtagggaagagaaggcaataataaattaagctagtgatcatgatcagctagctgatctcattctagttaattaagctgagtatattggttaattaacttaattgcatgtgtgcccatcttgatacaagcacctaatagcagcagttgcatgcatggttacttaatttaaccccatgcattgcctgacggtgaccctaaacacaccccattacattgttgattgtgtaattgtagatcacatgacataactgtaggatcgcagtaaaaactaaactgaccagaggggtttgtgctctttgttttattgaatgccgctaaatgttagaccacctgcaaaggggaattgaccaaaaacattttgaaaaacccaatcgtttcactttacttttccccttgtccctcattagcccaagacactcccacagaccagaaagcaatttatatatgcaaatccagagcatctctaattatacacaagcaaacactgccaaaggacatctaaagagaatatgattagttgattcaattttcttacaaaacttgcagaattcatctccccctccactttctcttaactaattgttctcttaactaattgttctacacatggtaatctccccctgtctgctagatataaaaaatatttaatttgtaggatcgtaaaaggtcttccccatagtcaatgaggtgaggggctcccctacttatgtattaggtctctttcccttttacaaccaatgtgagactattcatcaatctccccttcacacattggtgtccctcagccattcactcccccttcagtccctcgggtatacttccacggcgcatcaacactatgtcctttgagccagagatgttgaactagctagctctgataccaattgtagtattgtaaaaggtcttttctacccaaaagctagccaatgtgatgaggggctcccctatttatatattaggtttattgcccttccacagctaatatgggactatttaacatgattttcagaggcaatttacttttccaaatctttcacctttctgcatctatgacccctctaaaagtcaggattatatacactaatttagtggtgaaactcttcttcttgttatgatgccaaaccacttgatccttcccccccccccccaaccatctaactgataactgttgatcatcattcttaagacaataagcttatcctgtctctgctgattcagatttcttctaaaatccagcttccattcacccttcacaaaaatatcactcacagaagcctcctgatggtaacttatctcatataaatcaggaaatttaacttttagagacaccttgtcacacgatacatccttccaaaaatacacagattccccattgcgcacatctttctctacaagcttttccaaccacttctgcaatgatgtaaccccttctaaaattgagatccaccgtcagcagaacgaccaaaagaactgccattgttcacatattttttcctaagaacctgaaaacacatatctggagccctattttccaactttatcatccacttactgacaagacaaatgttcatcaccctagtatccagcaagtccaacccaccataatcttttggcctacacagaaatgtaggaattaaaatcataggattgttttctatatgcatcattggtttcatagaaatagatctaaaaaatccataaggattatagtcttattaccttatttcataggattcttagtatggggtaagatctcttagaaaaatttataatgattggaatacatgtgacgtcctaatccaaagcatttacctttctattcctatgatttagaaatcctttgaactgaataagcacatggtgaaattagaatcccatctcttgtactatatggtaggggggaaaaacaccaatcatcatcttgccctcaagactcttcacgatcaatcctgtccagaaagtaaaaccgggatgacaaacatatacttggatttcactgtcaattcagcaatgctctgatggaacccgaatgcatcctttggattatattccctgtcaagctgccaaccctaccaccagctcccctcgatatttctcatctagtagttgcttacaaaacttttcctgtcaaaaagatggctgatttgattaattacttggctgttctgaaacttggctattaggatcgactgatccgacaagctagcaatataaaaattcagtgagaaaacattgcagtcagactaggcactataaaggcgccaccttggcttgctccagcctcgcaagcaaaggctcccactgaccccatgccactcgatccgtctctacaaagattacgttattagcttgaaggtttatctcacagagactatctctaggctgagttattttcttcactttcccaactcacctctctcgtattttgtgtgtacgattttcaaaatactaaatggtacattttttgtaaaaaatttctatgcaaaagttgctttaaaaatcctattaattaatttttcaagttatttttagctgatacttaattaattatatattagtaaaccaccctatttttggtgtggggaggagttccaaactcctgaacacaacctcgtaggagaaggagaatagggtacaccgaaactctttaatactacttcattctttttttcttcttattttagccatcatatcagtagtaccctttcctcatttcttcttttcttccttgttttctctctgaatttaatgtattttaatcttttgcttttgcttaatatatcactgactaactaaaactatagtctttaaaaactatagtttttaagggattgacggagtatatgtgcagctaattattgagctagctcgacgatgacacaccgacagacacaacatatataggcttcgtttattcagcgttttgttggaagattgggtatttgatatatacaggagtaggagtcaaaagtaatagcccgggcaatggggaaatatttgacaattctcattgacggtagatggtccacttatatgcatagagtttttgaaatacacatatacaggtctttatatatgctaaattttctcaaataagtattttgcttttgtccacaaacgaaacatgaaatcgggtagttgattcatggttgactgtggtcagtattgagttcatccgtctttggttgatttcatatagtcacttaaaactatggagccgtccactgttgatcttattatacctcttaatagaactgttccaatttcatttctatgtctaaaccagctacggtgatttttagtgacctagtatctaggcaaattttgctatagaaaatcgtgactttgcggttttagctataggacaccgcgtaaaatgacttttgggtgaagacattctcaaaagttagatatttgctggtggatactggacccattaaataataatttttggttgaaggggagagataaattgtgtgaaaggtctaaaatgtccttggacccacatgtcatatctccatctctcttctctctctatcccctccttccacacaggcacaaaaccatggcgacaggcttcggggagcaagaggagggttgcgacgatggcgacaacgagggagagagcggcggccaacggcctaggccttgccaggccagatcggcatcaccgccgtggagccctcatctcgccaagatcgccgagccatcggactccttcgcgtcagcgtcgtcgtcgtcttcctacacctcctcctccttgtcgtcctccgccaagagcactcgccggcggatatcgctgcgtgacctcctcctcagcggcacggcgaacagcaactccgccatcgctgcgggcgccgccgccgccgccgagaggtcatcgggcttctggcacctgtccttttggccatcgtcgcgatccaagaagacaacaatgctagcgctgccctactcatgcccgttcccgccgccgctgtagcctgcgcggcgatccacctcgccggagaggtcgtcggtgccgaccatggctgtgttcctgtgtggaagaaggggataaagagagggagaaatgagagatctaacatgtgggcctaagggcatttcagaactttcacacgatatttgtctcctcttcaatcgaaaattattattttattgtgtctagtgtctaccagcaaatattcaacttttgataatgtcttgccctaaaagtcactttgtgcagtgtcgtacagctaaaaccgcaaagtcataatatcctgtagcaaaatttgtctagtatctatatatgtggcgtctatatgaagcaccatgtcagcttcttttcctaggtataggtacgtggggttcatttgtacttaagatgaagttatggcatggaaaacaaaaagatcattagcgcattagttttaattattttaaacttgaaaaattaatttatttgatacttttaagcaacttctatataaaaaaaattcgcatgaaatgcactatttagtactttgaaaaacgtcctaaagaaaatcgagataaaatataatctatacttaattggaaaagaacaggacttactcactttgtccgaaataaaaatatcactcatcctaagagaactttaggagagaagagaaaaaattgcagtatccatcattaatagaaatatagcatcgatcagttggtatctcgataagagtatcgaagggataaaatctctttgattcataccaagacacaatctctatgaccaagtcatatatacccattttcatcaccaccttcctaggtagtcgcaccgctctctattttccaactaaggcgttgtttggtttagagggtatcgaagaggattggaggggattgagggagaataactccacctcaaaatagatgtgaaataaatctcctctaatctctccctcacagggattaaccgaacaaggtctaatggatcctcacaaaaatatggtgtctcctcttttcacgtgatatgatatagctcggtataaatttgcaggcctcttttaatttcctttctcattgcttcataatgctctaactatttatctttctctcgtctttaaaaagtgttacctgtccatcaggaaaaacaggttatatatgatctgcataatttttctaaggtactccctccattttttaatagatgacgccgttgaatttttctcacatgtttgacaatttgtcttattcaaaaaatttatgcaaatgtataagatataaatcatacttaaagtactatgagtgataaaataactcataacaaaataaattataattacataaattttttgaataagacgaatggtcaaatatgtgagaaaaagtcaacgacgttatctattaaaaaatggaggtagtagaaaggtagaatgccgagaaaattggacaaataaatgttgtttgttttggtttctagctaggctttagtcgatgtgcccccatggaccggaaactacattttagttacttaagtcttgcttcatgaccgggttacacgatcgtaattaaatatatactctttgtttagtagtagtacctacttgtggatacgtggctgcctactaacttgaaataattagggcctaaatgagagctttaatatattttttaagaaaatacttccatcatcccaaaatataatactactatcagtttgtggtaagtcaaacatctagcgaagggagcacgaagtattatatatatatatatatatatatatataactcgatcacatatccgcttatcactactagagaaaccatctttgccaagttggccaaaaaccacattagtcccgatttaacaaaaaccgggactaaaaatgatcttttaccccggttgaaaagaccaacgtcattttatgatctttagtcccgggccccttgcggaccaccgccgctaccgcccccctcgcgggccgccgctgccctcaccttgctttctcccgctgctaagttaaaagaagagggtaagagagaggaaatatgagaggataagaaaggaaaaagagaggaaagggaggagaaggaagttaaaatgagaaggagaggataagggtgagggattatatattatgtattgattgttagtcccag

SEQ ID NO: 58396 - DNA, 562 bp, Oryza sativa
gctcaaagggtgggttgggatctgtgtgacgtgcctatgctggccttggaactctacaaattcttctcatgcgaaaacggactctccggaaaagtcggaatctaaacagaaaagagcagaatcaccaaaacagcacataaacaagcatgaacagtacatgtagatatttttaacatgtagatctcaattttagaaaaatttagagacttgaaccaactaaaactgagttaagatgaattagttatgattttttaaacattaaatcggattaaaacacttatatgggttttaattgaattatgacgcaataatgaattatttttgaaaaggaaaagggaattattgcgtcacaggctagggtccgcggtggaccgggtgcacaggggagactcacggaaacgaacggccgagatcgatcctatccacaacggacggccaagatctgacggtctacgaccggcctacgacggacggcaacgatgacgtcgacgatgacataatcactggcggcggctcgggcacgcaagctcgccggcgaacgacggcgcgacgacgcgaacgg

SEQ ID NO: 58397 - DNA, 18506 bp, Oryza sativa
  unsure (1)..(18506): unsure at all n locations
ataacttatgattcactattatttaatgatggcttaatgatagttcacgatggtcaatcgtgattggttaattaattaaattgccaactaaaacttgataatggtgggttgtgagcacatggttttgttggtcgtgatcatgacaattaaggaccggttcacgattttcggttgtgaaacattaaccgtgccaaccacaagccagcgtgggcaacgactttaccttttgtataacatggttcattgcgaagcaccagactgagaagtggcggagataagcccacgggggtcgctggggagtccatgccttgtttataagggggtgattatgatccaggaacggtgcgctgtggtggattgtgttgtgcgaggggtactgtcacagctcctttccgaggtaccgtggtggtattgaggcgcatggtgacatgtcgtggggctgtgtcttgtgggtacagtggtacacctctggctagagcaaaactattcgaatagccgtgcccgcggttatgggcgggtctgacaatgtctttcgtgattagtctcacacttctcatcataataaaagatgctataactggtaataatttgattagctcctggtttggaatggttaattcctggtttggagatagaactgtgcagccgggatggttgttcagaatggttgggcctaagcaacagggtatgttgtatagcgttggattaatattgtttaattattacttaactgttttattaaattctgaaatgtttgttaaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaagattaggtgtagccctggtcaagctgcctgtggagtggagtcgtctgcgccgtttatcttattttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaattggtattagagcctcctcagcagcttgcagaatttcctcatgctttgccttcccatcctctactcctcgattcagatctggaggtggcggatgtggaccttgcggctcttgtcgcccaatctgcaaagggcggatatgtccccttccccctgcgtctcccctccagaatcgattaggcggcttgaaaggtggacgcggcctccatcctccgccctgatttgccattggagagccgcttcttaccaccttcgcgaaactccggccgtcccctcgaacactcgccgtccactctcgccgtcgcccaccaccgcctacccttggccactcctccacttctctcacctccccttgcgtctcccccttctccaatctcctccacccgccttggaaccctagctcctcgagactagctccccacaggtggtgtagaaacggagtcaggagagtcgactcaatggtgttccaccgatctccaaaatcgccatcgttgaatctcgacacgtgttgcccctccacctctctctcccccactattggatcgggccgaaaaccatgggcttcctccctcccctgatcaaaaactctctcgcgcgccgaggagcactctcccaactcccgaaggccatcccctccgccacgaatcaccaccggcgatcgtcggagcgccgcaggtgactccctcgtcgtctctcctaggattgaagagtttctgacgccgcgggtgactccctcgtcgtcattgattagtttctgacgccgaattgaagagaggattggattactgctggcatatgaagtgaatcaatgcaatacgattcgtaatgagttagcatcccaactgcagagacaggtcacgtatatacgtacgtatgcaggccggcctacttccaaatccaaattccaatacgattatacaattcaccgattgattgatttaatttcttcctgcttcaattcgatcgatcgatcggcgtcgaccagaaattaatcgatcgagtctatctagggaccaatcgaattcatcgagttcgctcaatggcaactgctgctggtagatatgaagacagcggagtcagtgtctctttccggcggaaggcggcgtacacggcggcgtcgctgcttgtcttcctcgtcgccggccagctgccgctctatggcgtcaagaagtacaacggcgacaaggatgtcccggatcccttgtactggatgaattgcatgtttgcgtcaagcaataacaccctgatgactcttggaatcatccctcttcttctctccgagatggccgtccgcatcttctccgcactcatcatcaccaggtggccacccttccatcatgtgcgcctgtaagctactccctcatcttttttacagtacttacaaaaataatggaaggtgccatattctgtagcgtaaaatctggtatctcttgatacctccggtagtatgagtatcgctccacagagttcgaattcgttttttataagttgtataataaaaataacaaatataaccctaaatatctgcatagtagtttagtataattttgtttaacttatagaaatcgaatttgatttgtatatttgtaaagtgatcgatgtatctcaaaattgatctatcttatcaatttttaaattattttttatcatttaagtggcatgtaaaaacgagaggatcctctcaaggatgaaattccatctccaatattagtaattgtttttttttggaactaacatgcatattaattttgtttgattaactaacatgtctgcatggatgcgtcatgcttgctctatatattgtggagattatggataccccatatctacatgacggttgtaatttagccggatatacggtaccaaatatagatggaatatctctataaagactcgggttaggttctaaacttatatgtcaaggaaatacccgggatcttagtcggttactattgtattttatctataatcccatattgcgttaggatatggactgtattttgtaaagtggactccttcccctatataaggagggtccgtgtgcctcttggggggcgattctttttccagtttatacaatcaataacacactcggcggaatcatccccggacaggagtagggtattacttcttgaataaaaaggcctgaacctgtataaaattccttgtctccaaacccattcactttcctagcttgatagctacccccttttattattgtcgaaatcttgtttcgacagttggcgcgccaggtaggggcagcgtcaagttatcgccaactaagtgcgatgggtttcgtttctggcatcgacgacttcgcctttcctcccgggtaggcgttccggttcggcagcctcaacttcatcaccaacgacttcggcaagatctctctccttgactcggattcaaaccagtcggggagagaccaggtccccgtgccgttcggtattccgaactcggccgaggcctactccaagatcatctctcccgagtcggcttcaaaccactcggataagatccaatctactcttccgcgaccagatcaagacgacgggtcctatccctcaatcctgatgaaacttcctgatgatttggccgctgtcttcacagtcaggacatctcccactcgaagatctaggcgagcttcggccccgatccgatctagatccagggaggttggcgttatactccaacctctcgggacagtctcgacggaagagttggatggctacctcagctcccccggcgtcagttctcgaccaaccgagatcctcgactacgacgatttcagctaccactacgaccacggcgacctcgacaacttcgacgacagctatgaggataactacacgcccctcttcttcggcgtattcatggctgacaacgaaacggaggaacagcgccaagcccaagaagcggaccaagatcgcgcacggaaagaagctgaacgtcgccgactggaggaagagcgacagcgacaagagcgagaacgactacagcgtgagcaacaggatcgcgaacggattgcaaaagaggctgaagatcggcgacaacgcgccttggaatctgggcggcgagcgagagagctcattgggcaacaagacgtggctccaatcggaactggagaaagggaaagaagccagggccgaagttgatcgcttgaaggccgaactggagaaggagaaggcccacaccgccgtgctcatagattattacaatctcaccgagccgaagatggaggctcttcggcaggaggttcgcaaggccgaagcaagcgctgcagaggagtcgcggcggttttcatgggagatggtgaaaaccaccgagtccgcacggacagcgtgacaaacgcttcgcctcgcccttactgacatgggcgcaaaagtgcggggtgtcccctccgaagatgcatcagccttcgacttctccgaatggacccaacaggctggtggttcagtttctgactgcgccaccgcatacagcgattgctgtgcacgcgtgtcagcggcctttaccatgggcctcctgcagcagttcggctgcgagaacatcgccgagtttcccaagtacgcaaagggggattgggaaatcagtgcgcaagacatttcgcccgcgcttcgtgcgtggcgaaaacaattttggcagaaggacgaccgctccgccgctaaggcgcaccttttggcgcagctggcgaaagcagaggcggtggacctttgtgaagatgaaggcgcggcggctggagggggtggaggcgatgcccgggaccacccagaggtgtgaggccctccgcccttctcttagattttcatagttttcttttggtgttcgctagatgtggcaaaccattgtatattcggcaaacttccgctaaaccttaaaaaaggctttttggtatatttggaatgtatgacacaatcttaattactttttgatgatcgaagtctttggcatatttttatttcactcgtttcacattatgccataccttccccttctttcgcctattcttaccatgcaaaatgtgttttgccttttctgcactgtctaccagggggtctgctgaaaatcgtgcattcggcccccttttgggagctggcgaggtcaaaacgagaaattcgtggcattgaaggggctgtcgaagacgcgatgtccatttcggccattttatcacgaaatggagataaacggtcgcagctataaggttatcaaggttgccaactggctacgtgcgcaccccgggtgaaccttagaagattacgatcttgttcactcaagacatttggaagatatggctcgcttttggcgaaaccatcagaagactaaacgccaggaatcgatctctcagcgtcgttacagtttagtctgtgtttcgccccctactattcttaaggttgtgtatgatattagtagtgatgacgaacctagttcgtccgaccattccttagggagggataatgattactggggcgaaaatgtaatttacttgtaaaatgaattgtatcgggttgtaaaccttgtattcttcgattatttttttgaagctaataaagaacgtgctttatttccttttcgctatttttcgcatcgtcacattttgtgcttttgttaggccggaacatgccggcccctttgcatatattagcgaaataggtgtactgacttttcagcttttcgtcgttcattttcgatctgtagcattctgtgtcgagagaaacgcttttgcttttatgttgatcggtcgtaacgtcattcggctatttattttccgagacaagctgttgcggtttcaacgttcggcgagcaatgcttcggccgattcgtttcgcccccctggcatttttcgctgatcaggcgcttgccttggggtttttccacaaattatcaatcacacgaaaagaaataaaaagaaggcggaggacacagagattttatactggttcgggcctccatggtggataatagtcctacatccagttttttttttctttttctcttctctttttttctttttttttcttgccgaaaggcttacatagtgccgaaaggcttacatgacagtatgtacatttttacaagttggcgatttgggtgccacccattctagacatagaagcgcttgagggaggcgacgttccaggaatggtcgaactcctcgcctttgagtgtcgctaggcgaaaagatcccgtcgtggacttgtgtttgatgatgtatggtccttcccactttgattcaagcttgccaaccgctactgggttcgcctttttccttaggacgagatgaccaggcattagctccgtgggtcggacttttttgttgtaagctgccgaagtgcttgtggcgtacttgtgcatatgctcgagcgcttcgacccttacaccttccaagagttcgagcgatacctcgcacccctcttcgcccctagagaacataacccttggtgagttagcccctagctccgctggggtcattgcctcatcgccataaagaagcataaatgagctaaacttggttggtcttgtgggggtcgtccgaagggcccaaaggaccgataacaattcttctggccatttgcctttcaccgccccctcaagtcttttctttagtgcttctaggatcttgccatttgtacgttcggccgccccatttgactgtgggtgcgcgaccgacgcgaacctgatttccaggttaagcccttcgcacatttctctgaacttatcagagtcaaactgcttgccgttgtcagtaatgaactcttttggcactccgaaacggcaaacaatgtttttccatacaaacttctgtactgcggccgaagtgattgccccaaggggttcgacttcgatccatcgagagaaatattccacagctacaattgcgaatttatacccatttcgcgccactgggaatggcccaataatgtccagcccccatctggcgaagggccatattggtgcaatgggctgcagatcatactggggcacggcttggcttcggccatgacgctggcaactttcgcacttcttgatttgctcaacacagactttcaacacagtgggccaataaactccttgtctaaatactttggaggccaccgttcttgcagcctggtgcgcgccacatagcccctggtgtatttcctttgccatttcttcgccttcggcaaaagagatgcaacgaagtaagggttgaagtaccccggagcggtaaagctgacctgagaccatcttatacttcgtggctctgtgttgcaaacgcttcgcttctgcttcgtctaccggaagccagccagtttcaaggtgtttcaccaatggggttcgccagtcatatgggtcttcgcccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcgttctggtctctaggcaagtgttcgaccgttatgccggtgaagcatttttccatggaccaaacagcctccagatacctcttcattccctcttcttttgcctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcaatctcgccgcgtaccaaatcgacacaccattcggcgaaaagaggactgccgcaacgcctgcagaaccgtcagagcacatcacccagaactggtcatcgggctcggggtcgggggcaagtactggtgtccattcagctacgaagtcagctagcacttgagacttgatagcagagcgtgcaataaaatgcaagtcgaacggggatagctctgccgcccacttgctgagctggccagtgacttccttgcctcggagtatttcgcccaaggagtactgtgatgggactatgactttgtgggcctggaagtagtgcttaagcttgcgcgaagccattactagagcgtaagaaagcttttccatttcaatgtaccttgtcttcgctccttgcagtgcttcggagacgaagtagaccggtttctgtccggactctgtttcttggacgagtgcagcactgactgccaccgacgaagctgccaagtataatagcagttcacttcctgggggtgggcttatcagagctggcgggctttgcaagtattgttttagctcgtcaaatgctgcttggcactctggtgtccaattaaactttcccgcgccccggagggtcttgaagaagggcaaacctctttcggccgccgttgagaggaatcgactgagtgctgcaattcggcctgtaagcttttgtacttcatgtacgcttgacggaggcttcatttgctggatggcatcgattttctcgggattcgcctcgatgcccctatcggaaacaaggaaacccaacaacttgcctgcgcggacgccgaaaacacacttctccggattcagctttatgcctgccgcgcgcaagctgtcgaacgtctcttgcaggtcgaacgcatggtcgaaagccttgcggctttttacgacgatgtcgtcgacgtaagcttccacgtttcgccccagctgcttgccaaggaccttgtacaccagcctggcgaaggttgctcctgcgttccttaagccgaaaggcatcctgaggtgacaaaatgtgccaaatggagtgatgaaggatgttttggggatgttgagcgggttcatgtggatctggtggtaaccggaatatgcatccaggaaagtcatgagctcgcatccagctgttgaatccacgagctagtcgattcgcggcaaggggaaatcgtctttcggacatgccttgttcaggtctgtgaaattgacacacatgcgccatttgccatttgacttccgcaccagcactggattcgccaaccactccgaatggtcaatctcttgaataaaccccgcccggagtaatttttgtacttcggtcttcgccgcttcttggcgatcggcagacatcttgcacaacttttgctttcttggcttaatattcggcttgactgctaagtgatgcatgatgagatctgccgggatcatcaatctgcacttttgttatcttgccgtgaggggtgggcttcagcatgtgcttgggccgctcatgcggttcggtctcaacattgtgcactgctctgttgattatggctagatcgcgttttgaagcggccgaaggctgaagccccttgactactatcacccctgttgggccaggcatcttgagcttgagataattgtggtgggaaatggcttcgaacttgttcagggttgcacggccgaagatggcgttgtagttgtatgggatgtcgacgacgtcgaacagtatttgctcttcgcgcctattttctcccgagccaaaagctatcagcaaaagtgcttggccaagaacttgcactgcctctccgccgaacccccggagcgacgttggtgccggtgcaagagtttgggttggcaagcccatcttagcatatgcttcggcgaagatcacgtcggccgaactccctccatcgaccaggattcggtcggacttaaaaaccgctatctcagctgagattacaagtggatcttgatgcgggaacaggacttctttcggcgtcttctggcccgaaagagatcaactggttcacgtactgtggcgccccctcacccggcgaagtgatgctgtggaccatacggatctgcatcttcctctgccgtttcgacaacaggcttggcgggtcagctcttgtaatcacttggattacccttcgttgtgtatcttggcgttgttcggctaggggtatttgctcctgaactgcttcacggggtgcttcgactgttgttccttgctgcggccttgggtcttgcgcgttgccacgttgcctaatgtttaagcattgctccgtggtgtgcaaagagcgtccgtgaaaagcgcagtagaggtcttttcggaccttcttgcgggctggctgctgatggttgcttgcttgctgggcgtcgaactccttgcggagggcttgcacttcttcgacagccatcacagccttgcccgcccgatctgttctgaactttctccaagtcatgggggcttggccttgccttggcggctgtccctggatcgccggctgagactggcgaactgataggggaggtggttcgacaatttgaacttgtgcttgagcttgagcagcggcgacgaaggctttatcgtactcagcttgtatagcttgccgtcgcttagaatcctcctcgccccttgcgaacccgtcagtgatgcgaagtaggtgctcgagcgtctgcggctccttgttggcgatttttcttgttagttcgccctcaagcagaccggccgaagcggcgtttataaccgacgcctcggttatgtcttgaacttggcaccgggcttgcgagaagcgacgcatgtactcccttatcgactcccccggcctttggcgaatgccaagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattaccatcgccttggtattttcatcaccatgagccgcttcgatcgctgactcgtagatggagaggaactccttcgggtcagtttcgcccgaataacgcgggacaggtgggaacttgaactggggcgggattggacgagtcttgattcccccactcagcggcagccccttttcgcctcccgccctgtttaccgcaccttgctgcgggtacggtgtggcgaagggcgaaatcgtggcttgtgcgtggagttgggccgcggcattcgactgcccggctccaactggtggtacttgctgggccgccatggatgggtcaaagattggctgcgaccacatcatggcagcttggattggtgcttggtttgttccgaagcctggggttggaacttgctgccaaacggttggcacctgagcagtgttgccgaagtcgaactactgtccttgactccacggcgaaggtcccgagcctggctgaatcggtggcaaccaattaggcgcaccttgacttgtattccccaccgggtgagccgatggggttgtacttgaaatgtagtggggttggttgagttgctgaaggaaagcttggagttgcgcctgcagagccgaagccccttccgccactgtttgtgtcgcttggccaggtggttgatgctgcccgacgaagtacaccggcggctgtgcggctagtggcggagagggctgggtcaccacttgcggccggacttgagaaggggcatagcctgccgaatactgaaggattggagccgacgtggccttggtccgccttgtcgcctcgtatgcttgttgttgttctagcatttggcaaagcatgtcttggagccgtgtcatgttctgccgcatggcttccatgtcggcttcggcttgcgcttcggggtccaggctgatttgggcctgtacaacggcgagcgcagttggcgccgccggctgtgatggggcggcttgaggcaccaccagttggtttgtcgaaaggatctccgccctggtctggagtgctcttgccgccgcagccgccttcgccacgtcggccgtgttcggcacttgcactgaggttgcgggggccgaagacggttgtgatggcgcgggggccgagggcgactgtgatggcgcttgtccttctacatcttcggtcacggacgccgaaggctctgctccttcctcggcggccatgtccggtccggcgtcgctctccttccacctgacgaccttctccttcacgaccctcttcagtggcattcgctctcagtggtttcgttcggactccccatggtcggcgccagctgttgtcgaaacgacaactgcgtacgtcgaaggacgtggttactcaacagtggttgggaaaatgaagtgtactaaattttgaatttcacttgggatcccccgttacatggcctagggggctatttatagccctattgcaggctcttactactaggatctaggttgtacaggggaatttacatgattacccttatgaaagggacatttacaggggtacataatgttatagggtctcatgggcccctgatgggccgtctagtgatcaccggcccttaggcttgatgggccggaaaggcttcctcggcccttgcgggggcgaacttgccatggcgaagtcgtcttccttcggcagatagtcttcgccttgcacccttcgcccgagacgcccctggcttggcaaggccctcgcgcgactcttcgcctcacgccgttcttgctccatagccttcgccacgggtttcggcagatctggtcgaagagcctcatgccatccgccaacaaacgtgattttagaaacatttagaaaaaaataatctaatttggagtttatataagtgcggtaaacttgttttaaattttattttaatatacagctccttaagacgcccgtatgtaaaaatgagtttatttttgcatgcggaccttttaagaggcccgtatgaaaaaatcaatttcttaatcaaaattagctaactattgcaagaagaggaataagtctattttccctcgctaatgtcttactcttgattgaatcctctccctcaaccacaaaattggatataagaaaattactaacactaaaatttagaaatgttgatatgttctattagaaaaaataacgagctatatctcttccttgatttgagaatctcggtttgaggggttttttactttgatatttatttgttaccgtattcgttccgtttcgtattcgctccgtatatgtattcgacaatattcgattccgttttcgtatccggagtttccgatttcgattccgattccaaaaagaaaatatgaaaatgaatatggtagagctagtttccatccgtatccgttttcatctccaatgacatcgatcgatcggtagccagatttggctcctttttcttgtgcgcgcgcgggggatcttgttgtcgagtcggatccgctcacttttgatgggccatatgaccatttgggccagagtaggaaggcccattttggaagaaagttacacctctatttggaccaaatattctactactatatactacggtgtatacgcatgcacagtgtacgtataccttatgcgtagttttagccttagaattactttatgcgtctactttgccattttagtttttttaaaaaaaaaatcttatgtgttccgtgaactagcaaatgtatgtgagtttgaatggcaagtggaggttcgctgctggtttgtgaaaacgctaggggattaattaatattgccaagttttaataggatttcttatatatttatcaaagtttggtaagaaactaaatggatgcacatctttaataacttttatgaaaaaatgatatggtttaaaataacataaatatggacaacccttagttgttaattttattcacctcatatataaaaaaaatctagataacggctgtaggaataggataacttgaaaggtatatgttatttccatcaaaacggttggacaggcatgcggcacgatttcctactaagcggtaggcggcggcgggcggtcggctgcgccctcccctctgccagagggaaggcgggaggcggcagcggcagcggtggattttgtttgttctttttttttagaatttgtgattcatggtatggatctgagatatataatctgtgatgtatttgatttgtgatgtatttttttggagaattttttatatgaacttatgatttgtgatgttactttgattttaggatatgtagggcactcgatttgggaaaatcatgtagggatcaactcgaaggaaaaatcaaaatgcaagcagcaaagaaacaatgaaaaaaaaagaaaaaaatgatgaccaaccgggactgccactaccatctttagtcatgattggtaaacatctaactttagtcccggttatttcacccgggactaaagatggacgaccatctttagtcccgggttgcatttagtctcggtttgtaatataggactaaaggggttgtaaaccaggactaaagaagagttttccgggagtgaaagtaaacgatcaaatatattatttgaatgtatagcaatgcattggattttcagatggaccaagcggctagtaaattaatcagacaaaagtataaacgtgatttttttatcattatttgaacctttttaatttttaattttaaaataaaccatctcaaaacttattaccaaaatctaaaacttttggtgtaacaaaacaatactgccaccagcgggtgtggcagtttgccatgacaacgccatgctgttacattagctataccgatgtggccaaataacattgctacgtcatccacatcgatatgggagtattattttaccacgccagcctatcttatactgtggtagtgttgttttgtcatgttagtctgactggcgtagctaatgtttctgattttgaaaattagttttagaaaaatttattttaaattaaaaatttaaaaggttcaaaaagtaaaagaagttctagaaacatgttgtagacacaaaattaacacgcgttattgattgcttcaatttcatatctagcgccaacatggcagcatgattaatgacgcattttccttaatcccctttggcaacttaattatatccaactaaaggataaaattcaagtgaggaacgaggatccccaaaacttagcgaagaaaattatcaccagttatttctttttaataatgaaaatgtattacatctctgccatctgtcataaggcatgcaaccaattagttcttattaaaataaataaaatgagttgtgggacaaatctccagttaccttgaaaaataaaagcagatgacacactaaaatgatcaccagttaattaattactagagaatggaacaatatatacctccaaaattatagtacgtcgtgttaaattatacaaagacatacatgtgctccatgtgccacactagttgggagctgcttctttttttatttatttcttgtgaagactgagctgatagattaattagtcctcttattttgtttatttcagtttaatcaaggattaatgactcttcagccttgcaaaggccatcatatcgaattaatgacccatactatttttaatcgcaaaaaaatgtgaaaggaatgatcgatcgatatcaataaaacttaaggtttttgtataccatttcagatgagctgccacgtgctaccttgctactgtagaaactacagtccttgcatgctatccacaccgttcgattgtggctgcaagcatctctgcccttgagcgtgtcttcccagggagcctcggctgctctccaggggacccccatttttttccccatcggttgattcatcccccagcttctctatttgcacgcagttcacacgcttcctccgtcgatccatccagcgccgccggtggcatcgccgcctcccttgcccagtgtgttcttgcgtcttctttggcttagctgtggacggccgtggtcttctgctcggtggcttcgtctccaccatctccattccatccgtcagaggctgtcgccgtccgcgagtagcagcagcctctcctctcccagtgacagtccagttgcgccaccaccgacgaccttttgccttaccggttggttctccggtgcccattgccatcgtgtgcgggagcaatgccctctttttcccacggcagtccaggcaagaaaatccttctatccccattgttgtacagaagaaacccttaggcctttagaaatgtcgttctttgatttattatgtaccattgtgacagattcccttaacctgtatttttaatggtgcaagttacttattatcaagcatgtgattcaataatccctactgattaagcatttaattgaatttagcctgctacagtggttatgggatggttgcctgctgcccccaagtccacgacatacacatattaaagttgtccatatttaggttcatgcttagctttccataatactccattgtgtactcatctgcttgctttatgattttgttttgccattttgtataaatatctaggagtggtttggtgatggggatggatgcggtgcctgacactctaacaccaacaccattttctcagctaacttagggacaaatgagacagagaacaggccaggtgctactcctacacattattcggcatattcaactttctttgctttttctcaattctcaactacagttttcttatgttgagcggaaaacttattgatgatttatttctttgtgttctaagtgctccaagcagtgaaagctctaaccctaccatatcttttatctcaactcctgaaataggaatctccatgtcagtgttttgtcgtccatttcaacgacccgttaacaggaggcttgcatttaaccctatcaatcctgctactccaatagatcaacattttgtctcctcatcagatggcccaacagtgccaggtgttcagtcccttcctgcagtgcgcggtaaaggtaagcccctctattaagaattaatctctatttgattgtgctcaagcttgctatactaccattgtatcattttagattcataaatgccagttcaggtacctgtgcnccatagtgacatatttgttccctttgtgtctgctcatataaaatttggatgcttctcacattggcataggtcctttggataatattggtttgagactgcctcgaccagatccatctattgctacggaagcacgcaagaagcgtaaagtcacaatggttttaaggagaggacataagttacccatatccaatattttctccttcaactaactggcttatttgttgcttccattggttcctacatttctatttgatttcgttcagcaagtgctgattcgaccaatctatagctcctcaatttgtgattgttacattaggagctggacctgatgatttctcatcttcatatcgatgtgttcaacgatgtatttccccacaagttaatgccaggcattgtgatgtgcggatagccaggaataatgggatgagtactactattggcgcttctccttcatctcacattgcccaaaatgacacctccttgcatagggtgaatacatgtcaacgaagccgtgtagggcggtccagagctgatggtaccttatttagtttgctatgatttttccttatttttacctgtttgggaatatgtgattacatttggcattttctgctttctaggaaattttgtaccccttcttgccagtcgacatcgccgtaagttcttttcttgcacatgctttgatgcactaaatttatacataacatctgcatgctcaagacttataggggtgttcccttattattaccagctgatcatgatgctgctcgatattcaggctcaacctccacagttcatgttccgaagtaatttttgctgctcaacactaatgttctatctcgatgatcgtaaagcttctcgacaataatactccacccaatgatcttttttctatggtgaaaccacttaaccatgttctaatttatattatatcatccttttacaagattttccattctaatttttctcttattcctttctattaggtactattttcacacctctcaatttaggaggccctacccatacttgccaacattgtggtgctcgattctggtatgaggaacgcgtacgtgggtgtggacgaacagctttgcaaatttacaacaaatgctgtagaggagggagcatttatttgcctccatataggccaccaccagaacctttgctctctcgtttaactggacgagatcgtgttttgtccaaccacttctttgaaaacatcagacgatacaattctatgtttgctatgacatctatgggtgtaaatatcatcaactcaattaatgatggtcatggcccttacattttcaagattagtgggcagctatgccaccgaattggatcgcttattccaaagcatggtgcaagaccagaatattgtcaattatacatatttgacactgagaatgaaataagaaatagagtggctgttgcttcacatagagagatgagttttgaaccaaatgaggatattgttgcatctttgatgtccatgctcaatgcacacaacccagttgttcagctctttcgaactgctcgtgataggctgcatgatcagttaggg

SEQ ID NO: 58398 - DNA, 15277 bp, Oryza sativa
agcagcgggagaaagcaaggcgggagcggcggcggcccgcgaggggagcggcacggcagcggcggtggcctgcgccagtgcggaggctgaggccggcgcaagagagagggccggcggtgccagctctgtgcgcaggtggttgagcgggagggcagtggccgcgcggagttttttatcagtgatgttttgttgatttgtgatgtttagatttgtaaatttgtgatgtgaatggtaaatttgtgatgttaatctgagtatgttcatttgatctataaatttgttgaagtttttgtaaatgtggatgtttgtttttgagtttggaatgaaatcaatatgcaaacagcaaaaaacaatgaaaaaaaagaaaaaccttttgtcccatttagtgttatcaatagggactaaagatgatttttagtcccgtctatttcaactgggactaaagatcgctatctttagtttcggattcgtagccccggtttactacccgggactataagaggttgtaaaccgggggttagagagggtttgttcagcagtgtgtaattagaagtacgggtttaagaacatgtggttgttgggggagaatgtagtatgaaccataaccatttgattaccgagaaaatttgatctttttttcagttcattgagaccaaattatcttctatgccatccaaaagattatgaattctaaaaatggacagagggcggagggggccgctgtcatcgcattcgcccgccaccgctgctggagcccgcgcccaccgccgtcacccaagccctcacccggccgtcaccgctagagcccgcgcccgccatcgctgtcggaagggaggagagagaggagagaagatgggcagatcgaggaggtggttaaggaatcgtatgtgaaaatgtaagtcgatttttacagacgtgaccagcagttatagtttgtctatagaggtactcgtacaaaaaaaaattatttttttaagtagtatatgttaaacaacctaaaataactcacgttaatggacgtagggagtagctgattacctaatttatcctacgagtgaactagaaggtccaacgtctatagatgctagcccccctgtacgcacaaaccgtgtgatctgagccgtagcctacggctgtgttctaactttttcgttatataaactatttagacacatgcattgagcattaaatgtggacgaaaaaacaaattatacagtttacatgtaaattgcgagacggatcttttgagcctaattacgctatgatttgacaatgtggtgctacagtaaacatttgctaatgacggattaattaggcttaatatattcgtcttgcagtttacaggcggaatctgtaatttgttttgttattagtctacatttaatactttaaatgtgtgtccgtatacgtcaaaaaaaatttcaccaaaaacaactaaacacggcctacccataggctatagctaagccttcaatgttggaaacaaggggacggacggaatttccctctcttgcaccatggtgatgaacaaccaaaagccttgatctgaattgaaagccgtgtttccatgcacatatgaaaaaaaaaaactaacttgatttgatacatgcacgcgtattacgcgtactctcctttgattctttgacccatatctaactctgcttgcaacctatcaatgcaatgtgctgctgctgctgctgcaagtgttcttgccttgccacttacgtggaagaaggcgactgaattccgggaggtgatctgtgtctcctgcacacgtacaggagatttattgggcggacaggagagaattcagggctcttctttttgcatttttgcaagcctttcttcaatgcgttttccggtcgtcgtcggttgcagttgcgtcgacatgacatgaccactttagtcttagatatattttggccaaaaaaaaaaatttcttcctccctgacgaaaaaaatgggtgacagtcgtttttgttgctcacagactcaactgtttgggaccttcaaattctgagcaacattcgcgtaggaatctgaagctgaaaattctgacttacagatcatttttttcaagtttcacgactataagttttatgattatatttttttttaaaaaaacctagatgaaaagctgacatgttttaaaaagttcggactctttaagaaagtgcagctgataggaactcttttaatactatcttcggtctaaaaatcttaagacgttgtaatactatcttcggtctaaaaatcttaagacgttgaatctggacaggggttcagttatggtccgttgtccaaagatgaatcaaattttatcgtaactactcaatattttgtgacaatgaaagtaggttctaatctttcttcacgtcagtttcattggaggctgaagttattgaaaccgtctgcaatatttcattagttttttcccacccttttttcctgccctggtttaactgctcgattcggaggccaaatactggagtactgcgtactgtttgtgcaacagagcagagctacactagtgttgctttactcgaggacaagaaaaggcagcaggccagcagccagctactactagcagcaacctgttgttgcacaggatattttagaacaagctgtttctagcgtcccaaaattcggatatgtctgaaatttctcatggagaaggagaaggagagagatgggttaatagatcgattagattgcctttcattaatggtcccggttaatgacagtacgatatggattgtaggggtgttttcggtatttcatcattacgtataacccactatactctagaaatagcttatattttacaagagtaggggtgtttttggcatttcatcattacgtataacccttgatgctctagaagtagcttacaatttataagaaattcaaacactacaaatagctatattttttattttaagacagcgagagtaaatgtttcattgtaattcctgcaaaagaaaaaagaaatattgctctcaggtagcattactactattacatggatgacaattaaaagaaatcaataatgaaaatcaatcgaacatatactccctcccttcaaatataagcatatttagaatttaaatttatacataatataactatttatggaacattagctttaatgtacgagaatccaagcatttttaaccaatcaggtgcttagagagatcgaaacaatttaaaattttaactaattaataacgtgactaaaagaaaatcgtttctgttattttaacctttactaagcaatctagaaatgcttatatatctttctacagaagaaatgagaaagagagttagttgattaagtgagcatgggtcagtcaaatgtctactcaatagctttcgatgtagaagtttaaattaaaaaaccccaaaattgtcaccatgcatctcagaatcaatctcatctcatctcatctcatctcacttggcttaggcattgtttagttcctatttttttttcaaacacatcacatcgaatctttggataataaaaaaagtaattgtacagtttgcatggaaatcgcgagacgaatcttttgagtctaaatagtccatgattagccataagtactaagtaacccacatgtgctaaaaggcgagttatgaaattagttttttttattcgtgtccaaaaacctcttccgacatccagttaaacgtccgatatgacatctaaaaattttattttcacgaactaaacactctcttaaatttctttctccccaataggtaggtatagctagctggacaaaacaagggtattcttcaggcgcgaatccccgcttgtccgtttgtctgaaactctgaatcaatcagtgcgcatacatgcatacggacaaccctaataagcagggtaatgtagctacaaacacaagtcaagaaagagatcacaactgtggtccattccaacatgcaactgtcatatatatagtaattcagcggtccaaaaatacgagggattatattttggatagatgtgacctatcttattattacgaatatgaagattcataatatcatatgtatcacatatatctaaaatcttttatattttaggatggaggaaatagcgtgctgtcacagtagaagatttgagcaagctagctagcctccatttctattcaattccaagtgccacatgctgtgcattgttcgtgcagataactgtgtgcacattatggtggtgtggtcactgggcaaccattattttcagtgtatgtgtatccatcggtttgtaattgcatatgcggtgtattaggaatggtactgtgtttctgaatttttctttccctggaccctggaacataaattattctttaagttgtcgccatgctcattattatgagtttttttatttttaaaacctttttatcaatatgttttaaaaacaaaccctaaaaaatattcaataattgaaaaagaaaaccactaaaaaaatacacaacatatgaaaccaggaatttaggtaagagcatctccaacagcatatctatcttactctccaagttaaattttagtaattttggatgaaaaacacactccaacatacttgccaaccggatggccaagccatctggttcgccaaactcctccacgcgctagccaaagttgccttgccaatcgtgggccccatgcgtgggcccacgaatttttcctctctctctcctctcccgtactgtctccttcccagatcgagcgccgtcgacgccgtccatcagctgtgctaccttgttcatcaagccgtcgcccgccgccgtccccccgctgtggccacgagctgctatgacaccagccgctgcgccgtcttccgttgtggcagccaccatcgtcccgctctgctccggccgtcttccgcggttgcacgagccgccgtcctcatccttcccggggacaggagggagggcgcgatggccggggtgcggggagcgagagaggtcggcgaggaacggatccacgcctgtcgtcgtcggcatggccatcgcctcgcgcgcccgtcaccgttcgccgtccgagcgttgcctcgcctcacctgtccgtcgtcatctaccgtcaccttacacacacatgaatccgctgtcgccgcggaggtagagggcgctgggaggagctcgtggcagtagtagaggaagaagggagcagtatgggtggggagaaaaaggggagaaagaggaagaagaaggtaatagaggctaacatacgggtcccgctgccatagatttagaatagagagtgtagatagagaggttgttggagtgatcaatgagtttgacttgccaaatcagatggatagttggctatataggtgtttggagagtcaaatttaagtagtctgttggagatgctctagccagcttgggtgttggacgaaacttaaggaagacgctagctcaaaatatatatgaattgtttttgtttgaagactagtttttgcctactaaactgttggcattttaaatagttcttttacaagggtttgctattgaaagttgccaataacatacatatttattaaaaaaaattgatagtggtaaaagttgtcaaggtttcgacaccatttctgataaattggcgggagctatacttttcaatatataaggctcgcaatatctgagtgttctacttggattgtaaccaccagcttaatttctattatcaagaaaaagatacccgagtactttgctttggatgtatgaattttacaggatcatcacaataaacatatcaattcctgtgaaattcctcaaaaatcctactttcgaaatgatgtcctgtaggctatgcgttatgatgtgtttagatgtttcagagttgtgccctgaaaaatggagtcgatcggttcacttgaggattcacgtggacgcttgatgcgtgatttcttgctgttttttttatccaactgtttgtgctgatgttttggtagcacatgtgtttacagtaatggtgattaatttctactgaaagtgaactgtacataaatagtagcaattcaataatgtaatcgcactgcgttatctgaaaaagaaaatagaacggcatctagtagatgctagaactgcaaatcacatgtccttcaggcttcaggatgagtagtgacttctttttttttttttgttgagatcgtagtagtattaattctaccactatagatactcgacagtaattattttgaccaaccagctgccagtgaatttggacaggtcattatttatgtcatataacggcactgatctctgcgaccccatgaaaatacatcagcaaccatttgatactataataacttgtgataataactaagaaacatcaattctttctgatgttaacttatacatttcacatcaaaaccactattagcttgatatgtgcatccatctgacatgttccgtattttcgcggcgaatgaacttgtgagatgggtaatatatcatgcacccgtacgtttgttcctactgaaaaaagtggatgaaaatttgatactcatggcacgctttttaaactggtaaactgtacatttcgtacaaaaacttttgatatgaaagttgctctaaaatatcagataaatctatttttcaaatttacaataattaaaactcaattaatcatacgttaataccactttttttcgtaaaacatttaattattatttcatcttcatgctcgaattggtgcaacaattgttcatcacccatcctttgcaaattgcagaacctatcctttggtggcagagtagcccttttccatgatcattccgatgccaaccaagtgtggatatgaggtggccatatataaggcatgcatgggagagaattttaggtcagagtcctcaagatgccgtgcaacatcagatcatgagattataatcaatcgaccgtatgctttacttacttaaaaaaatgttactgtacaaaactcttaggaataaagatctcaacagttcaatttcaatgggtaattatagaaaatcaaaagtgcaaccatagtacgcgacattaaacatactcagtgaaaagtaaaatatgtactatatatataatatgtactatatataaaagtaaagtagaatatgcaagagaactacgtatcattacattaaaaataataagatttaaatatttacgtgaccccactaactaccgtggtgacagaaaaggataggaaaaaaccatccaaatcctccaggaccaaagacactgagataacaaaaagaactctaatcagtacatcacgaaaacccttcctccagctaagccacgaaaatccttcctccaaaatcaatacatcattttgtataactaccctagagcccgtgcattataacggaaaacaaattgagtttctagcttattgaattaattaattagtctaagtaattgtatgattttttttattgaataagtaggtgattttgaaatttggggaaaatgaataataaaatagtggaggatttgttgaaaggtggtctaatagtatagattgtaaggcctagctgttagtgatagaggtggtgtggaaataaacaccaccactacttatattttaagtagtatatagatcaatatatcaatatttccttttccatgaaatcaatatattttactttatattgaaaacactatagggtttgaccatgttttgcaccactaaacacgtcattacatcagtttgagtatcttacaactttttacactatactaaattaaacctatctcatcacaagttcataaaccactaattaatgcaatttactttctaaattaaatcccccaaattgcgtgcctctaatcgaacaaacctaaccatgatctgatccaatattattagttcaatccagtttgccaagatgacacagctagcgaacacacaccaactctacaatatgtgttttgagatttacaatgttcagatgctctgcaatatttttaggccagatgccagtgttgtctgcattatgtcccaaagtttccttttcttctactcacctttcatcacttcttttctactactgctattagattttttttcccctccaaatccctgggtcccacaacggatgacacgttagtcaagtggcatttgtctgaagctaaggtacacttgcacaagaaatgcagccattatttcttggccacattaagaggacttaattagatcgtcgtttaagtttaacctcggcgtcatggacgaaatcaaggaaatgcgtaaggacatgaaatgctacaaaagaggtggttgggaataccctctcaaaggttgcaacaacaagcccccatttttatataaagcctgcaagcctgtgcctgcctgcctgcctgctcttgttcttgatagatggggcattggatcacgttctgtttagcattagaattaatagccttgaccagaccagagttgggttaattttttttttctgtcatggtgatgtaatgtgtgtgtgtgtgtgtgtgtgtgtgtatatgcctcagctcagctggatgaagattaaattggacaagaatttgttttgtgtcattttttttttggcatccattgatttatgaatgtgtttcagtcttgacaccttggcaaattcgacaagttttaggtgaaaattgacgtgcacagtactataagcatatagttgcaggcttgcggcagatttttgtgtggctaagcatttctttccagtttgatggccgaaaaattcagttaggaaatacaaactgaatttttgatagacacgtcatggatactgtttgtgaattggacccgaccaaattctggttccgcacaagtggtcaagcctagcttttagatcaaagaatttgaagtacaagatttcgtacagtagaaagtacaccactactctttgagattcataaatagtatttgacatttcgggcaggattcgatcaaattttcaaattttctattaaaataagtttataaaatctaataagttcatgatgttataattgtacttttcaagaaaaatatatacatatatcattttgttttgtttttaaactaagaattttgagaagtaccgatgattgaaaaattaaaagcctgactgaatcttgccccaaatatgtttttttttaccagagagagtataccaccttattcaagaaatcaatctgatacctttcaagtgctaaggtactaggaggcgccataatatgctaacagtaaaatgtgtgacaactcccgatattgaagctcctccatttcatgataatccatataattctctagtttctttcggtatggaccatcaaaaagataacagtgaccttgcttgttataatgacagtatgaaattttgctaagcttgagcaacacattttgacgaagtgagatgctcaaggtcgctcacaaggacaaaacaaaaaatagatacactacctctgtctcataagtgtagttgtgattttctgtgaccaacatttgaccatccattttatttaaaaaaattatatatttttttaaaaaatagttaccataaagtactatttatgttttatcatctaataacaataaaaatactaatcgtcaatatttttcaaataaaacggacgatcaaacgttggacataaaaaaccacatctacatttatattgggacagagacagtatttttttaatatatatgtatatgttttggataactaaagaagagtagtggagtgagagtgtgagacactcacttaaatagcggcggctcaaaggcgatgccattgccaccacctcgctctctccttccttctccgaccatccgctcccactccggcggccggagtccggccgggagaggtcgcactcatggctgtctagccggtgagccgctcatcggcggtcgtacgtcatcgctagctaagtagctagggggtcgaacggttgtgggtttgatggaggcagaggacgagtactcggccgggtgctccttctccctcatgtgccaggaggatagcaccgacctcgacgacgacggcggcggcggtggctgcttcgccggcgacggccgcgccgacctgctcctggtttacaatgccgccgccgccgccgacgacgaggatgaggaggaggtggaggagtacatggaccatctcgtgtccaaggagagcagcttctgctcctcttcttcttctacgtcgtcgtcgtcgtgctgcttctccgacgccggcggcgagtcggcggcggcggcggcgccgatggactggttcgcactcgcgcggcgcgccaccgtgaagtggatcctcgaggtgaatgatcgttttctccggtttgggtttttcttgatggaacagagcatctctgacctgacatctcgccgccgccgccgccgccgccatttgcagacgcgagggtgcttcggattctgccaccgcacggcgtacctggccatcgcctacttcgaccgtttctgcctccggcgatgcatcgacgtgggttgatctcgctggtcaacggttgctagctatagcttctttcccctgtttcttggatggcttccattgatgggtcatgggtgtgggtggggtgcagaggtcggtgatgccgtgggcggcgcggctgctggcggtggcgtgcgtgtcgctggcggcgaagatggaggagtaccgggcgccggcgctgtcggagttccgcgccggcgtcggcgacgacggctacgagttcagctgcgtctgcatccgccgcatggagctgctcgtgctctccacgctcgactggcgcatggccgccgtcacgccgttcgactacctcccctgcctctcctccaggctccggcgacacgtcggcggcggcggcggcgcgggcgcgtccgccgccctcatcttctccgccgccgaaggtatgacacccacatcgatcgatcgatcgatccattgatgcgttcgaggaggaaccaatccgtgtgctctgtttttttttttggttgcagcggcgagcgtgctcgaccaccggccgtccacggtggccgccgccgcggtgctcgcggcgacacacggcgcgctgacgagggaggcattggagtccaagatgagcggcctctccccatctttcctcctcgacaaggtcggtcgccgtcgaacacctgcatgctcatgctcatctccatggattattaacaaaatctcccttgttttggtgttcgatcgatcaggaggacgtgttcgcgtgctacagcgcgatgctgagccagccaacttcaccggcgagcaagtcgacgacgacgacgaccggcaagagatcgtcgtcgtcgtcgtgctccgagtccaccgacgccgcgagttcatacgacgccaccgccgcctccttcccggcggcggcgagctgtggcagcaagaggatgaggctggagctgccgggaggcatcctccgatgagcggcggcggcggccgggacacgcatggtttttgtccgtcgtctcgagcacgtcatcaccatttctcttccaatttccttacaaatttttttcacttctttgatcgatgcaacagcatttgccaaacaatttgttcttggcagtgcgctcgctgatcgatcccggattggattggcttggttaaattaatcccagcagcacgcgagatcgagaggatcaaacaaacaaaaacaccaaaaaaaacacaaaggatatcaagatcgatggagcttgatcgagcttctcctaaggagaggagaaaactcaaactgctcgtgtgagacagtgacagagtgagtgagagtgagagtgtatcactgtacacaaggatggaagaaaaaaaaaacactttagcctgcacattgcactcacactgcacttcccgggaaggagtcaagaagaagagagagaagctgaagaacagtgctactaggaacagtagctgcagataaaaacgatgggagtaatgtctaatccgtctgccagttcaatgcaagcgaaggagagagcaaagaaagctgttgctgcagcagctgcaagtaccatggtccatggccttaactctgatttgatcaaaagccttctcctgctcaaagtgagtgtgtgtgtgtgtgcgcgcgcatgttgctactatggcggcgccggtgcatggctgccaaatgcatgtggctgctacactggttgcctgtaacctgtagtagtgagctactgccattgttgtagcctttgcaactttgcattgtattttcttgagtgtgtgtgagagagatggataattcagacagagtttgtagggttcttggttgcaagcttttccagtctctcttgtgtaatgtgattgctgtgatgatcgatctactgatctctgaatacggtggtggtccttcggaatcgaatcgatcgtgcagtgggcgatggatggatggcaaagccgggcattgcagcaggatccgagggcgacttttgccgattggctccacgttggtgctagcttggtcgatcgacaactactctactagtcgatggctgctttgtgtttggatctgcaacattggatgaacagtgggaatggcagagtttgcagctgtacttgagctttcggtcaaggggctccctccctcacacagttatgaactccttccctgtcctaaaatataattatttttaaacttataacatagtcttatatatactattttaattaataatatctataaaagtaagatgttttagataaaaagagttacgtatctctttaatgataaatttagtaacatgagttttacgtgattgattttttttattttttcgttattaatagtcaaagaaaaaatatttgactttacactattttaaaaatgtttatattttaggagggggaagtaatggctagccttgctagtggagtctgaagaacttcgtactcgctagtcagagtggacggcggagagatggggggccatcaagacctactaatcacgtgtagtaactctgtttggaggggaggaaggtgtagatttgttttgtaatttttgggtttgggatcaaatctgaactaaactttaatataaggttttgaatctattatatcaaaatggtgaagtacaaaccatggttaaaaattttgggtctatcaaccctcctatacgaaatttatctcccaaatgttttggattttttttcatttttttgaatttggcaaattttctttaaatttgatcaaaaattttggaccgaaattaccgcaatttctgaaattcctgtcctattggtacccctggtagaaatacacaaaacaaaattttgaacctggtacaaactatggatcaatcactcttttctcaatcgagtatatatgtaaatgaacatggttaattaagtacacattatttgtagatataatcgcagccattgacattcacaaaggttgattgtttcaggtcaataattggaaatagattaacaagggggatgtgacttttgaccggtctttgatgttttatctccactttgattttgtggtttctagtggagagcacagatcaaattaagattgaattggacgtagggaacaaggaaaggaagtgaagtgtgtcggacaatcaaaggatgttacagatgtccaggttgtggtaattaaggctccacaagtcttgtgatttaacttgtgggcagtaacatatttatgttaaaatctgtgaaaaattataatatagttccaattatagtagtagtttattttgtacactatctgttccatattttaaggctttttgatttttttctagtcacatttctttaattttaatcgattatatagaaaactttaatagcatttacaacacaaaattaatttcattcaaactaacatttaatatattttgataatatattaaagccggtgaaatatctatttcacctatttcaaaatactgttaggaggttttgtgaagttccctctcactttttagagaaaaaaaaacactcttcttgtttggtttaccttattgaacaattattggaacggtctcaaggtgttgttttttacgttacctaactctttccacttttttagtgtagtttatgccatttttcttcctatccacttttagggaatatttcttcctatctaacgaacaagtcattttagacttttgcaccgtaactacggagtactatcccacctaccctcagcacgtgaaaggagaagttttattccttcaataccctttaactacctatcactcttacaacttttttcaatgattaagagtattttagtaattctcactttccactaatttctcttggggatgctaggaatggtcgctttgtggacggagggagtatatcttatagctaacgatttttcttgcaattggcaaacacgagtcatttgagaatagtcgtgatgctggaaggccaaaggagggaagtgtattttgacagtggtttctaccggtagtagtcttccattgccagtattatcagtagaagctatctaagccattatttttttttactggaatctaagccattattttgagttgtactatcaaaaaaaaatattccactggtaatataaatagatgtgatccattagataagacaagattaattctactaccaatagaccaccataaaatttatcatatgaaaatgcttaaataccatgatgatttgttttatagaaaattcaaaaagctaatagagtactacctccggctttaatatatgacgtcgttaacttttgaacataaatttgatcattcgtcctattaaaaattatataaatcatcatttattttattgcaacttgttttgtcattaaagtttcttttaaacctaacttatattttttaatatttgtataaagtttttaaataagacaagcgattaagtcactcgtcatatattaaaaatccatatattaaaaactggaggaagtacaatacaaatttaagtaatttcaaaacagagtaaatagcatgctttaaacatgatgtagggaagtgcagattctgagattctcctaaataggcattcatctccatgatcagaaaaggccctaaggctgccctcaccgacccaaccggtgtgcagccattgcatgaatgcaggtgtttcctcgcgctgcccggtgcccgcctgcactacttatgacttacagctggtaaaagggggagcctttttgctctgtttctcagctgagcacgcactgcggattgtgttgtgcgagcgactttctgcaacaccacaaactctgcctccctgttttttctttttgaaaaaaaaatgaaagaaagaagattacgtacatttttacataatgaaataaatcctga

SEQ ID NO: 58399 - DNA, 18322 bp, Oryza sativa
aagggcttgttgatttgatgtcattttcaacccttcagtgatattttatggtaattccagagctttccactctcaaatattctaccaaattttggtaagatgcacaaaccaaacactttcatccacaccttattaccttaccaaaaattggtcatggcaaaatttagtattatcaaattttggtaggtttattttcgattttgctatatctcactcgaaagattttttcttatctctcactcgattttctcacttaaatttacagtgcattttcttgtaagttacagtgtaatttatgaaacttacattgtaatttgtaagttacagtgtaatttttgaatcttcgcatgtaagttttgatatttgtattggatttggtctttttcttgaagatatggtaatttagtgtccattatgatatttcttagttgctttttgccttttactgtgtttatcagattttaattcaaagattaaaaatctgtatgatacgattataaaattttttcgaaagatacataggtactcccgtttattttagtgaagtaagcaagcactgaaatcctacgtcagccataccctgttgaccatagaatctcctatgctggtagtagataaatacattcacatacattttttcagtgatatttcgtacaaaaacaaatgttcttaacacaaaaatcaaacaaatggccctcaacaatagacaaaatgtgaaaataatttgtacaatattaggtgtgtaatcatcaatacagaagttacaataaaattttccttccaaaaacacaagaaggtaaccgggcattcacacggccttttttttttctcctttgtactttatactaagaaagtgagaattttacattattgacagtttaaaaaaaatatagtaattaataactatgtacacccacactaatacttcttccatgcttttaatatctcaatttattatttaaaaaatagaaataatagagttatatctgtgtttgagtctcaatttagcatattcatgatttgataatttcgaattttggaattaacaaaaaccgagctgtcctatgcttggtctgtcaatcatattttctataatttaggtcctatttggcagatctcacatgcacgctggagtagtagtttaaaattttgtatttcatctaaaactaaagcaaaatgattcatccaaatgtaatgaatatagtaattcgatttcagatgtaatgaatatccaagcatagcagcatttgttggtagtatataagatggacatgttccatataattttggatggatgcagtaacttcttacatcttagtcttgatacaaaggaagtttgttgggggtcctatgactcctgccaattacagaacactgacaaaactaaccatgctacatcttcagatggtacagaaagaaaacacacagctacaaatactgatcagtatttcctcttgaaagaaatttatcaacagaggagactttctgcataactttacattgcatgccatcaacaaaaccgaaaatggcatacctccaggttccgatggaaaggagcattccaaaccatagccaaaaaccgaaaaccactccagccattacacagtagtagaaatactggtcctcgcatgttctacagtctctctcatctgacgcaactgaagcatttgtgcatgaaatgttcaacggagggccacagagccctgaattatggctgtatattgatgggtcagtgaaggtttgaagttgattcccggtgggtatcttgcctgatagatgattatacgagagattaagagtgctaagggtagatataccagcaaggcttggaggaatggctcctgaaatttcatttgacgagaggtcaagggactcaagatttttcaaactacctatgttttcaggtatcccacacgatagattgttccttgacaagttcagaaatcgaaggccttggaggtttgttaactcatcggggatgcattcagacaatgagttacctgacaaatcaatacccgtcattaattgaagtgttttttggaaaattatctcctgccccttccagattatatcgattctatcctgataggtagacccatctaatgatcccgcactggatacaatttttggattcttcatggatgttaagttgccaaaagatgtgggaatcgaccctgtcaaactgttgttggtcatatctagcagttggagttgagaaagatgtgataactcagaaggaatttcaccggtgaagttgtttgatctaaggctaagaatcttcaaagatgaaaggcctttcccaatccaaggaggaatgccaccaaagaaattgttgttcccaatatctaaagtgaccagcgtctggcatccctttagcgctgatggaaaaacaccggtgaagccgttgccggcaagatgaaccgattcaagagaacaattgtagcttgtattgactgcagggatttcacctgagaagcggttgtgggagaggtccatgaactgcaggctctgcagattccaccagcagtcaggcagcttaccggtgagcttgttgtttgacaggtccaggatctggagagaaagcaacctgcaaaaggccgagccggagctgctgttggaggagttgccgttcaggacgttgtacttctccggcatgactgcgccgccgtcgtatagcctccgagccggcctgctggagaagtctacttcatcattgcggtagtagttttcgtcgtcgtcgccgtcgtatattctccgtaccggcctgccggagaagacgtcgtcgtcgtcatcatggtagtagttgtcatcgtcttcgtccccatcgtaatggtagtagtgatcgtccacatcggcatcgaggctcaagctcgtcacccgttgaggagatgataacagcaagagggagagggagatgcagaggaagagacagaggcgcagcacgagaggggccttggctgccatggctggatttggtagagtgcaaaggagcttgtggaactgaagtattgaactccacttgtaaagctgcaggagtatttctttctctctttcttggtatggctatggacagggggcgaggttgaccgtgaccatgggggtcgtcgggtgggggtgctgcggattaggaatttggagcgctcgccgtgtcgcggtcggcgcatgtttcacacggcacagcgacagcgatggaccagccggctccaccatgtgagatgacttggactgatgacccgagaaaggcacaatggcacagtatccagccagagtcaaggatggagccaatggcgagcagtgcgttttgcagtcaaaatttcagaacacacggtggagttgtcagagacgaatggtaccttgatcatgagaggctcgcccgatgatggcgctcccgcgcgagcgacgtcgcccgccgcgctcctgtcccctcctcgccgtcttcctcccgccccgagtccctcctcctcctcccaggcatttcctcgagcacatcatgcgcgcagcacgccggcgagaccgagacattcctcaaagcgccgccgcctgggcaaaacccaggctaggtgggggaccgagctctggccgccgcggatgctgcagcgcttctattggagccacgacggcggcggcggcgcgcgacggccgggaccctcgctccgccgcgtcggagacagaagccgacgccgacgcgagcgcaaagtagctcgttctgacgcggtttcgtcctcgattcgcgagcccggcccaaacaaaacgaaacgaagtccgcttccgtcatctatacggcccattattacatactccacacggtgcttttgttcatgggcttgatccatttagtacggcccagcacagtcctcgtctcgatggcccatcacctgtaatgggccgtacttctccacggtgctactagagatggcaatggggacccaaaacctgtgacccgacgggtttttactctattaggagctaattgtgttctaactcttatacccatgggtctactaatgggcaaaactcttacccattaggtacgtgggtatgggtccgttctttacccacccatacccaccaacccgtgggtgaaaaaacctattgattaagcctaaaactataagcaatataagtctcaacgactactaaatcataatatgaaactcctttcacatcttaagcattgttctattctagttatatgaaattattatttgatttcttgattatgtatgtggttgtataattttttttactcgcctttgtatgctaatgttaatatattattgctagagaaaatattgatggtttacaactctaatatgactaattatagtacaaaactataaatgctacaagtcaactatatgggtatgggtacccgttggatacccgttacccgcacgggtgtgggtatggggaagattttgtacccgcgatgggtgtgggtatttaagtgggaaaatttagacgttgcgggtgtgggtatgggataaggaaacctgatgggtatgcacccgttgccatctactgctacacgcgcgcctactaacgagcggagtcgtcaggatgatgaccagctgacgtcacgttggcttctacttactctctccgtcccataatataagggattttaagtttttgtttgcactttttatcactcgtcttattaaaaaaaatttggaattattatttattttttgtgtgacttgctttattatccaaagtactttaagcacaacttttcgttttttataattacacaactttttaataagacgagtgatcaaacagtgcaaacaaaaactcaaaatcctttatattatgggatggagggagtaacattttctgaacttcatcgggaaaagcaaaaaggtttattccgtaattccgtatgaaacaagtgaatagcgatattagacgaaggcagcgacataaaattgtactaggctcatagcaaggaattcatatcaagttcagttatacttgtaagaggaggtgcactaacatactgttagccagctataaacatatttgtcaaggagtaatcctctctagcgggagatcgtgagatcccctttttgtgagttcggccgagggaaaaggctcgcttggggagatcgcgtattcgccttgaacgctgctatatcatgtgtgagccccaagattatacaagttcgggccgctatcgagcgtaacaccctactcttgtgtgtgggattatggctgagtgttagaagggttcctaaactccggagagcgctcccgcttctcttctcctagagttcaggtttactgagagtcgtccccttttctcggtgggcaaggtcctccttttatagttcaaggggataccacatacaccgcctctacctactctttcatgggaggggcacccactctatcttgaccgggccacgatccgtgccttcgcccggaagctaagcagcagtccgtccttgagcgggacccagtgctgccccccgcctgacacgggggacagccctttcattccctcataaatgggtgaagacttgcggtggtcctcctccacggagggaactccaaatgacgcttcgatgggacaggacatacctatctccactccgccggagacagaaacgacgtgggggcacggccgcccgtcaatcggacgtgaccggcaacaggccggtcacagattggtcacgtccgactgacgtgggtcagtcaggcggcaccgcacgtctgcccttaccgcattaaacgcggtgagggatagttggggcgccgcgcattgatggctgttcagcccgggtcctctccccactcactccccccgccacatggcagctgggcgagagccttgaggtgaggcagcgcgaaggcccgaggggcacgacatggcaccccgaggcccctcggctgcttttgcgactcgcgaggtgcgggagtagggccaggctgtagagccacgcggcaggataggaaggtaacttcccctcactttgcatacccccgggcccatatctccgacagtagcccccagcaccacgtcggacattggtccctcgaggacagtctgacgtggcgcctcacgacttctcgtgccgtggttgtgggcccgacgggaaatccagacggttgccggcgagcggccaggttggcacattagccaaaatggcgatttgaccgccgttaaccgcgctgatgatgggggcgcctagggcgcgaaaatcagggggtcggctagaccacgcctagaatcgtcacccacgccgcctcgactccctcgccctttgtgagttcggcggggggcagcgggtgagatttgagggcttggtgggcaaagctgtgtgatcttgagggggttcaatcccccaaagacgatgagacaaaagggatttatacaggttcgggccgctaagaagcgtaataccctactcctgtgcttgattgattgagtgtagaacacaagtgcttggggttgcaagacccaagtgccagttcgctcggaagtcccccctccccccttctctcactaggactggacctccttttatacctcaaggggttaccacataggcccaacaacctaacttcctcgagaagtattacaatctttgcattaaatgcatgtcttgttccttaacttggaagccgcatacacgtcgcctcggtcgtagggcctaccaaaccatgccgcctgacacggggggcgcccatgtcattcaccatttaatgggtgaagacttctgggctcctttacaccgggaaaacgggagcctagctttaaccagagcgggaggaccgactctggctgggataagaggatgagaacctctcattatcattatttgatgggacatgtcaggctgcacgccgcctgacacacgagcagcgcacaggcgtactagccagtcccatcggtcattcgaccggtcacagaccggttgagtacactgacgccgcattaaatgcggcgtggcgcgaccgctcgagtcgccataaatgcgggtaggtgggcacctgtaggcggacacctaacccaccgtacgtggtgacctagagagggggtcgggggagcccaacccctagtcatgggagggggcggtcgccgcctgacctcgggcccgatcccccctcggggagggccacgtggcattggggggcagcctcctctcactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattgggggcagcctcctccgactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattgggggagggccacgtggcattggggggcagcctcctccctctaaacatgatacccccgggcctatatcaccgacaatattttaatgagataaaatatgagagagaagagcagcgggctacagatctgtagccagctgcagcacggatttcaagacgtagtgtgtgtatgataggtaggacaatatattaatagtatagtaagtaactactgtataaattggctattgtattggctatatgtgaattagagctagtagtgggctattctcctgaatttgctctaactgcaacgcacacgtggacccacaatccagagtcacacggatcgagcctacataaattctctgtatttattgtagaggataacatgtcataagtaaaataagagtgtgtttaattcacgttaaattggaatgatgtgatagaaaaatttaaagtttgtgtatacaaaaattttaatgtgatggaaaagttgaaaatctgaaggaaaagtttgaaactaaactcggcctaaatctcaatgccatagtgaattgccgtaaattgttgtatcgtcattagtgctagttacgacggcaacataagtaagtactcctaaatttgttgctgttgctggcttgctgccgcggcagctatacccagctggtgcaccatatatagacagtttttttctttactgttgcgattcgacgtactagtattatttgatccggagagtccacacaactgaacaaaatggctaaaattgatcctaattctgcccccatgttctttcttttctacgtttattagtacttcagaaaaaactaaccaacttcaaatattaaaagatggagggagtatatatcaacctgttgtattgagctttacattagctattaccgcaaattatcctctttttttcttaaacaacaagtacaatatagtatgacgtttctatcgatattaccggagattatcctcattatgcagaagcacgtgtctagcattagtatgacttttacgcgaacattcgtgtattagacgtaccctcgactcctaccgaaatgtggtgggaatgtgagatgatcaaagcagtagcttgacagtcttttttgctagccccctcaattatttcactccttcagcaaacttggacacaatacgtcaatatcttgttatgtttttatttcttttgatttttttttaaaaaaaactactcctgcatagttatcgtgttatgcatggtggtgatcgttcggttcaaagtttcaaacacacttgttcacattaatggaacccaccgcagttaatagcgctggagagggccatactcctgtgtgaggcagtacagtttgttgcgtgtcgtgtagccgtacgagctaccagtctaccacagctatctatctcgcggagtaataatgacttggacttagagcaggtacattagcaggctataactgcaaacatattttaagaatataaatgaggagagagagaggagcggtgggctacagatttatagccatgtgtagcacatactccaagacacagtgtgtgtatgataggtgggactagatactaatagtgtattatataactattgtatgaatgaactattatattggctatagataaattggagctagcagttggctatactattaaacttgctcttaggaatgtactactagtattattttctgttcctaaatatatacatcttgattgtttaacaaaaatggtactactacattggttgacaaatcaaaatattttttattacctcattggttagattttaaattgtttgtactcttctgattgatccatttaaaattgctagagatcggaatcaatatctcataaataattatataaggagaaccaactagctaggttcattatggtgtaaccagcctaccctcgttcaagttttaaattttagacaggtgttcgtatttacagctaattattgtttcactgataaatgatgtacttattagtaatgaggtgcatggtagggtgtacagacgaccgtggtgaattcatcaagtttatagcatagttattaagaccggaccggtgaatgaaccggttgagctctcggttcactggtttagcggtcgagccagtggttttaccggtccaaccacggtctgattactattatagaatgaatgtttatgtgatggcacaagcagcaggatggtggcatggctagcgcgtgaacctgtcaatcccgtgaccagaggtcgaatcctcgtctccaccaatttttctcgggattttgcgcgcgcatgcacgggaggcaactagttgggccccccattagccggtctttcccggtttgaccagccaggttaatctccggtttatataaaaaccgcccgagttaaccggttttctccggtccgattatacgtgtatcttgaacgtctatgtttatacatttgtttttttataaaaaatttgaataattctatagatgtttacatactggagtactatttggacatctatctgtggctttgtttagttccaaactttttctttaaacttctaacttttccatcacatcaaactttcttacacatataaacttttaacttttccatcacatcgttccaatttcaatcaaactttcaattttagcgtgaaacgccaccctatctctcggggagtaataaatggctggacttgaagagtgtcgcagtactgtagcagggtcgacagcgaccgtcctgccaatagggaatcaatgcggcccccgtcttaagttcgcttctgccctgtcaggtttgcccagccactccccgcgcagcagctcagccgtcgctaccaccacctcaagctcccgcctcgcgtgcagctagctgagagcgagcgctcgccatggagaacggcgccggcgccggggacgacgagtacacgcgcgacggctccgtcgacctccgcggcaaccccgtcctccgctccaagcgcggcggctggaaggcctgctccttcatcgtcggtacgtgtaacgtgttcgtgtgtatagtcgtcgtcgccggcgagcttggtggtgatgtttgtgtggtggtggtggtggtggcagtgtacgagctgttcgagaggatggcgtactacgggatcgcgtcgaacctggtgatctacctgacggagaagctgcaccagggcaccgtggaggcggccaacaacgtcaccaactggtccggcaccgtcttcatcacgccgctcatcggcgccgtcgtcgccgacgcctggctcggccgctactggaccttcgtcgccggctccgccgtctacctcatggtcacatctctctctctctctctctctctctctctattcagctacataccctgttctcttctgcctctgtctctcctctctattcaacggaaaacaatattaaactctcgacaactcaaacaccacggttatggaaaaatctgaaaaaagtttcttaggaattttgaaacagttttactcctgcatgaacggagaaaaaaaaaattctgaagcatggtttgcaatttcggcgtatgcaaattatagctcagtaccgaaatttctgacgaaagagtaatttttttacacattttaaaatttagaattcgggtcttttaaaactgtttaagcttgattcttttgttttcgtgtaatctcatctgcatatatatatgtatgcagtggttaattattgacttctcatccaaatatgataatatatataattggaagaccctatcttgttttactcaactaatttctcaaatgtttgaaaggcatctaatatctccttatcataaatgatgttatattatattcaatataatttgtcgatatatgattagaagaggtaatgattaaagacctctcgtcagctaatagtaaaccggtcccttgtccctatccaaatttgcatagtagaccgtatcttcatgctacttcacccctgttaattaagaagctactactctctccgttttatattataagttattttgggtttgtattaactcggttctcttcaagttttaccaagtttataaaacggtcaaattagttttataaatgcatcattgaatatatttttatagtatatttattttgtgttgcaaatatcgtaaagtgaaatttactcttatatttttctgtaaagttttacttatgacagactcgaagttacgaagccgggtagtggtaatgaagcaatcggcaaaagaaaaccattctcccttttttttttaatcaagaaaaccagtcttgattggacaaaagaaatgtcataatactcacttcacttcatttgtcctgtttgcacccataatggggttcacttcacttcacaatgtcccttttaaaaaaggttttacaatgtcgacagtaaccgctttgttatcgtaaaccgtgttgcactcaccacacaatgttcataaaatttacctgtatacattattgatggtgtcaatatcattaacaatggggagagcaatatttcgacggaatcttcattttgaaggaaatgcctggatttggagataccttctgtacaatgaaagtgcaagaatgaatgccatgtgtgtgtggcatcccagtaggccggccgtacgtcattttgtatctttgcatttgtatcttcgaagacaataatctgtgtctttccaaactaaatccgacaaaaatgaaaccatcaggaaataataggtcaactaccatgaccccatgtgagatctggtcctgaaaaataggacaatggggtgtaagattgacaccaggttttgcttttgatataagcaagtaggggggtaatcctttccaaaatgtccaaaattagtacagaggattgatgtgttcatgttgtgacttcaagtccatttccactaaaaaattggagatttgggtaaacgtcacagctaattacgagagcatgctggaaaatgcatcttttgttttagcacactttgtactgttaataaaggttaagttctactccctccgtttcaggttaaaagacgttttgactttaattaaagtcaaattgctttaagtttgactaattttatagacaagtatagtaatatttataatactaaattagtttcatcaaatcaataattgaatatattttcataataaatttatcttgggttaaaaatgttactatttttttctacaaacttggtcatcaaaaatcaataattgaatatatttttataataaatttttcttgggttgaaaatattactattttttttacaaacttagtcaaatttaaaacagtttgactttaaccaaaatcaaaacttcttataacctaaaacggagggagtagttagtactaatatgcttttctaaagtagaatatcaacttcaccaatttttggtttggtgggaactcaggcttctaatttgggctttactggtgcaaactgcaaacccacacatgcttgacaggttaacctaacacaaaccttgttcatcacagtccaagtagaacttctagaaaccaaacccaagttcaatttcaagctgaacacatgagtttgaacattatttattcgttcaaattaaattcacctgaaatttggaaacacatggaagaattcctctctttcaaatttcttctgaatctgaaccatccaaattaacaaacgcagggcatgctgctgctcacactggccgtctccgtgccagcactgaagccgccgccgtgcgacggcggcggcggcgccgcctgcccgcgcgcgtcggcgctgcagctgggcgtctacttcggcgggctgtacaccatcgcgctcggccacggcggcacgaagccgaacatctccaccatcggcgccgaccagttcgacgacttccacccgccggagaagctgcataagctctccttcttcaactggtggatgttcaccatcttcctcggcatcctcttctccaccaccgtcctcgtctacctccaggacaacgtcagctggaccgtcggctacggcatccccaccctgggcctcatggtctccgtcgccgtcttcctctccggtacgccgctgtaccgccacaaggtgccccagggtagccccctcgccacgatggggagggtcgtcgccgccgccgtgtggaagtggcgcgtcccgctccccgccgactccaaggagctccacgagctcgagctcgagcactacaccacccgccgcgggttccgcatggacgcgacggtgtccatggcgttcctgaacaaggcggcggtgaagccgggcgaaggaggaggaggatcggtggcgcggctgcccgggtggacgctgtgcacggtgacgcaggtggaggagacgaagcagatcgtgaagctggtgccgctgctcgccacaatggtggtgccgtgcacgctggtggcgcaggcgggcacgctgttcgtcaagcagggcgtgacgctggaccgccgcatcgggaagttccacgtgccgccggcgagcctcggcgcgttcgtgacggcgacgatgctcatctgcatcgtgctctacgaccggttcctcgtccccgccgtgcgccggcggaccaagaacccgagggggatcacgctgctgcagcggatcagcctggggatgctgctccagatcgtgacgatggtggtgacgtcggtggtggagagccagaggctggggtacgcgaggaggcacgggctggtcgccaccggcgggcagctgccggtgacgatcttcatcctgctgccgcagttcgtgctgctgggcgtcgccgacgcgttcctggtggtggggcagatcgagttcttctacgaccaggcgccggagagcatgaagagcctcgggacggcgatgtcgctgacggcgtacggcgccgggaacctgctgagcagcgccatcctcgcggccgtcgagcgggtcaccggcggcggcaaggggaggacgccgtgggtgaccaacaacctcaacgcctcgcgcctcgactactactacgcgttcctcgccaccctcgccgccgcgaacctgctggcgttcgtcgtgctcagctgcaagtactcgtaccgcgtcgagtccacggagaccatcgacgtcgacgtcgccatggacaacgtcgcgcagggcggcggcgtggtgacggtcaaatcagaggcagccccaatggcatgacagcacttccggaattgtatcctgtctattcccgtctggattctgaagttgcaatgtaatgaagaaacggtgatgatacatattagcactttaaaaatgttaaatgaaaattttatttactcgttctgtaaaggaacggtaatacggacaatattcacagcttcacacaatcgcactagtagcaccatcgtttctcttatgcctatacttaagctaaaatgtgaattttaaagcttcactttagagttgattttgtgttttttttaaatatagtttattttacagtatttgctttcgaatcgataaggacacgtcgcataaattattttttaatttgttaataaacgattcgcatgaacgtaagtataagtaaaaggatggaaccataaatatctaggagtaatttggtgacaacgatggagatgcactattacagtcatgacgctagaggcaactaactccatccatcctaaaatatagcaatatagtacatgatgggacatgtatgtccatattcatagtactatgatatatcacatctcatattagattgttatattttgcgacggatgaagtatttgagagatactagctccgttttttaatagataacgccgttgactttttctcacatgtttgaccattcgtcttatttaaaaaatttacgtaattataatttattttgttatgagttgttttatcactcatagtattttaagtgtgatttatatcctatatatttgtataaaatttttgaataagacgaatagtcaaacatgcgagaaaaagtcaacggcgtcatctattaaaaaaacggagggagtatatcatatcggccgatgatgtaagctagtagctgatcctttcaaattatttatctttctaggtttggacttaagtcaagtatttccatctttttaccatcagatatatgttttaacaacatggaaattatgtaccaccagaaaacaaggcacgcttatatataacgtgttcatatgactaggtaacactctaactcaactggattgaccgtagtcagctcgccacctgagctgaaagcaggcacaatattgtcgatctcggatacttcgctactgtaaattgacgaacatgacatcaagacgagaaatctaaggaataagtccagtttgactcccttaactagtgaccgaatttgatctgtatccctaaaccacaataccggatatcttcgacccccaaactattgaaatcggtgcaatttgactcccttggcggttttggagggcagtttcacttatgtagggcccgctcacatatgggacccatatacgatcctccctttccttcccttattcctccttcctttctctctctcccccttaccttcccttcttcctcctccctttctctcccttaccgttggtgcaccagtagttcagcagcggtgccgggaccgggccgtcgtttgttgtttgttgggaggacgccaagtagggcgacgtcgaggagcgagacggtggcctctccccggaggtcctagtggcgtgggcgccgagccagccgcggaaggagacgcggatctaggtgttagagacggcggcgcggagaggaggagggcagaagggggaaggtggggccgggactccggcgagcggggcaatccccgttcacgtcgctcctctcgaccttcgttgcatgggatgctaccatcggttgcccactcatccgcgccaagctcgatgccatgggggccacatctaccaccagcggggcccaatgaggcacgcgggggcaaggacatgagggcgcgccacgttggggtgctcgtcaagatgtgctggtgtggacgtggatccctgacgcgcttgtttggatttctgcaggaagtcgaagctgtcccgccggcgccactccagcacctgcccgccaccactccaaaacatgctcctcgcacacgactgaagaaggggtagagagagggagagaggagggagacagagggaagagtaagaagggaaggagagagaggatgacatttgggtcccacatgtttgtgggtccacaatttttttttgaataacaagtgggtccacaatatatatatatatatatatatatatatatatatatatatatatatatatatatataagttctaatgacatgtaagcgccacgtcaacgccacgttgtacgaacactaggtcaatactaccacgtaggcgctacgtcagcgaagctgccctccaaaaccgcaaatggagtcaaattgcgcccgttttaataggtgaggatcaatatatccggtattgtagttcaatgataggaatcagattcggtcactaattaagtgagtcaaagtgggcttattccgaaatctaaagtaagcttatttcataacaaaattcagctcagttactcttgggtcaataagctagcctaataaaccgggaagaaaagtcagaaaacaatctcgctagcttccacctctcatgctgcagcatgcttataaagcaaagacaaatctagggttgatttagccttcatactcaatggagttattcctatatgctccgctgagatatgttgtttgtttcactttcaatcggttaaacgttgactgaacagtcgtcatcatcacgatgtaatttctacctttcaatcggttaaacgttgactgaacagtcgtcatcatcacgatgtaatttctacctggaaaggaggcgtcgaaggagcttaatgaaacatatcaaatacaatgcaattagacaatatgagtgaactcttcatccaaataaatccttatccatgacccaaaaatcattctcttccattatctgaagaagattagctcaccaagttagtagaagtgttcatcatctatcctcgactagttcaaaagcagcaagaccaccttcccacggtgtgtaaatgaaccccaaaacagaaaaaaaactcccaaataacacgccacaaaaggtatggtaggtgtggcttgacaatattacattcactggttgttaggttaagcattaaacaatcacatgtctcagcatctgccactataaaagttcatttttaaggacagtcatatagaaactttaattttctgagtctaattattggtcttgataatgtatccaaacatttacaatcgttatttttcatgatccacacatactgactatgacctatatgaataatgagacgaccaatcaagaaaactgtagtaaagaataattaggcaatttgttttgttggtttgttgtgggatatgttatatgttaatcaagttagtccttcttattggagttgaagagatgacataaaaaatgtttctatgtgaacaaagtaacattaagaagataacccgttaaactctttttttcttatagtaaagcgttcaactttgtgttgcgactccaaagctttattatggcacaaaaactttacacaaggctctaattattcttttactataaatcttaatttgttatgatgatgatttttaaaactaacttttaacttttaatttgttgagttggacgacaagttcagttatgtaaagctccaaggtcactgatagaagtgagcaactgttagtattttcatatttacttttcaatgatttatatcctaaatggcaattgcggagttcattacatatatatcaatagctaaacttgttatatgtattacaggat

SEQ ID NO: 58400 - DNA, 3303 bp, Oryza sativa
atcgtttctgttcggttggttttttttctttggttttttctttctatttggttttttctccggttttttcgttcggtttgtttttttctggtttctcttctgtttggtttttttcttttttaatgtataaatacaaaatttgtattcgtatgtataccaagtttgtattcgtacgtatagaactttctatacgcgcgtacaaacttttcatacgcgtatacaaactttctatacacgtatacaaagtttgtatacacatatacaaagtttatatgtgcgtatacaaactttctatatgtgatgtttttttttatttttttattttttagtgcgtatacaaactttgtgtctgtgtgaatatatttttatgcattgaaatatattcataaaaatatatatgtgtgttagggttatggataccacatacctaatagtagttgactaaatcttggcaggatccaccacataccatatctaatacggaaactgacttcagatatggagggagttctggataaggaaagacaaccagagttctacatggaaacgacaaggactactcggattgtatccatactagtttccctagttctacttggacaaggggacacctgtgggtataaatacaagcccccctaggaggacagggggacacccatgatatgagacgatcaacatgatcaacaaccaccatgggggacaagacaatcaacacccaacgggattaacacctgacaggatcaacacccaacgcaatcaacacagaagcctacatacgccaagacacgccgccggatatcgacttcaaggataagcacggctagtaccctacggtgtcttcggatattgtcaggagagacgaaagtgctatctttgatctcgccgagcacgaattcgaggtggaaggctatcctgttgtcgactacgagtcagatcgtcagaccgccatgtcgacaacagttagataggttaccccaaacattgtactggtgtgattatcatgaataagagcaataccggcttcggccaacaggatgtagggttattacctgaccgctcagggacccaaacctgtataaaaatcctcgtctccatctcttttacctcagtctcgcgtataccctagtaccgacgatccccatactatgcaaataccagaattgcgacatcaaacgtagataatatgtatgtatattatgtatatatgcacacgtatatacatatgatgcatatagtatatatgagagactagagggggggcgattgaccgcgcgcctcctcgcgcgcgcagctgatcgcgtatcagcaccccggggggaggggggacaagtcgacttgttcgcagctaacttttcgttaaagtgattgatatcacttattctcaacaccatatatcttttcactcctaaattataaaaaaaccatgtaacttagggtgagttcgagaagaggattgagaagattgggaagatacgcaaaacgaggtgagtcattaacgcatgattaattgagtattaactattttaaatttcaaaattggattaataagattttttaaagcaactttcctataaaatttttttgcaaaaaaacacaccatttagtagttcgggaagcgtacacgcggaaaacgaaacaaacaaactctaaatcacctcaccacgaatgcagccttagatccgattaattacagtaaaaacctcatttttccttgttttttattacatcgtagatgtctgggcccacttgtcaaccaaccaagctacgaccaccatatcaccgagagaaaaaaaattggcgctcgtcatcgctccgctactccgcctcccgatctctcctacttccccaccacaaccgatgccggcggtagccccctcccccccccccccctctctctcctagcgtgtaactccatctccttggcgccctccccctcttagcaatagcgtctgccttcgtcctcagtgcagcaggcaaccgcgccttgccgttgcgaaacggcttcgaccgctggtggacgaggaagctgttgctcatgtatttgtagacaaggagaccattggcaagcctgacgtgtcatcgcaccatcctctggttcagccaatgcagtcgctgtgtttcaacgagggctcacaacacgataaatgttaggggacggtggttgccactgtcgccgacgccgcgatgttcgactcgaaagcgcggcttgaggtgtacaatggctgtaagcggtgactgtcgcattcgacgagaagctcccgatttagagattgtggccatcggcagctagtcggatgggaagagctccctccttaaggccctcctcgacttccacttcaatgtccgggaggtcaagatggggacctaccgtccctttgtcctctagatggtccacagcttcaccgtcctcgatccatggtgcctcttccctgtgcgtgttccgcttcttcccctaggcggcaccctttggacgtcaaggtctccttctcttttgaggatgacaaatgggcctgaacatctgtcatgtaagagaaaacaagggaaattgggatctatactactacgagacccaagttcggttttgtataatttaggtgtatagatttttggtattgagattaaggcatgccaagcaaattaaactcgaaataaagatgagggatggtaagtgaacttttctgagcaaaaaacaggtcaacaatgagaagcaaaaggaaataaaaatctattttgactctcttaactagtagatgaatctaattcgtaatcctccaccataaaatcagatatgaatgccctctcaactatcaatatctgatcaatgtacgtcctttgatggttcttagagtggtttcgtactatgtgacgtgtttgtgacgtgttgactagtcaatccatgttgagtcatgagatataagtatataacaacatgacattgacgtggtggtacagccagaaaaaaaagaaaataaagaaaaatcagaagctcattatcccctccttcctccggtctcagaatgacagacatgaaggacaatactccatagctccatggctacggtgaggagcagcagcttgcagcagaggaagcagcgggcttggtagagtcctcggcggcatgcagtgactccgagctacggtggtggcttggcgggtcttgtcaagccgaaggtggagtagggaagccgaaggtggagtagggtggcactaggggcctgtttagcacagctccacctccacctccacctccacctccatctcttttggagctggagcttgagctcagctaaacagtttcagctt

SEQ ID NO: 58401 - DNA, 11571 bp, Oryza sativa
  unsure (1)..(11571): unsure at all n locations
tagcagacttcaaagtcaactatccttctcaatgaagtcctgggcaggtggatcggttgtaagagagggctacgtcaaggtgatcctatgtcaccttacttgttcatccggcagatgtgctccaatgccttcttagagcaaaccctgctctggacaccatctgtaccctcagagacctcgtacagctctgcagtatgccaatgttatattgattatttgacgagcttcgattgcttatgtaacaccactaaagcattgcctagacgagttttctagggcaacaagtctgcaaatcaactttagtaagagcacaatgatatgcatctatgtgggagcggaggaagagtctcagctgattcacactctgcaatgcaaacaggaatccctgctaatgtcctaattaggtcttcctttgtcaatccaaaagttgagaacagcagacctgcaaccaaccattgcgaaggccgacaaattcttagttggctgggaggcgcgcttactctcacaagccgaggctaggaagagctctgtggagaggaagaattgaaaacagaaaaatatactattctgatatcttgatctcgagtgccaactccataatcattatgcgggagatacagtacaacgtttccgatcgtgcttgatgtgtgttcctccaagagccgactcataggaggtgttgaaaatttcctaagcagcagaaaggctcggaaaaacattttccacacaccattgaatgtggcaaagaattccctgaagaaaaatagaatgggggctaagaatgagaaatactaacaaaaaggtatactccatggtacataggggaaaatatttagcatagggatctcctattttgttaatgtaatattcaagttactcacagacaatgtgttataaggtttatctctccacttgtcaatagatgccgaggacaagtagatatctgtagatgtctagaagtagctgttgtatctagtgttgtgcataccgtaaatttggttgaaacaagtatcatttctttaagttggttttattatttttatactttcctaggcaacattttctgcatcactatcacattagtatatctttacgttgccagcgatgtccatgacttatagtatggagtacaaaaccttggagaataaaaaggacaataagtaaataacacttatttgtccatatctatggagacttgaatataaagacctgagagaataaaaggacaataagattcacttgaccacatcctggttagattattagctagcacaacctaaatattccagaagagtattttttttagataatagatattttattaatcaataaggtacataaaagtatctgttagaacttctctttttagatatgcactagcttgctagatatgctcttagtcaatttcgtaaaaatatctattaaactattttctttcaaataacaaagcctaccaaacattttttgttcttgaacatgtaggatagctgcatatgattttatttatagacgaagaaaacgattttttttttaaaaaaaaacaggggtccacccgcttacaactcttatctcatagacaccacgtgaccaacaggaacaatcaaggctgaatttagcagcataacaatgtgcagaggctgagctacataggagagggggatgatcaggaacattgtctaagaattttttttaatatagtttatctattttcactatatatgcacccctcaattcaaactctagcattcgtatcagcctaaacttgatcaaaagtagagtaaagcaagcgagtgggacccctctccatttcgttccgccctgccaaagtgtaccttcctctttaaccgaatgcactactaaacctaaatttaggataacatctttaaaaacgcaatggttgcagtgcttaattccaaatctaccaagctggtaggataatcaaggagtcgagcccttttcgttgtagcttgtgaacttgtttgcttgctcggtatcaccaacttgaaagcctaccaaacatatatatgcacaaccttaacaagatcaactaaggttagattagacggctggcatatactattgggctaatcaaccaaagtacacgaggaacacataaaaaacatctgtggaataggctgtttggagtggttactgcaatgctgcatatggttgttggaaggaaccctgctccagccaagaaaaatatatgcagctgcagcccggtcaccaatgcagtcaaacaatcttggggacaaagtttgctgaaatttgttggttcaaaagagtaccataccacctaggagtgagtggccacctcactcaccgacctgcagaagctgcaggccgccctaataaagcagtgtaaagagacactgagccacaggattaaacaatggagacatctgatctcgcaaatgccatcaaattaaaggaccctctgcaattttgccaagttgatctctggtgatcagttatcttctcacctttttgtttctaccctcatgccaagatcagagaggaatataccagtgtatggctacaaacatgtactatgacactatgtgatgtcttgatgacatacacatgattgccagtgttgggatcctggacaggatagttttttttttccttggagttatctgtagaatagtatagtgaaaatcttggttgtcataacaactgtctccattccaaaacataataacttatagcaatgaatctaaatgacaaatctataaaagtgtttatacatatttgtagttagaagtattgcatttaaggacgaagagagtactgtatatgtatgtaccactatttatatggtatgatcagggttgaaaataattcctcaattcacatcgcaatattcacatatactgattaagatgttaatatcagttctccacttctacctattaaagatgtgttcagtaatgcatatatcattctgatatgtaatatgtacagtacagtagtagtaatctctttgaaagaaatgtactccttggtaaggaatggcagttggaattttatactctcatctcatgtctcaagtctcaaccgaaagcctgaaccagggatggcatgcttgcatcaactgcagcagttgtcagggatggcctatgcaactgcctacccccagctggcaaaggatttgcagtagttggactgtaggagtaagtattcaagccttcaaaggacctcacctcatcacctgctgcccaaagacaagggatccaacaaaaaacacagagataggttgctagtgctagcccagccttgatcctaggcattcatcacgattcacacacaccagtactgccacatactgtaggtgtgcaacctctgtcgtctggctctgaccttggtcaaagaatcattggcattggcatagcatggcaaccaattcagatcctgtgcggtactgctcactgacatgtgggcccgagggtctgtggggcccacatgtcagtgaaggaccctcactccatggcaacctatctgctttttattttctgtctatctgcagcagagacactgctcagctctggattttttttttacattttagccatttttgaaaggttattttacaattatacatatataaaaaacttattctagagattgaccctttttctcggagctagaatcattgacgccaagattcaatgtcttggcaccaatgacactagcactgacaccctcgaccccttggtagctaagtcgttgatgtgaagggggtcgacgcttatattttgaccctttcataaaaaaatattttactaataggttcttgccactggtctatttagtgccgaccgctccacaccttggctgctaggggcaagggtattggcgctcagatgttagaccttggtgccgaggttactggcgctgagaaaaaagaccattcttggtgtaaacttgtctaaagatctatttatcccttgtgtattgtactactccatattgtactccacaatgattcttgtgtattgtactactccatattgtactccacaatgattcttgaaggctactttgatgggaatggccaggtttacttatggtttgttcagatttcaagaccattgcaggtaagcggcggagctaggaaatttttagagtccgaacaaatctaactacacagagcatttgctataaaaattatattttcaatcctacgataacattaaattcaattgtgtatttgctgacgagcacaacagtcgaccatcaattgagttttattttcccttgtttgcttggtcagttcgattggctttcttatcatggccattctgatcttctttctgttccaatgataggatgagattgttaaaatctatttatgttttgagtggttcccaagtgttttatgtttatgttaagttgagagtagtggtgttttcactccattttgtgtattaactggtagggcattaaccaatcatgaaggtaaaagggcgtcaacttagcataactctgctagcaagatcccttatggtggaacgtgtctcaagtctaaacttgacactggtgcttatatttatgactgattatttttccagtggtacacaatttacatatcgataacgagacgtctatgatgactttgttaatatatcggtccagtcttcggaggtgctcataagggttaagtagtgcgggtgtgtctctcatgcatttgtatggggtgtttcggaaaaaaataagctagagggcgaacacatgaatacatgatatatttataaatatcaagtctctgtaattattctgcagtagcaatacatcataaactcaacacagtattactaaaactttctattggctactaatgcaggcaaactcatacaagacatctctttgtgtatctatacctttttagttacctaaaactcaatatgcaagcgtagcaattattaatcctaaaacctaacatgtaagtatatcacatcaatgtaagcacctaaatctaatcttaacatacaatcatactaacttatcattttcgcaatattttaatccaattctatccataatttaatatattcatttataatatttccaacgcactaggcgtcacctagttactgctatgtttgaaccaagaagaaggactaggtacatctattcacaaagtgccctttgcagtatatggactaaattatatccgcccaataagaatacatgatgtaaatctgatgcaaacttttcataaccttaaacataagttaaatgtgcgtttctatatggacaatctgaaatgacattacctgctgggttgacatgaattattcaaaataattggatttttcattcactagcatggaacagctcatatgtgtcggcgagggattccatcacaaatcaaaggtcagtgatgtgaaaagtcatctttgttgggtcggccgccgtcacgaatgacaacatcattgtcgggcttaaataaaagaccatcacggatgacattaccacccgtcacgtatgagagtcatccgtgatggttcataagtatgaaccttcatggatgagaatttatgatttttgaattttaaatgcataaaaaaccctaaaatattttaaatattactaggatattctaacaatggtcacacattactactaagaaattcttgatttttcaagtgatatatgcatacatgtcatacatgagattcaaacctaagacctctcaacacatacaaaccaaccttaccatctcacctacaaaccacgttacattggtaatcagatgttattcttttaactattcatgtccaaatatgaaacacaaatttgaaactctagatgacttcaaatgagaacgctttgaactacaaagttgcagatctcatcaagctctacaactttagtgtagggtacatctccatccaaggtcgtttcaaaattcaaaaaaaatatttttgatatagatcacatcacttgaaacacttattcggagatgaaaacaatcttaagtgaaaatattgtcaattagacagttgtagatcataaaaccctttgactttgatatagacactattacaaaaagggccaaaggtgccgggtcctaaaggggccataggtgccagattttcatccggcaccaatactagcaaccgacacttataaggaaaatagaaccggcacctttagcattgctcgagccaaaaaaaaaaaagagagccagctcgaatccgagccgaactcaccaagcgttgtcaccgcgcatgcgcccatctcaaaatcaaattgatatccccaaaccccaaaatcatccacaaatcatcaccaaaataaattgatatcacagaatgaacatattcaacaacaaattcatcaacaaattcacaaaaacatcaacaaaaattctagcgggatagatccatgtcgatctgaagagaagaaaaagagatcgatggcggtggcggcgagagtagtggatgaggatccagatctagagaagaggggagggcgccgccgcaacccatcgcccgctgcctgccgcctcccctcccgccagatccggtggaggggaaggtgccgccaccgcccatcgcccgccacctcccctcttgcgtcgcctcctgccgcctcccctccagccactgccgcgcgcgagagagaagtgagagagccgagagagagaggcaagagagagacagacgagagagatggagagagaacagataaggttgactcatataggggataaggccgatgtgtcgggctagatcagctcagctcggtttggacaggtcccggtttttaaaaaaaccgacccctattatttattataggtgccgtttttttatttaccgacacgtataatatattnaaggtgtngggtttttttnnnnnnccggcacctatgctataagtgtcggtttttctttagaactgacacctatagtttcttaaaggtgctgattttttgtgttttcagcccgtggaggaggaaaaatcattatatgtgccggttttagctattccggcacctatagtgccgatctctatgggcttttttagtagtgaggccatgtctccatcggagatcatttgaaaaattcaaaattacgtatttcaaaatagctctcaccacttataatgcatattcaggcgtgtaaactatctcaaattcaaatagtatcagttttaaagttatagatctcatcgagatctacaactttcatatagggtaatttgaggttgtttgaaaatttcaaaaatttgaattttcctcatccgtgtcagttcataactactccctccatcccaaaatatagcaacttttgtttggatgggatgtatcctagtactatgaatctggacattaggcttatccagattcgtagcactaggatatgtcccacctaaccaaaaattgctatattttgggatgggggagtatcaccctttacagataacattatccgtgaagggtagtaattaagacccgtcgcggatgagtgctctcatctttgatgggtcatatcattgcacctgtcatggatgacatgttatccataacggggtatggctatgacccgttataggtcatctgtgacatgttagaactatgacccgataaagatgactttaaatcgatgacggggcatggttgtgacccgttataggtcatccgtgatgtgttagtactacgacccaacaaagataacttatatcggtgacggatcatcccctatagttatatcttaagcgggataccttttgaaccattagagatgagtcatccgaaatgggtcgcattcactcgacacagatgactcgtcaataatggtcggatctgtactagtgattctatcccttcctccttccaagttccagcaatggacaagaaaattacactactagagaaataattattaacaacggaagacttggtcgttaaaagcccaaatgggatcgttaaagttcattaacgaccactaattttgtggtcgtacgtggtcgttaaagcctccgtcgttaatagttttaacgaccacatgattttctcccgtcatgatttcattacggcctgtttggttggagggagtttttaggagggattgggagtttagagggatgaggctattaagtgttttgtttggttgaaagacatgggaattttgatgggatggggatggagaattgaggaaggaactccctccttttcaatacctgggtaggggcaggtaattgggagggaattcctcctttactttgtctaagcaaatctcagccatccgtttttattaatgacctaatctccaactaaactccctatcaatttccatcacctttaccaaacaagatatatcgagattaaaaattaaattccaatcttaatctcatcatcaattccctcgtgtaaactcccaatccccttccctcgagttaccaaaacggtgcttttttgccatcgctatctcattaacggcgatgtcttttttacatcgttaattctaattaacaaccgtggtattgtgtcatcataagctttttaacgatggtagtattgcgtcattgttaattattttaaccatctctgttaacatccaatgattatcaccatggtacactatccttgatagtagagaaccatacaattgcagtctgcacatctaggaattaacatgcatgcttatcaccatatattctgacacaaccaaccaaatttattcaattgaaatacataataataatttgtttggaacatccaactaaataactaagtatttcaaacagaactaacatcttagtttctatcaaaattataacactcaatctataaatatgtgattggaggtgcagtggacaattcctttatcattcgatcccatcatcattcgcaggtattgtcttcagatgcaccgttctcattgtctcaccattgattctatacaaccaacaaaaaatgatactagctagttaaaacgagctgtatatgtggtacttcatacataaaattcgttaaggcgcatgagtttacctcttatgatgtcattttaagtacgcatcacttccattcactgcacaaaaattgatatgataaaacaaccccacatactttagaaaatcgtagtgttgagaggagccaatttttgcagatatgttgtgtgcacattttatattcgaataattgtttgtccatgttgaaaataaagcacaatagaacattttgcctaaacaaagctagactgaatttattgtgacctaaggtagaatttaaacctaacaggtgcatgttcaaataattgcttatcttttgcagtaggattaagaaagaacatcttattctgaaaagaagcttaacttaccttcttgctcaaggaatgaggaatgctttgtcaccaactagcttcatctaagtcctgtaaattcagagagctttactacatttatatttcgcaattagtattgtaacatcgttattaacccatgagtactgtaactcatcataattgagatagtgtcagcagtagcttcactgatattgaatagcactgaaggaatcatcaactagttaaaagaaacaatccatcggaggcatagttattaggaccggaccgacagtccaacccaaaaaaaccggaaccagagccctcaccggtttggttcgattaaaaaaccgtctgtgcaatcgagtcggtaaaaaccggatgaaccggtgggttttcctttgaaccgggcggttttttccttagtaaaccgctaaaaaactggcagtcacgtggacgtgcgtggccaccctccgcactagcaggattaaatgccataaaacagcttgaccatggttcaacccatgacctgtgcctgggaggaaagattccctaccactgagctatgacttgtattgtgcatttgctatagaaattactatatataaactggattaagccggtggtctgaccggttgaaccaatcaaaccgtgaaccaagcacttgaccggttcaatgtccggtccagtcctaataactatgatcggaggtgtcatattcctatgtattgcatctaacttgttgtgggtaacaaatcaagcccatgaatgaccgacaatggaggaactattggaaacttggaatcctacctgaaaagtggttgctcccctggtactatatttgggccaggccaatggagtgtactaatcttgggttcctactaaaatagatttgaactgaaaatttctaaatatataaccaatagaataatctgaaaacaaaatgatgcacaccctatgtaacaccctgaagattcgaccgacaaaaatctaaactctaaaaatatgggccttcaaaaactttttaaataaactgcataatgccgattttatttacctattccattgaattttgatttcggagtttgtagaacgcaaataaagaacaattgattaggaataaaacctaaaattaaatgagcaaaataaataactgaaatataatttaaaataaaggttgaggtgaggatagaaatgaataaaataatatcgcgatcatattcgtattaattaaatctaaatacgacggagtgagaattaactctaattaaaatcaagtaaattatataaaaataaaatatgggtacaattaatctagagtggatccattggttgggataatacacatattgagtaaacttcatttatgcaagatttagaaattatagaatcaaatttatataggaaataaactaaaatcgggataaatgggaaaatacactgttcattatggcataggtgttcgatgcagtccctagccttccccctcctctcccacctctgcgccctagccggccttgagcccacgtcgccgccgcccgtcgcgtcgccgctccgcgccgtcaccgcgcgccgccctctcgccgcctcgcgcccagcgctcgcgcgtcactcgcccgtcgcgtcgtcgcctcgcgccacgcgccctgccgcgccgctcgcctgtcgcgtcgccgccacgtgccccgcgccgcgctgcccgcccgtcgccatcgccgcctgccgcgccacgcgccgcccgtcgcgtcgccataagccaccgccccttcccctctccttctccccctcttccctataaatacttccccctctccatttcccccactccatctccctcttcctcccctcttccctctccaccgagccaccgcctttgtgtcaccgcgccgctgcaccgccgccttcgtgccgccgcgctgtgcgccgtcgtcgcgccgccctcgcgccgccgcaccgccgccttcgtgccgccgcgccgtgcgccatcgtcgtgccgccgtcgccgccgccgccgtcggtaagctgccacccccttcccttgttcggccgccgtcgccagagagccgagagagagaagggagaagaagccgggagggagagaaagagagaaaagaagaaagagagaagaagaaagagagggagagaaaagagaaaaggaaagaaaagaaaagagaaaaggaaaggaaagaaaaaaggaaaaagggaaatagaatagggaggttaatagtttagaaattttaaaataattataatttaattatagattaattatagtcgtaga

SEQ ID NO: 58402 - DNA, 5453 bp, Oryza sativa
aatcgatatatttttgcgatttccattacaatcgtattatttttttaaaaaaattcgctcatgctattgacacctcgtataatcgtatacatgagacttgagagtactaaacaagcaaattcacctcaatgctatctaaaaaaaatgaaaatagttagcaacgttacattttgtggcccacttcattgtaaagatgagcccgacccctctatatttggctcaaccgttaatctatcatcaatcattaaattttctctttaatgccaatttaaacgattctattattgactatactatccatgcatgttaaacgcctatttattttctctctaatgccaatttaaacgattctattattggctatactatccatgcatgttcaacgcatccttttttttcctagttaattgtatcgtcctatggttaatggatagcaaaccataaattctttccaatgttacacattttatccatatacccattttcaaaaaagaattcacctttcttgtcctataaataggcatgatatcctacccttgtgcttagaaaaaaaaaactacccaccctttgggttctgcacctaatagcaactggtatctaaggtttcgtgtttcgccatggcttgcaaggttgcctccatatttgcatccatcctaatattgtcggtcctcgtcatgtcttgcggtaatatcatagtatacgtacactctttttgcgtattttatgaagcattgggggctagtaattaactaatttctcacatatatatacttctcacaaacaaaaacttctcttaattttggcttgaacagatgcagctggtttatcctgcccaactgtaagagcgccgaatccgacctgcctgagccctcaaatttgtgctaatcagtgtgtagcagctggttatttgattggattctgtgagttttatggtagtcgattgggtgactgcgtgtgcaccaaatgcacaaatgctgtgcaagccggccgtcctcctactattgctcctactcctgcagtgagaaggttgattctgtgagaaaaatacatggcatcatcaatttgtgatggatacaccatgggaataaattaacttgtgtgttgacgattgctgaatttgttgaatcgagttgttttcttgaccaagtgttgaatcgagttgttgagaattaagaaaataccaactatatatatggtgaaattctaccttatttggtgaaattctaccttattgtgtccggcgaaattctaccttgttatagaggaaaaacctgagtatttttcgccccttaggccttgttcggttaatccctgtgagggagggattggagaggatttattccacacctactgcggtgtggaattattccccctcaatcccctccaatccaatcctcttcaatcccctttaaactgaacaatgtcttagtaggggtgttctatgttttaccacccgtacatgatatgtgggtcatgatcaacctatagtggcaatgactaagtttcaactaccagtgaaccgcaaatcctagagttcgactaatagtgggcgtgttcggctggcagtgttgtggctacaaccgtgtatcgaacgcaccctgtaaagcaggaaatttctaaaaagaaaatactgtgcatattatgtttgtttatgattttagtacgatccatcgctgcgctgcccatgtggaaagaggaatccaattttgcgttgaaccgaaacttgcagccgttaataaacgttaggagagaaacatttgatcatacaaccatcataaacagaaatcacgtataatcggtgctcaatcctcaaatcccccgtacaactgatgtttttcctcttgtgtatttacgattttacatcaaggtgatgctgaagttagcactggaaaatttggataagttgatatctgatttttttcccctggagaaatctgtattctgatgaggattgcataatgggcagtcagtgcagtaaaaaggggaaaactttactgtccaacatgattcagctgcccaatttcttaagaaaaatgggatatacaagtgtaattggcttgatcatttttttttaaaaaagcgatttcttcactacaagaataggcagggcacacatatataggttctcatcttgcaaaaaataaataaacaaataaatttcgactactacctattacgtcttgagctcttgaaggactttttaagtcctgaacttttttttaatacgtaaggagcgcatttttttatcaagaaggaataaatgtacggaaatgctgcgtgctgggcgtccaacggcagaagaaaaaatcgggcgcccacgcctcccaccgttgctactttaaatagttttaaaatgatttttctcctaaactaattatccaatttacgatccgatcacgccgttgtattcgttgcaattaaatctttacaacaagactacacatgattatatttcgataaaaaaatattttagcttttttattgatatgttttgaatgttacatatgatctttttgatgtttcgaccagtagttttacggtgtttcagttagtgtactcgcgatgtttcactatgtacagatcaaatgttgcatcaaatgttgcagtggattttgatattatggaacgcgccgttgcaacaaatcacgcgcatattatggaaaccctctattaagggaatttggtttattttttattctacacaaaatgtttcatctagtgcactcacaatgtttcactatgtatagatctaatgttgcagtgaattgaaatattccattgcaacaaatcacccacatattttggaaaccctctattaatggaattcgttttattttttgttccacacaaaatgtttcacctagtgtactcacaatgtttcactatgtatagatctaatgttgcagtgaactgaaatattttttcactatttgttgaaacattgtttttatataaggtgaaacaacacctgatttaaacgagtgagacattttcgatctacttagtgaaacaattccgatatacctgtggaaaatcgtgcaacatttaaaaataattcgataataagataattttttttcgtcggaatatatccatgtgtggtcttgttttgaagatttaattgcaacagatttaatggtgcaatcggatcatgatttggataagtaatttaagagaaaaatcagtttagagtaattttgcacgtaaatgttttggataatcatgttattctcgattttaacctccttctatcggccgcccgagccggagtggcgtccataaatgtatgtacaaagcgggccaaaaagacaaagcaaaagggacgaggtacaagaggagaaccaagaaccaaaagcctaatctccaactaaattttgcgacccttctccactaacatgagctgccaaaacagggattgcagctctagctagctgccacagctccgtttcacccgccataacccttgcaacctccgctcaagttctgctcttctggctgaagactcgattgtttctttcttttcagatcgtccatgcaaccaacgtcgtgatggtgtcaaaacctcggcgatcgtccatacaaccaacgccacaatggtgtcaaaaccccggcgatattcctttaccatcttcttgcgacagagtcctgaacttcctaacctcgttctcgaagaaacgtgccttgtgttccttccacgccgttgaaaagctctggtgctatttttttttcttacttagattttttgtagataacttttgttaattagataccaaggagcagctgaacctgaacgaaagcaatttctgcttcagaggacctcgatgaagtaaaatggaacaaagtcacacatagcctaatcagggaatgcatgccaagtctcaaataagctggatcatcctgcagttagcaagacactaagatattaacacaatcctaaatgccattattagttagctgtgtggatatagagatcatatttctattcattattaaaaaaaataccattattagacacagggttaatacttaccccttatccacttatacatcttgatcaagatttttatcaaatcatcaatgccatccatttccaatcagtggctgatttcttacaaatagtcacccctgcagatcaaatcctgaaagtgcatctaggaccctaatgattttgatgattgattacaatgcgattagagaggactaacacttttattcaagcaaatgtgaaggttgttatgtcctcaacatgttgtaatgagatgcataccccatgaatgcgacatcacgatgcaatgcggcaatgatcaaatggtatattgtatcttttaccttacattgtgtcgtaggaatgtcgtactattaagagggataccacatgcatattattggtagaatactagtgctcaaaatgcttcatctttgtgtgagttgaaaaacctaagtcaaaatttcaatcccgagttgtttcacttgtcacaacacttacaccgggtttctttgcaagtttttcaacatctcttgaaggttttggaccatgttttatgttgggtttgatagcccacgaaactagctttccatagagtccaagatcttcgaaatcggagttcggagtaaaaagttattgcagttttactttagcaacatcagactatccgatttgaaatcagactatccgatgtatcggactatccgatttttcacagaacttcactctctatcttgatttgaaaaaaatcctatcgagtgagtttttctaagtatcggagtatccgatgtcggatcagatagtccgatgatacagagactccgaaatttcatagaacttgagtctctgtttgaggacaaagtttttgcttctaaaatatcagatactccgatttaacatcagatagtccgatgtctcgaaaagtccgaaatttcatggaacttcgttctctatttctcgttgccttggaggtttaaaatatcggactatccgatcttgtatcggactatccgacgtgggctgaaagattcccctccaacggccacatttttggggggtctataaataccccccacctaacccttttctagggttacccaacccatttcattctcattcactttgggttgagcttggtgctaaggtgctttggatctttgagctctttctccctctctcaaatccctccttgttctttgtgtggtggatcttggtggttgtggatttggtgtttgagggcctagtgtgtgtttcactcgatcttgagcactagggtttgaccaagagttgtgtggtgtttgttactcttggaggttgagtactcctagacggctaggtgtcactcccgagccaccgatctacgtgtggttggctgagagaagtttgtgaaggccggatctcacctccgcaaggaaaaagataccccttagtggaaggaggagtgcttagtgcaacctcttgaggaaag

SEQ ID NO: 58403 - DNA, 1053 bp, Oryza sativa
tagctttgcttaattgtgccgctatagatctagtcgctgtttgtgctttactcttgtttgtgtgatagatctacttgttgtgcttcattggtggatcggacagtctgatccaacatcagactatctgatattttcggatagtctgactgtggatcagactttccgaccttatttcagttttagcttctgcataaaattttaaattagcctattcacccccctctaggcctaattgaccctttcaaatccaaccaaatccaataactccatcccctaaaaaaaatccaataactccagagatttcagctttcaggcttttagccatggcttattgcagctgcaagctcacaccagcagcaatggtggcgtccatattattcctggccctcctcctcctctcccctccctgcagtaagtacacatgccaaaacaaacagcagcaaaaactgaattttgatttggtttacattcactctagtgtgttcatagggaagcataagtggtgtggtagtgaagtcatggatgcataactccacctataaatatttatatccgcgaatattacgctgttgacagaaaatacgaggcctgggagatctgcttaactccagtgcaggtccaaagctcgccttcgaatgtatgagcttgccagttgatttgatcctataatcaacaagaaatagagacaaagaattcgtggttaaatctataaatgatagctgatcggctaggtgccgatgacatatcatttatctttgagccgatatcatatatgaatcgatcggcggttataaatagatagtaaggaactaaatctattcgatcggctgtagatattaacgatatatagttcttatattaatatatacttaaatcaagtgattgggatagatcggtcaccatgccgagatagtataaatcacttagatcgaaatatatattaataacatgattatatatgtttatagcatagccgatcagatagatctagaatgtatcgcgctaatactccgatactactttatataaagatatcatgatgaactactgtac

SEQ ID NO: 58404 - DNA, 35345 bp, Oryza sativa
gtccaccccctcgccgagtccgccgaccgccggaacgccgtcgaccccgtcaacccgagccgcgccgccgcctccctccgctccggccgcctttttcgtcgtcgccgtcgacctagggtgagccgtggaccaccgcctcttttcccccttcccttctcctctctcggccgccgctccgccatgcctatggccgccgccggcgaccataggggtgcgggcgccgcctcctgccggccgcgccgagtggccgccgcgtggggcccggccgtcagccgcccgcgccctcgggtgcggctgacgcgtgggacccacggcgccggccagtgcgagcccgggtgcgcccggtccacgtggaccgtgaggctgccgcgtgggccccactcccgtggacctggtccgcgcgcctcctcccctcggctgacgcaataaaccctttttaaattaaaatttaaatacagaaattcgcaaatattcatttaaagagcatataaacttcaaatggccataacatggccatttgaactcggaattggaccgttcaagtctctaatttttccttaagaactcaagaacccatttttgtgctttgttcctgcttattatatggagtttattagagtaaaagcccttttattttccgttggtcgtgtagacgttgcagcttcggaagatccgctcttcgtggaggttgaagctgacgtttgggaaagtgagcaaggcaagtcacatcatccttgaacatattgaatcccagtttaaaaaattattttgatttaaattattgcattatcgctttatttaaattcccgcgttatcactgttttatctagccatgcttatttacctttgttatgaccttattattgttattgttattatttccttgttcaccctagaataaacaaaaccccaactagtggacactctactcatggtaccactagtatgattttaggtagatgcttcgctggttaattaggcaatattaggtggttttacaactctagactttgggaatactcttatcacctggacactatggaatggttggattattatggaattggactcacacctccccctctattcaaaaccctcaaaatggttttaggctgggctcggggtgcattgttttgatagtagcacctcggccatataaggaccgatcttcgggcctctgttgcaaagcactaccgtacttccacatgtctagtgggtaaggcttagtttgtggctcagtctggttataaacaaaagtacacggatggagatggatgaagtcgggagtcgatggacatctctagggcaaatgaaggctacacgagctgcggcccggtagtcgagatgtcatggcacagggccggtgtcctgctgttaggggttcaatcctgcctacctgtcccgggggttccggccgtaggtggggttgggtcggtactcttgtttatggctaggatgggttggaaactatgtcatgtcttccgtccgtataccgtggtggtatgtggcacgtggttacacgtgagaaagatgtgtcttgtgggtaaagatgtacacctctgatcagagtataacctattcgaatagccgcgccctcgtttatgggcaagccgagcaatgtacccaagttagtgttttaattcttaaaacctgcctaacagctaaaatgtggaatggttggcctgggttggcttgggacgagctgggacccagggtcgggttgccagttcggtctgaatcatcgtaggccttgggttaaggcaggttcgtgtgggttcacggccttggttaataatattgtatagctctaggaccgtgtttacaaagtagctttgagcaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgtcgtcaagcgcctgtggtcgtcgccctagtcttccgctgtttttcgtttgtcttcttgtgtgctgggccttcgccgcccatgtaataaattaattaattacgcttccacttgttaaactctgaattgtatcaatttttggtgtaccttgcctcctgggacaaggaataatgtacgcacgtaaggaacgcccgttgggttatttccggtcgtgacaacatgacagatctattccctgacgtcataccccgggtaaactttgtcatcactaaatttcataacggttagccgattcattacttgactaatcttttgttcctgttctgtagacaacagtgtcctcccctccacatcagagcaatagtggtaggaacattgaatatgccccaggtctgattcctaatggaggcggattgtccccctctatcatcggctatcatgcccccaaggtctcaaccctcctccaaggtgccatcagggaaccaaccgatgtaaccaagaaaagaaaaactagatcatcggctgtgaacaccttgactctagctccaaagaaaaaggccaagtctaagaaaaccaagccaaccgacgacctgcctgctttggatccatccattgaacaagctctggatgaagaagatattgaggatgatgttgatcaggctgcagccgaagtaagtgatactaaaaaaacaccatcggcttcgcctaagcagataccttcaactccttctgcccccactcacttcttcagagtaaaacatctttccttgcaaaccctattataatcattatttttcagccgactactcataggttttgtagttgcaaaagaagaaaactgctataaagaagaaatcagcagcaccaattctcaaaccagcttcaccagtaagacactctcaattttactagttgattttagccgattttgtctaacacttgtctttttacagcctcctcctccttgttctcctgtacaacaatcaccgagtgaccgaactccatcggccgtggggagtcatcatattgtggaagaagaacaaccggctgctcctgctatcccagtaagttttcctttgatgcaagaatttagatcgactatattgacttagctctcaaactttctgaacttatacctgtaggttctaaccgatctcttttcttttgatatcaaagattatcttgatgaggcagaagaagatacttcaagcaaagctctagttcccttatctaacgatgcaaagaaaacacttgaagatatctcgcgtcggctagaggcctcttctctggatagcttagtggtcgactgtggatcgattaggacacgattgcacgaagttcaagctctaattcctgaagaactagccgatgtcttaactccagccgcttatcttgagcaacatcaatttaaactagcaaaagccaagctaagattagccgaacaccgtgagcgcaaggagattgaagccacaatccaagtcaatcggcagcttgtgcatgaagaaaaagtcaaactcgatcagctatccgaaggtctgatcaaatccaatatcgatcggcttgaagcccgcaagattgatctctttgcacagcttgaagaatgcaatgctgaattggatatggagcacaaaaagctagccgatctcccaaaatctgtcgaagagcaaaaagcaaggctcaaatcggctatcaagaatgttgctgacctaaccaagtccctgaagatcatttctggaactgatgctcaagatgcccaagccattgaagaagtggaacaaattaggaaaagagctatttcggctatccagcagtacttgtctcaataacttttgtgtaataggacttaaaaattcttgtaatcggctaagataccttaataccctgctgttttaacaatccttcgtgccgattaacataagttctaattttcactttcatttttggtatatatgtgccccccaattttataatgtcaacagcattgataaaattagaaaaacaactaatggcgatataacaatatcggccgttatatatcggcaaaccataaccgattacaattggaaaaacgactaagggcgatataacaatatcggccatctcaagacgatgtaaaacacatcggctgtcatgcatcagcaacactagtcgatcatgcgtcaacccaaacacttgggtaatacttcttcaagtatttgccattgagcgctcatccataaacctcaccatcaagcccttgcaacatatatgcccctttagacacaaccttatagatttgaaacggtccttcccaatttggtgaccacttgccgaacttgttatcccgagttccaatcggtaaaatcaacttccatacaagttcaccttccgaaaaatccttaggcactactttcttgttatagtgcctagcaactcgttccttatctttggtaaccttagtaagggctcgtaaacgcgattgaaccaagtcctccctctcatcggccataagattataatactcatcggctgtcaaaccatcttgcaattctatccttctagagccgattctaacttcccatggcaaaacagcttcatgtccataaacaagcttataaggaggaacttgaattgatccatgacaagccatctgataagaccacaatgcttcggccaaccggttatgccattgccgaggataatcagaaatcttccgcttaattaatttgatcaagctcttgttagatgcctcagcctgcccattagcttgtgcataatatggtgaagaattcaataatttgatacccacgctatcggcaaactgaacaaactcatctgacacgaagattgaaccttgatcagttgtaatagtttgaggaataccaaatcggtaaattatatgttcttgaacaaattgaattgcatccccagaatcaactttcttcaaaggaatggcctccacctacttggtaaaataatcagtcgccaccaatataaacttatgccctttacttgatggtgggtttatcataccgatcatatcaattccccaacctctaaatggccatggtttaataataggattcatagctgacgccggcgctcgttgaattgccccaaacttctgacaatcttgacaccccttataatatctaaagcaatcctccagcattgtcggccaaaaataccctgcacgccgaagtaaccacttcatcttatgggccgattggtgagtgccacaaattcctttatgaacttcgccgattgcaactttagcctaatcggcactcaaacacttaagtaacactccatcaatcatccgataataaagctcatcatccaatagagtgtacttcaacgccttatatcttaatttcctagaagccgactgagatgtattatgtaaatattgatgcacatcatacctccaatcatcggctgttattgctgcaatttcaaccttaacatctttgatcatcggcttataccccgatgccccttgggtcagatcattagcttcaatattttgttctcgagatacatgctttaaagtaaccagccgaaattccttcatcagttcttggcacttctcattataaactattaacgtatcattcttgcattcatactcccctgccaattgactgattaccagcaaagaatcccccatgatttcaatagcatcggcttcaacttccttaagcaattgcaaccctttaagcactgcttcatactcagcttgattattagtcgcataaggtttaatagtataagcaaacttgaaacatgccccctaggggaaattataactaggccgataccacaaccatgagtacacaccgatccatcaaagaataaagtccatggcaccatttcaaccgagccgattgaatcatcacgatgttccacaataaaatcggctatagcttgtcccttaatcgccttcgatgactcataccgaagatcaaactcagttaaggaaaatatccactttccaacccttcctttcaatattggagccgataacatgtatctaacaacgtcggccttgcatataatagtacattcattggacagtaaataatgccttaacctcgtgcatgaaaaatataaacataagcataacttctccacaggagaatatctagtctctgcatccaagagccgacgactaagataaaatacaactcgttcttttccatccaactcctgaatcaagactgagccgattgacttctcaccggccgacagatacaatctaaaaggtatccctttctgtggaggaatcaaaacaggaggggaactcaggtatcctttaatattatccaaagccttttgctgctctgccccccaagtaaactgctgatcggccttcaatctcaacaatggtgtaaaaggttctaattttccggacaaattagaaataaaccttcgaacaaaattaatcttgccgatcatctcctgcaattcggtcttgttttccgggggcttaatctttttgatcgcattgatacttctctgagttatctcaattcccctctcatagacaagaaatcccaagaactggccagccgataaaccaaaagcacactttgtcggattcatcttcaagccatatttcctggtcctctcgaaaacttttcttaaatcggctatgtcgtcttttattcccttaaatttaacaaccacatcatcaatatagacctcaaccagccagccgattagattatgataaatataattcatggcccgttgatatgtagctccagcactcttcaagtcgaaagttataacaacccattcaaataagccgattgcaccaggacatctaaaagctgtcttatggatatcttcttcagccataaaaatttgattataccctgcgtttccatccataaaactcaaaattttgttccctgacgcggcatcaaccagttgatcggctactggcattggatattcatctttcggtgtagctttattcagatctctaaaatcaatgcataccctcaccttgttgttcttcttgatgacaggaactatgctagaaacccactcagcatatcggcaaggacgaataaaactagcatcatataaacgcttaatctcagctttgacaggttcaagcatatcggctttgcatctcctcggaggctgctggtgcggcctaacccctggtttgataggtagccgatgttctacaattgatcggctgagtccaggcatctcataatactcccaagcgaagcaatctctaaactcttttaagagctctatcagcttggttctaaattctggagacaaattcttactaataaatgtcggccttggctgatcgcctggacctatatctatttcttccaaatcatcggccgacataaaaccttgaccttgcttgtcatcgagatcatctaccgtatccttagtgtagacacttgaaccctccacgacgccctcaaaataatagcttgggttctccatcttcaactggctgtatatcagaatcagacacttttagaaaatctccattccaaacttttccagataaacaatcaaggccatccatctcccaaatagctaaatctgcactggtaacattaactgacctgtcggctggtacgatctctattttgtcgccttgccactgaatcaagcattgatgtatagttaaaggaatacaataattggcgtgaatccaatcccttccaagcaacaagctgtaagaacccttcccatcgatgacaaaaaacgtggtaggaatagtcttactgccgactgtcaactccacatttagaacacctttggtttccgatggattgccaccaaagcccttgagcaccatatttatcttgataagatcctcggcatttctacccaacttcctgaacgtagcataaggcatcaaattcaccgcggccccaccatcaaccatcattttagacatcggcttcccattgacatagtcatttatatacaatggtttaagatgccgattctctgtcccctcaggcttctcgaacaccgcctgttttggtgacagaaccaacttagccgattcctcttccacctcgtcgacatcggcttgatcgatcccgaattcagttggcaaggtaaaaaccatgttaactagtgccgtcacaacactctttccttttaccaacctctttgcctcatcagctgcaacatcatcggctacatgagcctgattcttaacacgccactcctgcctcggttttgctttcttcagccgatgattaatttcttgctcgacctcctggaagcgttctctactcctcaatctttgaacccttcttttctgatttttcgtaaaaataccaggaggacaccattgagtcttcttattttcgtcatcttccgaatcaccacgttggtttactgggcccaatctctgatgaacaggtactcttgtctgttttggccaatttcctccatcgtacaatcggcttgaaccccctgcaacatcactgcatctaggacaatcctcgatagatggtaacctcatacattcattccaacagaacctgaagaactcacagccccaatgaggatcaaagccaccattatcttcttcatgatgcctttcctgttgcttgtcgtatttcctttgatatttgtttataattctagctgaacttacttgataacccctcatgcgccccgtatcagttgttcgaccagctgtgtgtaccatgttaacgggaaatgggttaccatcgaccctcatcggctttttggaatcatcaaacttaatcttgcctccctcaatggccacctgaatctgttgtctaaacaccttgcaatcgttagtagaatgggacccagaattatgccatttgcaatatctctttttgcctaattcctcatccgatggaatcgtatgaccagcagggagttgaatttgcttctctcggagtagcagatcaaaaatcttgccagctttagtaatatcaaaatcatacttctcttcctttccagaactctttacccattggcacggtatgacctttttactcctcacccattcggctgcagctatctcagagtcatcttcatcgtcatccgacccatacatgtagggacaaacatgattaatcttcttagagcttttcctagcctccgcagacctatgctcatgcaaggttaccttttgtatcagatgtgacaagctatcaaagtcttcagacgagaatttctccctaatcgtgcaatcataccctgaaaggccagatcggctaactgagcgtcagttaaactcaagctgaagcatttgttcctcatctccctgaatctctgatatacttgtgcacaggttcatcatgccgctgcttaatcgccgtcaagtcagataacttcatctcatgaaccccactttagaaatagctgtggaattgcttctccaaatcggcccaactattgatcgacccatacggcaaagaagaaaaccaagtaaaagctgatccagacaaagataaccggaacaacctaaccctcagagcgtccacagccgatgcttcaccacactgagctaaaaatcggctaatgtgctcataagttgacacaccatcttgtcccaaaaatttggagaagtccggaactttgaaccgattggggagaggaactctctcaaaccactcagggtaaggctgccgatacaagcttccagtctcttttggtttaagcccaaactgttccctcattacatcagcaatcacatcggcccacggtcgttgctgagctgctccctgtgactgttgttgcatgggctcgaactgaccgtactgagacacaaactgaggttgagccagtccccctgactgatattgggcttgcggggaaggatgatgattttgataattcaagttgcccctggtaattatgaaggttcggctgaattttacgtgccaaatgctcgggaacaacttgaggcattactgtgccatccggctgtacatggtgaaccaagtgttctgggacgacttgatttaaaattgttgtacaggctgtccaccaggcgtcacaaacccggccgatacgctcattgagccttggtgctgaatcggctgaacgatttgctgtcttaacgacgtttgctgaatcggccgcggaggctgttgccttggtggcgtttgctggactggttgcacaacttgttgctggattggttgtacaacctgctgactcgggagtgtctgttgaatcggctgctgctgtattggatcaatagcaggttgaggcggcagaaacatggcagcaatctgatcttgcgttggccgattcacaacctgcccactatgctgtggctgctctctcattaacaaccgagggtttaccagctggcctggtgccaatactgacggagtaggtaagggagtcgatgccggctccgtcggctgagctgatggtgcgacggggggaactgcctgaatagatggttgggtattagtgatcaaaggccgataatttggaaagacacctccttgaaaataaactgggcctgcagcctgatgctcaactattgatccatcggctattgacttcatcatgtttgataaggtattgactaacaccctagactgattgatcaaagcatggtgcacagcatagtcgacccggtcttggaaattattgaaaaaatcttgtgccgcatcactattctgattaagatttctcccttgcaacccctgagcaccatcaccttgaactccatgcactccatcgccttgaactccatggaccccttgagagttgtcaccttgacttcctagagaaccgtcggtagcccctttgtcactcagtcgagccgagccatctggagcttgtttcccgtcttcacctttggaagaactggtcccagggtcatcggcaactacctttactttatacttctgaaccaatgttcccttgcgggtctgcatgaatgagttcaagaactgatcccgggcttgctgcaacattgcttcaaaatccttcttctgctcaggtgtgaatttctctggatcgataggcacgacgtttccttcattgatgtcagtcaaccccaacttctggatcttttctttaacagtgcttgggctagccgaggatggcgacagcggtggcttctcggccatgaggaagaattgcttgctgacttctaattggtcccaccaggcgtgccaaaagcgtgttgacagaaaacacgaggcctgggagatctgcttaactccagtgcaggtccaaagctcgccttcgaatgtatgagcgtgccagttgatttgatcctgtaatcaacaagaaatagagacaaagaattcgtggttaaatctataaatgatagtcgatcggtaaggtgctgatgacatatcatttatctttgagccgatgtcatatatgaatcgatcggcggttataaatagatattaaggaactaaatctattcgatcggctgtagatattaacgatatatagttcttatattaatatatacttaaatcaagtgattgggatagatcggtcaccatgccgagacagtataaatcacttagatcgaaatatatattaataacatgattatatatgtttatagcatagccgatcagatagatctagcatgtatcggctaatactccgatactactttatataaagatattaaaacaaatataatataccaaacaaaagcttaatatacttaaatgcaataagatcctgacataaagggcggatttaacatgtcattgaagcatatagatcgaatatggttaaatcagataagatcggctgaaactccgatactaccctaatcggcaaccagaggacaggctagagattgatattctaagcacgacttaatagatcaaactcaactgatgcagtattaagtatgaaaagaagaacaatatctagacaatcaagccgctgggttttcataaagtggtagatatcttatataatctagaacaacatcgctatttaacctaatcggctgtcttctattaacagatgttagccgattgtaggttagatgatgatattgccaaagattatgtaggatatatgataacttgacgaattatatagacaagattagagtgtcataaagatagaatcactaatctcgagaacgtaagtcgtcataacaagttttacctcttgttgaagatcgaaaccgatgcagcttaacccgaaagcaagaactcgtcgaaacaaaactaaagcaaaaaggtggcgatgcgccgaaattgtattgaacgtgtgtgttctttttttaaattacatagggctcggggtctatttatacccgagaattacaagatatgtccataccggacacgaccactatctctaacaaactctagacttttgcccaaacatatctctaaggaagttacataaaacagcataattaatagatacaattgccttctcaggactctatccatgtgcggcaatcatcttgaagcacctcaattcaacccaatatcatacaccaaatcatactgtcagaatcggccgcatcagctcacctagtccgactcagacccagctgatcctaatcgtagccgatctggatttcagccgattcttactctgttctcagatcaatctccgccttcgactccaccttgatctaatctccttttccgatgctgatattaccaaatttggtcgttaacatacgcacataccctcgaatgttagtgagaataggaatataccgttggtttccctttctgtttcgtgttaggaggcatattcgtgggtgtgtaagtgtggtgttgtgtgtgtactagtgtatggtgtatgtacgtgtgcgtctgtctgccatgtaattgaaataaggaaaaaaaaacaattctttgctacataatgatggcgagaaaattgtttgtttgtttttgttttgacaggtgcaaagcacaagagggagtgtggcgagctgaatgcgccgctgccgctgtgcgaccccggcggcgacgcctgcatcgcgtggtgcatcaacgagggctacgccaacggcaagtgcttcgtgtcgaaactagatttcggcaataataaaagggggtggctatcaagctcggaaagtgtatgggtttggagacaaggaatttatacaggttcaggccttcttataaaagaaataataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacagtagcccccgagtcctttgcagtcgaccatcatagtcttctcaaagatagtaatccgagtgcttcaaactcttcaagccaaaacctgccgagtggactgtaaagggcgaaaagataaagaatatggtgcatcgaatagatgcacctaattaggtgtagcccccaactatgtgattagttaacaaactaatcatatagttgaaagacaaaataataacacaattgtgcattatatgacaaaagcatacgcggcgcctaaataggcatgctagccgaccgctttttagccacaataaaagaaatccgagtggattacactctaaaaggttcacgaatgaacacacttgacaggcatccgaatataaaaactctaaagattacccatcaagtattatgaagattatggtaataaataagtcgaatagcctaggccatgactatttaccataatgaaaataggtatatcacataccaaggaagtgactatagtaaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggccaatgggcgtcatccgacgtaacagaagagaatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccgtagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggctggcatgcaaactggttctatgttcagaatcccgagcctgctcttcccgggtactcttgtcttcctccagtgtaccaagatacttggaactctcttccaatcggagatgaagcagtacaagccttggagttgttggaccgtatgttaaatcttaaagaacaaggtttacagggagagcagatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcagctgccagtagtgccatataatgcgttcaatccgcctccgcaggtatgcatctgaaatcctcaatctatggccaaaacataatttcatcttcatgctgagttgactaactatggaagcatcttgtgcaggaatatgcattgatgaagtcagatccaccagtctctcagcgtcggtctcctcgccaacacaccgttcagggaggtggagggccaacgatcagaccagatccgcaacctcagacctccaaattggctggtcaaacaggtcctcgcaagagaaagctggttcttgatgatgatgaaggcgacgatgataaatctggggataagggctcgcctaataaacccccaaagcgtaccatgcccaggaaaaaactggctggccgtgcaatgccaaagatcagaacatcttccaggtattagacctctcgatatgattccgcttcagcatgttatgctcatgaaaatgatgctgaatactgaaagaacactttgcaggaaaccatctgatatagatccatctggaaaagaccccgatcctgccatgacagagcaaaatatatccaaggaccccgagccgactgctgaaaaccagccgactgctgaaagccagccgactggcgcccatgcttcgggcgatagggccaacccaagtgacctgccgccgactggaaaccagtcggcaacaaccgaagcggcaacaactcaagaacccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtgtatccgtctaatgtcttggaaacacatcaggaccatcaggtgatgacggagaagaaattcctcgcataaaggcgaccgacgactctcgtcctcctatcttgatcaaatggtgggacgagaactcacaagctgccggcatagtcataaaccgtcaaaaagaagatgaagaagtgtgccagctgaagaaagcgctcggagaagccactcgtattgtaaatgtaagtcttccgagtgacggccttcagtaactttgttttctttttagcagaactgaaccatgatccatcatgcagagaatccatcttcgcaatgaggccaagactacaactttggaaaagctggttctcatttgggaactctagaagcagttagggaccagctgcatgaggccaaggagtgcgccaaaaagacagagaaagagttaagggaccgaatcgcccagctccaggatgcaaacttcgagctaagtggttcatcaaaaggtaatcatctagatctgttccattgatttatactgtcataattgcatcctcaaatatttggatttcaaacagcgcaagccaccagaatggctcagatggaaaaacagattgaagccttgaaaaaagacaaagcaggactggctgcagaaagggactcagccttgaaagaaattgaaggtactgccggctgatgatctgaactttcctctttttaatgcagtagagtctgattgttataaatgtgttctgtagaccgtaaaatcaagtctcaagctcagtttgacgtcctggttggtaagatcaagaggcttgaaggagcaagagatgaagtcgccaatgtcgctacaccactcatccaagccatgttcctcaataacagtggtccgagtgcactcgacgcaaccgaaatattcgacaagctgagtgttgctccggatgtatatttcaaaaatatcaagaaagctggaagtatgggagctagcatggccttggcgatgacaaaatccttgtacccgagaattgaagttgataccattgatggatttgcagacgggacaagtgaagaagctgctcttgatctcatcaataatgcgcagagtgcggctgacaaaattgcgagtgatgttgtagagcaattccgcaacaacgacctccagccgagcgataataactctgatgatgaaaggactgattctgactgagtgtaaatgtaatacatggaggctcaatttgtacaatactggtgtatttatgctgtgcttgatgattcttgcgaagtttttgatttcttaaaagtttttgctaagctttattgagcctaaaacccaaagaagctattaaaaactttcagtcctcgcaaactaagtagaaaaaccaaacaaggcaatgataaaccaagtaagcaaactgaattgataaaaaatcacactccattattatgatgatagcccccgactggcaacttcaaggagaaaacttgatgtttgacagtcaaaatagggaaatacaatgataaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactaaaaaggcacgagatcgaacattgcgattatgataacgtcgcaacccttgtaagtaccgagctgactgaatcaaagctgcttcgcgggcctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccgttgctcattgggtgtgctactgaagcatagcaaatcttgattccaaagtcttcacaaaagtctttgaaaactccgccggtgaattgtgtgccattatcggtgatgatccgattgggtactccgaatctatgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgcaactcttgagctggtagatgaatttgtctggcaaaaaattggcaaccttcgcatgtgcgcacaattttgtcggcgtcggacactgcagtaggccagaaaaaaccctgccggtaagctttgccaacaatggtgcgcgctgcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatggcgacatcatgggtgcccgtaacttgagtggcatctttgtgaggtaccgtcggcgtataaaggtgttcgacaaaaacatcagagggcgctgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcttcatactcggcgacgttgtgagacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattaaaataccatataacagcttctgaacctgagggtacctcgttttggagtcggccaggacctcgctgatgaagtagattggtcgctgaactttctggacatggccttcttcctcacgctcgacaaccaagactgtgctcacgacctgggaggtggctgatacatacagcaacaacggctcctgcggatgtggtgaggctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttaatccaaacggcatggtgacgtagcagtatgccccaaagggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcccgctgctaacagcttggtcaattccaccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttccccactttttgaaattttggcagcgggcacttctccttcgctcaccgtggttgcagccaatcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaaacttgacgttacggaccactgggtctagtaccagggggtaccgccccgggtggaccactcggtcaggatgatccgagcggtcaaacttgattgcgatctctgaccatcgaagatactggggcgtgtcaggttgaacagcattgatctcccgttcagtcaacttctgcttccgtttagactcataagccagggggccgccaaagatatggttgagctccttgcggtggtcttgaaatccagccgggatgtcgccgtcgtccttcttccttgacgtgctttgttcctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaactcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtgtgattgtgtcgcgaagatcgatggggcggcgacgaggtggtgagcgaggccgttccactcggcgctccccatgaagttcgggaggcgagtgaacagaccgctcgtcgtggcccctgctcctgcgattggatcctgctccagtgatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggaacgattgagctcgttttggttgaggagggtgtcgagaagggtgatcgcggcaaccgcattctgttgaggggtgcggaaaaccagtgtcccttcgacatcttgctgaccgatgagatcacgtgctcggcgccctgcttccaaagctcgctgacgtcgatcctcagcctccttcgcagtccgctcacggtcctgctgctcgcgccgtagccgttcttgttcttgtgcttgatgctcctcctccagtcggcgtcgttcctcggtctcctgggcttggcgttgctcctccgtctcattattggccatgaaaacgccaaagtagagaggggtgtagttgtcatctaggcttccgtcgaagtcgtcgaagtcgttgaagtcgttgtatcgagaactaaatttgtcgtactccacgatgtcagtaggacgtgagtcgacggtgggagagctgttgtagtcatccagctgatctgtcgaaaccgtgccgagtggttggaggatgacgccgacttccctgaagctaggcgaactcggtgttgaagccgacttccgcctaggcctacgggatgaaggcgctgtcgtggtgaagacggccgctaaatcgtcggggagcttcatcaggaccggtgggtaagccccatcatcttgatctggtatcgttggagaagatgcgatctcggccgagtggtttgaagccgactcggttgagatggtcttgaagtagctttcagccgcgttcgggaatccaagcgggaccgaaagccggttctctcccgactggtctgattccgagtcgaggagagaaatcttgccgaagttgttggtgatgaagtcgaggctgccgaaccgaaacgcctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctcggaaagtgtatgggtttggagacaaggaatttatacaggttcaggccttcttataaaagaagtaataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacacttcggcggcgacaccggctgcacctgcctcaggccgtgcccggctccggctgctcagcccacgccggcaacgccacgaaaatgggctgattttcactgaaaatttttctcatcaggctttcagttacgttggtggtatacatgcatatactatcattccttcttacaccaaggaaattcatctttacggtgctctttagtgataatattctattgactattgccagtattatcaccaataaaaatgattcccataattggcttatgagttatgttctgccatttgtacgtattacatccgtgcaaaaatagttctctctaagattgtcacttttgagtattacatgctaagattgtcacttttgagtattacatgtctcatcaatcatcttcattttagttttttttattctaccctcaactatccttgcacatctataaccataccctatttaataaggagcactatagtctttttctttaaaccttaatctaccctaaacaatttagaatgacaactatactacgacggagggagtacatatgattcactagattaaaaaataaataaataactggtctagattaattatactaccacaaaacaaggatatcatttcatttactccattttttttaaaaaaaataaatgcaacagcatggatttgcacataaatgcaagtgtatctctctctacacataaattcggttggaatcaagctatgcacattaattcattgcagatgcaaattaattcctatatatatatgaacgctgcccccatcccatttacatccatcccagaaaattctctacacaaaaattagattaatttgctcttaattcattcctggacttcttgacccccctcaaaaaaaaaaaaaaacctctagttgtcgaacagttcatcatccatggagtttcagagcagcaagatcgcagctgcattcttcgtcttcttcctcctcgccaccggcggcggcgccgccggcgggtgctccgtcggcgagagcagcacgttcagaggcaactgcgagatcgacggcggcggctgcgtggagtcgtgcaggggcgaggggtacaccgacgggtactgcttcaccgaggtcgccaaccctggctaccacgtctgcacctgcacccgcggctgctactcgccggcgcagtcgacgaggaagatgatggcgcgcaattaattagctgatgattgattcgatcggcggcttgtttgaattgaatcgagtttcggtttaataatcaaataagaaattaagaatcaagcagagttcattcgaatgtgacgtagaggggcttgataggaatatacaggtttatgacaggggctattatgaaaaagttccagaactaacgccaagcgacgccaggagaaaattttcttagagacacgctataaaattaaagcagacacccataacacgtgtatagttaccctatgaacgtacgtacacacagccttctcatatgagtatactttcagaacactagaccaatattttttgagattgacgaagtcactacggacgtctcgttgcttaggggtgaaaacggagcggatattatccgctccgctccgaatccgtccgatgtgaggatatggtaagaatctttagatatccggccggatgcggatgcggatgcggattttatcatgcggatgcggatgcggatatggtatcaacgatatccgacggatgcagattatccggtattttaatcggattatccgatgtactgtttagcggataatccgcacctttcaggctatacaacaactctatttagcccattttacatcggacggcccatctagcctatctagtgtaacctaatccaatcctcccctaaatctctctctctatgtgactcttctctcggtcccttctcctgctcccacacgcgccgccgcatggcaccataggtgcgccgcgccaccgttgcagcctgctagcgccaccgtcgccactcctccttctagttcgccgacagtgtgttgtgtgctgtgtgctgtaagcagtgtgctgtatggaactagtgtggtgtgtgccgtatgcagtgtgctactgcgttgtgtggttgtgtgctgtatgcctatattgttgtatgcttcattgcctcatgcctgtcgtactgatgagtgaactactaaactgaacactacatttttaaattttaagcaacgcagtgaactgctgaactgaacacttatattatgtttttgatggatatgttatattaagcaaaattatattattgatgtgttttggttggtttttcatagagagctgagatcatgttcatatgttgtttggccatcgtattgcagctaattgtattgccgccctcttgttgtatggattgaatacaaacttgacatccgacaactttttgtccgtttccgaaccgagtccgcaccgactccacaccgaatccgacgtacgaaataatctgctccgcatccgcacgtcatccgcacccgctccgcatccgcttaaaagaaatggtttaggatatgtgacggagctcgtggctcctcaccgggagaccgcgcaggcccccctttgccggttcggccgggggcttagggtgcaatctcaagctctcgctctctctctgtatgtggaaagatcgtctgccagcaagaaacacgagacaccggcgatctatacaggttcgggccgctgagaagcgtaataccctactcctgtgttttggtggatctgtgtatgaatgagttacaaagtgtgagctgacttctcccccgttctcagcactcaatccgggaaagaatcaaccccctctcaatgggcaaggtcctccttttatacttcaaggggataccacatgcacccttccctttccaaactggactgttctttttctctttaatgggcggagattggtatggctgctgtccgaacgacacttcgatgggacagcccacacctacctccactcccggcggagacgggcgcaacgtgagatcgtggctgcccgttgctgatgcgatcagtgtcagaccggtcattcttgtccaccacgcgtcagtttaataacatgcatgtttccccttcttcgtgtaacacctcgcctgtaatggttaggatgaagcctggtattcatctaaccagggctaacgtgccatctctaagaaataacacgctagctccggcttgagacgagtgcctagaggctttcgtcttgacgggatggggcaaggcgtgcgtcagaccgccagtcgccacctaacccttgatctgaccggtctgtgactggtcacagaccggataaaagagcgtgctgtactgcgatgcacgcaacgtgacacgcttgaccagactgcaatgaatgctgttaggtgagcacagctgtgctcacttatcccatatatgtggcgcagacttctttaaggggtcggggtgccccggccctcggggccggggcaagcgcaacccgaccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacagtctcaatccatgcaccttggtactggtaactttggtggtccataatgggcggtctattcaagactgccacaccacttgagcagcgcgcgaatctgggcgagcagatttgtctcgctcggagatacggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaactagggagcgagatagcgagatacgagggagcgaagtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctaccttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccctttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaattgggacgactggaagagcgactggttctacaccccccttgccgacgaagcgcgtctccgacttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctctgcggaggcgtctcgcattcctcaagagatcctccccctctgcagcgatcccgaccgcgcctccattctaaccattatgatgggggtcggggcctcagaggagagagcccctaagggccacgacggcgcgggcgagcgccgccgggggaaacaatctgccccaggagggggtcgtgcttctgggccccgcgtcgggggctcggggagcagccgccctgccgacgcccaggggaaaaggaagctgggaggaacacctcccccatctcctccccgagggggcggggcggcgcgtgccagcagtcggcgcccggagggggccgcgccggcgtcgcagcccgagggggagcgcaagaagaagcggctccgcaagacgggggagacggagccatgccggggaaacctgatttcccctccaaggtggtcattcacccgaccccctcgcaggttcgtctcgctctcttcgcgatcgccttttcttccatcctaaaagcaagttttttcttactcattttgttcgtcttctggttttttcttctgcttcagcaatgtcccgtcgcattcctcccgccaccccaagtccggccagtccgaggccgaagatccggcggctgcagaggagcggaggcgagaatctgaccggcgtgaagccgcagatcgccttcgggaagccgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgtatcctccggggggccaagccgtgtcacattttctccaaggcggcttttctcctcctcttccgtcgccccggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagctcgaagcccgcaaggcggcgctggcggagatcgcccgagaggtggaggaggagcgagaggccgccctcgtcgccaccaccgcgatgatcgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagacgggcttcatggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacagctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggcggggcggctgcgggcggaagcgacttagccgctcgcctcgcggctgccgaacacaccgtcgctgacatgcagcgcgcgctggattcttccattggggaggccgaggccctccgcttggcgggcgagatggggcccgacatgctttgggactcagtctcccgcatggatcgcgccggtcggcaagcgggcctctggaaaggccagacgaggacgcgccctagcaacctggaaggcctcgctccgcacctcaacaggatggcctgggtcctcgaacgactccccgaggagctcgagaagaccatcaagtcatcctcgagggacctcgcccggggggcggtcgaactcgtgctggcgagctaccaggcccgggaccccgacttctctccctggatggcgctggaggagttccctcccgggaccgaggacgacgcgcgcgcgcgcgtccgggatgctgccgaccatatcgtcgacggcttcgaggggtcggcccctctgctcgcgttcgcccccagctccgacgaggagggcgacgccagtgatgaggatgacggcggcgacgaggccggcgacccgggcgcattggaatgagcccccaggcccccgccaatcttttttttcttgttctttcttctaaggccttcatgcctcttttttgtacaaattaacttaatctgcaatcagaagaaaaaatttttgtgttagttttagtttgctatgcaatgagctgaggatgatctgtgccgtgatcctcttttcgtgtcttagcctgatttaagggcccgtgcccaagtcctaatcctcgaagggcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaatttgaaactgcttttattgaaatgctgaaaggaatatatgtgcatgtgtggtagcccccggctaaccctgcacacccgaggggggtgcggggttagcccgagccaaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctggtggatttgcttggcgtggaactgacacgctctgcatcgccggaccagatcgaccgcgtcattgagagccgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcagtcctcaggtagagtcttatctgtgaggtatgtttggatctcagagatccaagcaatcaatctaagggagcttggagcgctctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgcgggtcagagcaccggtactccttacagacttggttaataaccagctgagagtcgcctaacaccaggaggcggcggatccccagcccagctgccaccctgagtccggcaaggagtccctcgtactctgccatattattggtcgctcgaaagtcgagacggaccaggtatctgaggacgtctccgtttggggaggtcaacgtgacccccgcaccggcgccctggagagacagagaaccgtcgaactgcatcacccagtgggcggtgtgaggcagctgagaggggttcgtgctggcctcgggtattgagacggtctctggagccggggtccactctgccacaaaatcagcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtaaacaggccgctgcacctttcggcggggccgatcctcttcgctaggggccgtatccccggggtgctcttcgtccaagtggcccctcggggcacactcgtcttctgtgctgatgacctcggggtcggaggacgacaggagcggccttcccacagtggcctcggggccgtcctgggggtcgggggctcctggcgtcgtcagacaagcgagcaaagggccagctccggtcgtcaggggcctcaggcctcctttcggctcgggggcctcttctccctgctctctcccgggtcgagtcagcacagggttagcctcggggtcaaagggcggtaagtgcggccttcccttagtggcctcggggcctctgagggtcgggggcacccagcaccgtttgacaagcgggcagagggccgactccggtcgtcgggggccttaggctaccgttcgactcgggggcctctcctccctgcctgctcccgggccgagtcggcacggagtaggggtgcgcaggatgaggattgtcctcatcgcgctccacaactaacgccgcactaaccacttggggggtcgccgctaagtaaagtagcagggactcatttggctccggggcgactagaaccggaggagagctgagatacgccttcaactgggcgagggcattttcagcttcctccgtccaagtgaacggccccgagcgcttgaggagcttaacaagggtagcgccttctctcccagccttgatatgaaacgactagggcggccatgcaaccagtgacgcattgcacatcccta

SEQ ID NO: 58405 - DNA, 13891 bp, Oryza sativa
atctcgtgacctcgtcgccgtttccctctttctcccgccgccggttgccgccgccgcaatccgccgccgtcgagcaacctccggcgaatccgagccgttggctcgtctccccttgtcacgtgcaaccgcccggtgtgcacgcttttgcccgtatcgccgtggttcgctccgccgctcgccgccgccggccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcggaccgcgcgcatgcaccgcgtccctttcccgcccgcgcgcgtgcgtcgcgtgctccctccgcacggtgagccgagccgctaacaagcgggtcccacccgggaccgcgcgtgatgagcccggtccaccggctctctctctcctccctcccgcgcgcgcgcgagtttgggccgccttgggccggccagcccatttagcttggccagaccgctccatttctcttgggccgcgccctagccatccgagaaaagtctatattccctccctcccttcttttctttttcttttccaaaaaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcaagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgctcgaacagccgtgcccacggtcatgggcggatgtgaggtgattcctagcgtagttttgtttgactactgcttgtgaaattgttgttgtgaaaaggggttcgatgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctactgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtcaccgacccaataaaattgcttgaagattatatcaagccaatgggagaagatttggcatatcgtactattcggcccacacaaggtatctctcaaccattagtgcagcaacacattaggtcatatgtcttggatgaattagacaaattactcaaagattctggatatagcctaggtcacttcaacttgccagagccagaacaccatgattacaatgttttgaacaacaggttggtagtggatgagctctcttatgaccttgatgctactttagtagaagcaaatgagcaacttaacaataaactcaagtcagagatctatttatgatgccatagaacactcagttctgaatggttcaggtcacactttctttgtatatggatatggtggtaccggcaaaacatttctgtggaatgcacttctcaataatataagaagtcgtggaaagatagccttagcagttgcatcttctggtatagcagctttgttgttgccaggtggtcgaacaccacactcacggtttagaattcctatagatattcaagagtattccatgtgtgctattaagaaaaatacacatgtcgctgagctcatagaaagaacatcactaatcacatgggatgaggcacctgtaaaccataagcactgttttgaagcacttgatcgaactcttagagatatcatgccatcaaacaattgttatctaccaaacaagcaatttggtggtgtcacggttgttctaggtggtgattttaggcaaacattgcctgtcatcccaaatgcaaataagcagcagatcctcaatgcttcaatcacacgatcccatttgtggcagaattgtgtggttctccatttaactgaaaacatgagacttagatgcccaacactttctcaggttgataggattgaattagaacagttttctcactggcttctttctattggtgatggcacactacctaatagcatgccaacagatcgacctgacacaacatggatccaaattccagagtatcttttgttacctgctcaggaaagaaaccttacaggtttaatttcttttgtctatgagtaaacaccagatgcctcagaattaccagcctatttgtgtcagcgagcaattttggccccaacaaatgaggtggctgctgctataaatgctcagattattggccagatagctaatgaggaaatgtcatattatagctttgatacaattgatgataccacagctaactattgcactcttcaagacctgtatcctccagagtttctcaacacggttcgcatgagtggccttccagatcaccatttacaacttaagattggtgtcccaataatgttacttagaaatttgagtccatccaagggcttatacaatggaactagacttattgtgacgcagctcactcatcgtgtaattgaagcccaaataataacaggaagcgctaaaggttctaaagcttatatccctagaattgtttctgtttcgacagacccgaaatggcctttcaagatgagacgtcgtcaatttccagtgcgtgtttcatatgcaatgacgataaacaagagccaaggatagagacttagcaaggttggtgtttacttgccaagtcccgtgttctctcatgggcagctttatgttgccttctcccgcgtaacatcttcaaaaggattacgaatcctcattgaaaataactctgctgagtatgaaagaaagacacataatgttgtgtattctgacattttccatgatatattaagccaatgttgtcagttctccccagatacccatgtccaatagatcagctttcttactacaaggtatttatgttttacaatttatgctctggtagtctgtttagtataatcttttttatgcctgaattttccatattacatccagtagacaacctacacttgctaatgcgtttctcaatgctctttgatttattaaagtgtatctgtcatcaacggagtgcacaacacagaaccatcttcatatatatattttagtaatgcagtcctcttgcagttctatggttcttttgaaaggagtgacttaacaacaatacataataacaactgttgaatttatttcaagctaaagaaactgtagtgcttatgttgttcagctatgttttcaaagtagcttacttcctgttcacatgtaaattatgtgctttaagtcatgtatgcacatcaaattaccccatttcaatataaatttagcattcttaaatatggttcccaccacctcaggtttgatttttcttttgtcccaagttgatatatctgatttctatctttctacatatccaaccatcctacattcatagctaaacatacaaattagataagtaatatctaaacttacatacttctataatccacatggatatatggtggtaagttcttatcattacttattgttgatatagataagcacagttctaatgctcctctgctcatatgttaacatgagtaaccattttgttacattgtactgctaaattttaattctatttggacagcccattgttaaaagatattctcccctcaacttcctattgaatggtaataggaaatgtcccatttcttattgttttatgtagagatagagacctcaaattcacgtctcatactatcgggtaatgattgacaagtatatttgatctgagttcattttacttattgcagatcaagaatgacatataaagaagaatattacttaatattatatgagggaatttctatcgtttaacaaggtatgacatatgacactgaaaggaataaaatttccaatttataagctcaagagttaaactatgttcctatcagaactaaactgaacgatctatgcgctttggcttcattttagtgtttattttgtagctcctttacatggtgatgaaatttccattaggcgttgatgcaaaattcaacagcgcctactatttcaggattaccaagtaggtactgcaggagacgtgctcacatattatcacaactactctgttttgccacaaatgatgcctatccggacatgtgcaacttggttatctcttctgcagttctgctgattgatcctactgatttacagagcttcttaatgtatgttttattcttagtggttttgtatattctcatatgagtaggctgagatttgtataaacctaatgccatgcccaatgttaaaaaaacatgtaggatacgatttaaccctatgattgttgtactgaactttccatctaattcttccaatatttagtgcccgcggcaacgctcggggtatagagtagtataactatatcagcgtcatgctgtcaaaacatatctacacatgcatacatgtgtacttttatgtattttatgatttgatcgcatggcatctcttgatatggatcattatcatttcataattaagctgcagtggtatatatatatacatatactgtatggccaaggatagcatgccacgagcaaagatatttgacgtcgattaatctatatgcatgattcttgctctcacaaattctaacggtctcggggaataagccaaacgatatatttataataaaaaataatttataaataaaatttttatatatgtattattagcgatatataaaagtaaaggctgtaaaataaatttcgataaaaaaaacttaaaatcaactttaaattaagattgaaaattcaaattctggctggtaagcataaatataaatgcaaagatgaggctggttgatgaaaggcacgtaaagttaataagaacgatcgatccatatgaagctgaatcaatcaatatcagtctctcattttcggtgatctgcccgtacctggaccaaaacctgcatgaggttgatccaccaatgtgtatgcagcgaactgccgaggttcactcgctcacggtttgcaatctcgttttgggttgaaatgcgagcttgtttgtttgaatggacatgaatattatcactatctttccaaatccaattgacgactctgaataatcagatcgatctgtagtccatggatttatgcaggtgaatgttgatttcccacgcaaagtgtacgtagatgggatatttggatttgtataaagactttgacttttttaactgggactggtcaactaattaattggttccaagacttattgccaactgtactactccattatacaagaatatttttccttagtccccacaaaacaaatattatgggaaagagtgcaagatactctttatgggaagggacagaattttgcagaggattaatgttttttctctaactaattctttacgtaaatataaaattacaaaagtagtataatactatgttacacaaatgaatttgaccacatcaattttcacatatatggttaaacgcacccattatccaaaacaaataatcataatgattatggtataatatgtgtgtgtgtgtgtatatatatatatatatatatatatatatatatatatatatatatatatatatatatatatatgccaccttgccaaataaaatggcattactcgttgtgggcgtctgtgtttgtactgtgtttcttaaaaaaatgacagtatttctctatgcgaccgaatagattagcactatccccttcccccttagcgtatgacaccattaacttctgtacacatgttttatctttaaccttactgaaaaaatatgtaataataataatattttttgttgttatttatttttaccattaaagctgctttaagtatgacttacatatattcttttatatttacatttttttaataaaatcactgttcacgcactacaaatcgatgacaacgtatattagaaatggagtgaatatttcatcgtgtagaacggataggatggtgatgtgtagggtctttggttggagttggcttggctaactattccaattctatctgcaagctagcatggccggcgtgcgtgcaccgggatggcgacgtcgactttagttcttagaatgaaattattggtagaaatttggaatgcccaagggccaagggacaatatgctgtgagacgagaagaatctgccaactgcttgcatgccacaggcaaccgccggcaatgatatcattcatgggattttttttccttatgataatggaataaaaacatcggatattatttagtttaaaaaaaacatgggatattattttattatctgaaagtcacaattataagaaacacccatacccaatcatatgtacagtactaccttcgttttatattataagactttctaacccatatatatatatatatatatatatatatatatgaatgtaggcaatggtagaaagtcttataacctgaaacggagggagtagtatacttcctccataaaaaaaaactcaacttaggaggggatgtgacccctcctagtacaatgaatctggactaccatttatccagattcgttgtctcacatcccctcctaggttgagttttttttgggacgggagagtaagaatcactcatatgagaagggctcactcttaaccaaaacacagcaggggagtctcccatagtaaaaacactcaagtatcatattgtgatatagtagtaataatatttaaaactgtacaattgaactgacacatagtaacaaattacctgtagcagtataccactatacttgtatagacatgtttcatctattgcacatatatgctcattattaaccatctagcccatcgttaatctagtaccacctattttatatactgatctcaaaaaagtatcgacaatagacatatgttgtgctctcttcgtaaaaaaaacgaatctggacatacactatgtccgtgtatgtccagattcatttatagaagtgggttttttttttgacatagggagtacgagcctaaacaattctactctgatatcgatgtcccacaggcgacaacaaacgaatttgcgaagcctccatatcctgcataccataaataaatcaataggataatcccatatagtttttccccgattgaattttcgtagctgcaaacacttatttataggcagagagagagagggagagagagagctgtggcttgggcaattacgccacagctcactgaattcgatcgcctctctctctcgttgctgccttctggcaaaccatggccgtccaggttcaacgaacgcccctcccccggtccacgtacaccggccatcgggtctatctcctgcgggccccacctgcagtgacacggtgcaccgtggaccgcgcctttccgcgcagtcatggacctccccttcctcctctcctgtataaaacctcgcgtcctgatgcttcctcctccaactccacgagccgccatttcccaaggaggagcaaggattgttgttgtttcgctgtcagatcggtaggcagtgccccccctctctgttgtctcggattggattggattggattggagtttttctgggttgatgtggtgattttgagggtgatttttttgtgtgtgtgtgtgtgttcttgatttttgttttttatttggtttgtttcagattcctgacgggataatgggtgagaccatcgccaaggatgtcaccgaggtgagcgagcgccaaaatggtttcttgttcttcatcgtggtggcatttttttggattggtattgggatgtgatttgagagagaaaaagaagaagattgaatcttttttgtgatgtgctgtagttgattgggaacacgccgttggtgtacctcaaccgggtgacggatgggtgcgtcgggcgcgtcgcggccaagctcgagtccatggagccatgctccagcgtcaaggataggtgaagctctactgaaatttatcatcttgtcatgttagggtggtggattatgtctgaaaaatcggttatttgtggttgtttccggaatggagatgtgatttttctctgtttagttctcagctgtttatgattagagctcttacttgcatcttggattttgagatgaaattttgatgtgtggttgtgttgggtttgtacaggattggatacagtatgatcactgatgcagaggagaaggggctgatcactccaggcaaggtgaggattttttttaatgatttcggtgttctgtaccaatggaacagtttggtcttataaactagttgttcttcctgcatcaatgtgaatgttgttcatttatttatttgttggatcccactgcggtttgatagtatgttggagctgatctgctgatgaaagggcgtgcatagcagagagtttgagttgaccggcgcatgtgcgaaagctcaaataagtagttagattgataagaaatggaccattcacctactgcattggtctagatattttatagaaaatgaataaggtgttcctcgcgttatctaagtcagaaggcaacgaaatgtgatccccagctgtcactcgattgcataatcataagttatccgatagctgttattctgccatctcatgttgtggcatgtttccctaatttattcttgatgaagaggccactaaacattatttttgcaatggagataacctaatgattgatgcttgggcctagactggttttgtttagttgattttattggaaaaataaattgattttcttcattaaatggaaacctgctgtatggactgattagtactagatgaaccagcatatgtttctagctagttatgtacaatagaccttgtcttgtcttattttagaaatagttttcgtagtacttatgctattaaagaatagatgaccaagtaaattttttttcagccaaataagatcacggctccattgcatcactgaagtttttcgatctgcttgctctttataagaacaatcatattattttcaatagcagcatattttgacataccatgcttcttctagattaatatatttgccgtgtctaggagtcatgaatgatgaatgtggccttgtttgcagtattgttcgttttctcctgcatctaggtgttttatttctgcagatactttgccagttgaccaaagtaatttttatattgccagttgaccaaagtaatttttatatttccagttgccatctgcatgattcaattagtagcttaaagcatactccctccgtcccaaaatataacttttagcattcagaatttgtctcaaaatataacaacttcttcacctacattcccttctcaaccaatcacaaccttccaccattcaaattcaccacctactttctcttcccaaccaatcacaaaccctcgtccatttaatcccacatactttcttaatacctgtgtctaagcctagaactccttatattttgggaaggaggtagtatttaaataagggaattttacaatgctttttatgtgatagtaagttagcagtttttttttgttggtaaacactttcttcaaactgctagtaaagctaaatctattataacttccatatagttaagaacgcaagatctggctttactgatgttttgctttgtctgtcaatgattgccagagtgtgctgattgagccaactagtggcaacacaggcattggactggccttcatggctgctgcaaagggttacaggcttgtactcacgatgccggcctccatgagcatggagaggagaatcatattgaaggcttttggtgctgaattgatacttactgacccactcttgggaatgaaaggagctgtccaaaaggcagaagaactggcagcgaagacaaacaactcatttatcctccaacaattcgagaaccctgctaacccaaaggtgtagcatgatttaacattttaatacccttgtttatatttgtgttctgtggactcatactgggatgttattatgcagatccattacgagaccactggacctgaaatctggaaaggaacaggaggtaaagttgatggtttagtttctggtattgggacaggtggcactattactggagctggacgatacctcagagagcaaaatcctgatatcaaggtaaggaccagaaaagctctatactacagttttggtttgccacattgaataattaaagttccagcatttgttcctttaggaaaagaatagtatctgattttattttttttcttatgtaagatctatggtgtggagccagtcgagagcgctgtcttatctggtggaaagcctggtaataaggagtcatccattaattccatgtcatgactttatttcattttctggttgtgtcaataaaaaaataataaattgtttgccgcactttagttttcccacaacagccaaaagctaaaacaaaatctttgatttgtggttgtctgggacttagtcatgtgaatatcttgttgaggagggagagcagatttaattattggatggctgcattttgaaattggaattatcatgtggttgatgattgttgatgtgctccctaaggactcattttctgggttcaatagtgtatccttgtacctctcaatagaaaagaatatccttttgaagaagggatcttgtgaaccatttacttctaatgcagggccacacaagattcaaggaattggagctggttttgttcctggggtcctggatgttgacctcatcaatgaaactgtacaagtatgttatgcttctgtattaagttgagctgtagaaagacatatatataatttagcaccatgttttttttctctcacttgatccatagctttacttttcttcattcgaatagtagtcggtactagatctatattattcatgatgtcttagcaaatatctgcttcttttaatctggtatgaacgtttggtgcattgaactgtttgacaggtttcaagtgatgaagctatcgagatggcaaaggctcttgcattgaaagaagggttgctggtaagatttgtgtttgatgttcatttctgtgctctattattaatctgtaggtacacaaattgcttttgttaagcctctctatgtacggatcattcggatggtacctttgctgaagtcatcagtgatgtaaataattgtaggttggaatatcttcaggtgcagctgcagcagcagctgttaggctcgctcagaggccggaaaatgaaggaaaactttttgttgtaagcgtttcatttttcttacctctgaatttctaatgccctgtggcttaaagctacttcgactgcacctgcatttgtttatccatttggtattttagtccaaatgtacagcagtacagatatactccaaatttacactccagtgacctagaggaaaagctaacgaatctgagttcttgttttgtcattgtggcatctataatttcaattcgcatagaacgaactgccgtccaaaacaagcactatctccacatttgtcatgacccaaggccatgacgggataaacccatggacaacattgtcgatttgtttcatcatgctcatccccacactaacacctttccctcaatgtaggttgtcttcccaagctttggtgagcggtacctttcgtcggtgctcttccagtccatcaagaaggaagctgaaaacatggtggttgaatgaaatgcacaatatccgggaatccacaggaataaaagtttggtatctctgcttgtgtgattaaacatacattgtcctgccattttcaagttgttctgcttgtgtagcaatggggaacacagtgtgttagccttgtagtgttaaacagtttacattttatcttccctgtatatcagaaccctttacatgggcatttgtcagccagtgtgaatgaaataaagcatcatatgatttgtctcatgttttgggatctcgtctgaaccataatattcttataagagaacaaggccctgtttagttcacaccaaacttctcccaactttccatcacatcacatccaaaactttcttgctcacataaactcctaactttttttacagactatcaacttttcctaaacttctccctaattttaggaactagacacagcccaagtctcatgttttgggatctttctctgaaccacaaattctcataagagaacaagtctcatgttggatctttctctaaagtctgaaccataaatattctctcaagagagcagtagtgctctgaaaaatgacatcaggcccaaataagggttgtaccagtttatgggccatgggccatgactgacagagaaaatacataatagtagtactgatgaacattgatgctcctagtccatggtgctgctgctaactggcttttgcagtaaaaaggagccaacatcagtcataaaggtccaatgcagtctatgctcatgttccaggatctgttttggctgttgcctgttggcattgccagggtgcagtacaccatcattcattggtttagttacctgttactactagttaatgcacaaccttgtgggtaccgagctcgaattcgccctatagt

SEQ ID NO: 58406 - DNA, 24455 bp, Oryza sativa
  unsure (1)..(24455): unsure at all n locations
tggtaatttccataagaaatcaatccgcggtagtaatttagatgtaattaataactaaacaattagatgaattcttatagactattatagattattttttgggtaatctctataagtaatcgattcacggtagaaattcggatttaatcactaggaattttagacgtatattatatttaatcgtttagtcatagactaaattaaatcgtataatattataagataattttaggattccgtccgatatttagctcgcgatagaaatttctaacatattatatggatataatgctagggtagattaaattaaaaacttatgataacaaaatatttatacccacaaaatagtttaggatatatagatcgaaattgggtttgccctagttcgcgaatagtaaagttaatataaaagaatcgactttcgcattcgacttccatttggatttacttggattttatttgaattctaaccgaattcaaatcaatttttgcacgtaactatagagcccgagggagttgcggatccaagtgaaggccaagacccgcaagactttgagcaaggcaagtcatcactattctttgaacatgttgatcccaattgcgaaattgttttgtttacaaataaaatcgcatgcaatgatgaacatcctacttgtgattatgccatgccatgattattgtttatccttaaatccttgtaaccatgatttacgtataagtccctagtcaactatgacaaatgcttagaaatgctactctagatttatgcatactcatatttatcaaatgatatatgcttgggcaattacctttgggaaggtaattgagatgcggcatgtggagacatgagcgccacattgccatgatattgatggcatgatttgtgaaaggaaaatgaaactaaacaaatgttttcgactggggcggatggaggatttgggtggtatccggaaaaggctagtgccgtccctggtcaattaaggaccgagccatgaagttaagcatgaaacgacccccgtacaaccgtacttctcgaatgggtatagacctagcggagtagatagctgagcggaggcagtatccatgcatagcagttccttgatgtgtgaggcaggggctctacggtggggcagccattggtaggaccgcgaggcgggtgtctacagtggtgtcgccatcggtaggactgccatgtgagaatctaaacataattataacttaatgcatgtgtgagtcttcacttcccgggtgcgccagaactcctctcactgctagaaaccgtgtacgtctagagtgcatgaggatgtaaagttcatggagcgggtactgccaatgcgaggttatcaaaaggctttgccgtgacgcgtctcatgtgttgggacgaggctcatgtgttgggcagtcgcggagtgcgggtaaagtgtacatccactgcagtgtgagtaaaccaaatctattcgaatagtcatgctcgcggttattgagcaccgggacatgtattacacttggctagactctaaattcttaacttgtgtggaatgggatattgcatgatgatttctatgctgatggagccacttcctgagaggcgggaaggtggacgtcctcagaaaaccatgacgactcaatggcgggaagctatccttgggatcacaatggatggtggacagaaccgtcattgtataatatgaacactggtactaaaatttgatcagtctgtgctaggtcttaggcttgtgaaaagaattacaaaacttgctttgcgcaaaagaaccatagccatcctttgaatacccttgtcatatgcattgttgttgtggtggcttgctgagtacggttggtactcacccttgcaatatacaaacttaatcagaggtcggagatgaagcttcggaggatccctacgcttactaccaggagggtgatgaagacgatggcgctcagtaggtcttagttacggtcgttgcctgtggcaatggcgtgccgctgccttaactccgctgccttacctacttctgtttttggaatgtattccggaccgctcggtccgatgatttaagactatgcttgcgggcttatgatgtaataattcgtactagacactcgtgtatgtgcacttagtatttcagctatgaattcgtgtgtaccagactacttgatccagggaaatggtactgtttacatgattgattcctgttataaaaacgggggtccacaccctatttatgtcaggatcattcaatcggttatgtcatatgagttttgctgaaaagaggttaatatcttgtgccgtactgcaccattcagttgttcttgccagatcaagctgcctctccattgctattcaatgctcatgaaattctttagtacaccgggtgtgtttagatcacatcaaaattgaaagtttgattgaaattagaacgatgtgacggaaaagttgaaagtttgtgtgtataggaaagttttgatgtgatagaaaagttggaagtttaaaaaaatagtttggatctaaacaaggcccaataaacttgcatgctatcaggtcaataacctaataactctaaataaaataaagcaatcagtatatatcactagactatcctgcaaaaaaaaaacaataatctgcagtgcaaaaaaaactaactcaagaccatgctgcgtctgctgccaagcccagtgactcggtttttgcagtgcagcacctcagcgcaaatcaagtactaactgcttttgtatatagggttcgcgatgttgatcagttggagttttcgagcgtaccaaggggagggtggtgactagagatcgaggagaacaggtggagatcgatcatgttggtgtcgacaagggcagatcgaagatccagacgtacggcctcagatcctctcgatggcgaggtgcgcccctacgtacggcgcccagcctcgctcggcgcaggtggaactagaggcgacggccagcgacgagttggggtgggaggcggcggccgtcgtggattagggtaggtttcgtactttagccggcgtagttgggctgggctgctcttgctgggcgcgatgctggagtcccgtgtagttgtgggcctcattcacgtcaaatttaggaataagtttatttgaggccccttaactttacaccgattccgattttcatccttcaaccaaacaatcaggtacaatcggtccctcaacttctaaaaccatgcaaacgagatcccttgacggtttggaaggcagttttggttgatgtgacgctaatgtggctggtttgacttggtcttcgtcccacttggcatttgacgtggcgcttacgtggcaattcgaatccggaaaaataataaaaatcgtagccccacatgtcagctacacacaaaaaataattaaaaatggtggggccccacatgtcagcctcacccttctcttcatacccgcaagcgagcatgcgggcagcgacctcagcgaggcggcgccctcgacgacctcacgcgccaccaccgcactccacctccgaggcagtgggcagtgtaggccagcgaagcggggcgggaggagcgacagcgaccactccactcctctctcccttccccttttcgacacgtgggcggcagagggcgcggagtggtgatgcggagcggcggcggccatagtaggctggcgaagcggagcgggacgagcggcggccgacgcctgcgtctcgtttgggcttccaccgtttggctcattgatccctccccttctccgagcctccttgcgtcgccggagcggccgtagttcaccgctggaagttcttcttctctcgaagtccgctgctaatgccgccgctactgaactggcatcgtgtagatccatccgtctctgaggctgttggtgatgaactgtaacttcggaccaatctattcattttgttgcggattactttgatttgtgcatacgaaaaaaatttccagaacattttggggattcagctaggtttccatgaaaactccttggtagatcagtctgaatactaaacctggaactggtttgcctttctttgctttgagacaaatggaagaggagatggtgatatgtaaattagcaacacacatgcatttcaccgtctcctttgtcgattgttttcgaggcaaggatgaagttgggttgcgtcgatctcatctggtatacgaggggcgccattgagattcacattctttatatggctagccaacaagggtaactagggtagatgtcacgctgcagataacttagcaaagagggaatggccacaccatcaaatttgcttgctctgctcagcccaggatgagctgtagacacttgctcattggttgttcatagaccaattggacctggatgttattgcgaggctggatgaggtttcaacttcctaaacatatgcaggtaaagctaaaacaaatggtgaatggcgtctatagattgaactttagaccaatttagagaaaggctttcgtctcgctgctcatgatgatctattggctggtttgaaaggagcgaaatgtaagggcgttcgatcagcgcccacggacatctacacaactgttcaccgacatcagagacaaaactaaaatttggaagcagctcgaccttttcaaagctcctaaagattgataatatggagttacgctgttgatttagattatgtatgtttatgcacatattgttatcttatcgacagctagctgtctgtcaaaacacttgttatttgttgtatacattttaaacctccctttaatattaagattcggtcaacccagctgaaaaaaatatgcttacaaactgcagcaatagtcgctgttttttagggcagcaagactgtcgtgcccggatgaacggtgcagtaccacatcttagctcattaagttcgcttgctatgatcagcccatgatgaaagttgtagacattttctcagttaaatcttcataaaccaacaggatctagacattgttgcgaggttggacaaggtttcagattcctggagacatgcgcactgtcatcttatcgatagtttttcgttgaaacgctctataacctatacaatacatttgaaaccttcctttaatattaagattcggccaacctggctaagaaaattataattacattctctaaaaaaatcgcaacaacaaagttgttttaaccgagaagaattggacacaaacaagtgcaagacaatcgtgcccggatgaagggtgcgggtaccacagctaagggtgtgtttggttacctgtattgcacttggcccgcatctggcatgcaaccttcgacctgtttggttgtacacagccaggcccacatgatgtaaaaaggcccatggaaccaggataaaagcggaaacgaaaaagtacaataaaggtccctcatcttgtcatcggattacaaaatcgtccgccaaccgcaaaaccagatatatgacatccctcatctcacaaactggatcacttcggatccttagacggttttgaccccggtttggtctgacgtggcagctgagtcagcgggggacccacgtgggcccacacgtcaggttgtccacgtcatctttctttccccttttctctcccttcctcctctcactcttctctaggaaggcatggtggcagtgcaaggtgggaaaggagggcggcggtggccagcggcgagcgatgcggcgtcaatgttggtatttcttaacgtcacatatagaatccgcaagcgcactgaagataccgatatagctcttcacctgggagtattccagagtatcgatttccacagggaacgtgtgagttcaactcctcgtcaggtttatccaaggacacaaagctaatgtgggcagagagctgagaggattttctaatgagaaatagtgtctacgaaaagcttaattttaatcctaacgcaatacttcaggcactggcagccctctattcccagatgtcgctctacaacgtagccggactcttgagggttatcaccacctctacacccacctcaaacgtactgtgggatacgcagcaaccactgaaaattaattacccagacaccacgtctacgcaattaataactactctagtgcccgatcacacactaaagcaatcactataaaataatggactatagtaaacaatgacccggtatgctaattaggaactaaccaagaagtaattctcactaagcaaatcttaattactcataataatatttctattaaagcagcgtaattaacaagatacaaaagtaggagcagattaccgacaactccggaattcctccgatttcttctatcttactctctccctattgtaatatacgataaagtacactatagcctcttgtaattcagttcatgctttggtgtgtgtgaatgagggagaggagaggggtatttataggtggaaaggtgccttgggagagtggagatgctccaagcatcctatgagcatattccttctagcttcatctcctcttgacaagtgtcctctttatgacggtttccaccggtagaaacggccacaaccgtcattgggatgaggagtccaaccgtcataccaaaattgggctggattgggccagctggagggttcgaccgaaccctggttggctcccctggcccacatccttcttcaggatgctgacatgtgggccttattttatggtactccatgttttggctccaaatgattgcacattttatatgttgtagcttaaaaccatgtgagtccatcaacacaaaatatatttctattctttatgctcattctctcccaactttggtggttgatcacctgcatactaatatacaccaacactcgtgaaaattgttagaaataaatcctaccactatgttggatgctttatatctatggttttatgcaagtattgtcggtgttaatttggtccttaacagccgtcaacagtcgacgacgacatgggagaaggggaggcgtcgcaggcatggaggagggcgttggagtagaggaggcggcggcgacgagggagaagggtcatcgatgatgtggtccaagatggccgcagcgtgcgcggtggcgtctccgggacggagacgacaagccctctccactccagttgctggaagtctcgccggtgcggtggccgtgggtgctgactccggcgcacctcgccggcaccatcggccggtagaagaaccccctcgaagccgtccatctctatgccgatgcgccacgccgctttctgccttcggccacctccacgtcatcgcgcccgccgtcaacgacccccagcaagcgcgcactcatccttgtcttcgacggcccgggactccacgcaccctgcacgcagcgggctcgccatccacgccacccccgccccccggtccccctcgagcttgatgtgggcctaggcgcggtcggcgtagaactcggcggtggcggggctagcctcgattgcctgcgtgtaaagctcggtggcgagctcaaagtcatcgtcgacgaaggccgccatggccttgctatctagatccaacgcaccggcagttgccatgggtgggagaggaggaggtgagccaacgagagggcggggaggccggtggcaagaaacggagagggagaaggcgtggtcgtcgagggagtgggggaagccggcagtgagcgctcacagagagggaggaggtggggccagcgagggaggcggggaggctggcggcgagcgacggagagggaggaggctgggccggtgagaggggtggctggcgagctcgctcgctcgctccacccggtgctgtgtggtgaggagaaagaagaggaaggaggaaggagaaagtagaggaggatgacatgtgggccccacatggggcccatcatttttttattttctaatgtaactggcatgtgggcccatgttttaattttttttttgattgaattcccatgtatgcgccacgtcaataccacatgggacaaagacctaatcaaaaggagaaaattgacattataccattgttaaaacggggtttcgctaaaatgccacttcgcagttgggattcgccgaaataccactctcaattgaggggcttcgccgaaataccattttcttttgattctccctttcctcgcatctttgttgacctatttaaatcaatttaagcacataaaaaatacgtagattacaaagtaaataccgtcgaaataattttacatgcaatttttctccacaccagattacatagtatgcagcatactatcaccacaatataaaaaacactctcaaccggaaactcttggtttctagtgatataaaagttctttttatttatgttgtggagatattgtgttatatactctataatctggtgtagaggaaaaatatattacatgtcaagatatttggacgatatgtactctgtaaaatacatagttgatttacttgaattatttcaactaggggtattttggtcggcaaagatgagaggaaagagataattgaaagagaatgatatttgggatgaagcccccttgttgtgagtggtattctggcgaatcctaaccgcagagtgatattttagcgaaaccccgttttgacgatggtatattgtcaattttcttagtcaaaagagccacgtaagcgctacgtcagccaaaaccttacacaatactgccgagggactcatttgcactgtttttttaagttgaggatgcgttgtatcggttttacggttgacggacgattttgtattttggtgacaaggcacctttggggcctatttagttccaaaaacatcacaacgaatttttggatatatatatatggagcattaaatatagataataagaaaaactaagagcatccccagcagctcctctatccggtcctccatcccgtttttggcgcacggaggtgaaaaacaacgctccagcagaccttccatcacacacgccatttttggaggacctccaaaccaagcccttcccaagccaaatatggaggttctctctcctcatgccatcctcaaccgccgacctcgcgctaccatatggactgcataccgtgggagagaggaggtgcatactggatttggaggtggagatcaccggagtagaggcggagaggcagcggatctagcagtgaggtcgccgctgtccccaccgctcgaggtcttcgcccactccgccgctcctctgaccccgccgcccctctgcctcgccgctcgcgccgccccttcgcagagactggttggtggtggtggcgggccatcggcgggaggaggagggagatggacccaccggccacctcccgtcgtccgtcccttgcgccgctcctccaccccttgcgctgcccgcgccgctcctccgaccgcgctacccctccgcccagccactcctccgactgcgccgcccctctggtcggccctcgtcctccccgtcctctcggcgccggcggtagagaagagagaaagacggggagatcggcggtagagaaggtggggagtgaagagataaaggtggggagttttttttaggaaaaagtacgaattacccccctaaactatcgcggtcgtctgaattaccccctaaagccgaaaaccaggtatcactcaccctgaacttcttataccggacgaattaccccctgactgtatctaaagtggttttcgtcccacgtggtgtacatgtggcagtccagtcatcatttttttaaaaaaaataatcggggggacccacctgtcagcttctctccccctcaccccctttctctctcttccatcctgctcaatctctctatgcggcgaggacggtggtggacggcggtgtcgcggggagggcacggcggccggtggcccgagccgaggagaacggtggaggcgacgggcggcgctgaggaggacactggaggcggcgggcggcagcgctcgcggggagggcgacggccagtggggcccacgccccgaggaggatggtgggggcaacagcggcgatgactggctagaggaggatggtcgcactcgcctcctccgccgccagctcgcctcnccnnncnnctnnnnnnnntncagggnnnncgcncttgncacnctggcagctctgctccgcggcgtgtggcgcngntnttgatccacctncaccaccngnngccnanncagctccncctccgcctcngtagcccggtccaccaccggcctccgcctctgcccctttgtccccaagcatgctcggcctcagccgccgccgtcgccaactcgcccgctttgccactggccgccagacgcccggcgaacttccgtctccgccgccaaccgctcgctcccactggctgcccaccgcccaggcgagctccgccaccggccggtccgcctttgccgtgtacgcgtgttgcgcccgatagagagaggagagagagggattagggaaaagaaggtatcacatgtgggtcccaccattattttaaaagaaaatgatgactggattgtcacgtgtacgccacgtaggacgaaaccgctctagattcagtcgatgggggtaattcgtccgatataagaagttcagggtgagtgatacctggttttcgggttaggggggtaattcggacgactgcaatagttcagggggtaattcgtacttttttcttttttttgtaagagtggtgataaatatgtggtagttttaaagtattagtaaaatataggatgttggtatatgaaggatgtaatatggatgatccgttggagtaaaaagtaatatggagtaggaatcttttgggatgactatctaaatgggagtgtggatgatgaaatttagatgagctgctgggatgctctaattgcacagtttatatataaaatcgtgagacgaatctttcgagcctaattaggccatgattagccataagtgctacaataacccatatgtgctcaaaagattcgtcctgcggtttccagacgagttatgaaattagttttttcattcgtatccgaaaacacctttcgacaaccggtcaaacgtcactaccttaaaaattttcattttaccaaaaagtaaacaggaccttgaggtgtactttttccacgaaaacggccgattcgaccttcgctccacagcctggctcgccgctcgaggcgtgcagcgagccgcgagtgcaggcagccaggcagcgagagaagtcaccgcgcggcctcgactacttctccgcctcctcatttcctcccaccgaaagaaaagcttagggttcggccgctgctgctcatcgccgcctcatcctccgccgccgggcgtcggcgccggctcccctccatcgccggctccctccgtcgccccccctcagatccgtcggctgcccgccttctcttccactgtgaagtcctcgttctctccgttgagcccatcttcttcgtcggttttcttcctcacgccctctcctcttcggttctctccgtcgagctctccggtaagtgcaaggatggtatgccgccgcccattgtagggttgggaatcctctcccctttcctacccccttcaattttgtgtccactctttctttgatttctgtttttctttgtggatgagagcacatgtccccttcataaacaaacctagatctactaaaatgtgatggattttaggttgatttgggtgcaacaaagtgctgcataggcttggattttgctatatatttttgccatgttatgcactgttggtctattttctagatgttgctaagcatgactaaaaatatatttcttggtcgatctacttatctttcagttttgtacacatgaatatttgttaaatcgattgcctcgtagctcagatctgcactggttgtttgtgatgtgctcattcaagttagatctgtgaccctgttagttgtgcatattactgtgccccttttgttatgtctgagcaaatttccttggatgtggcagccgtggcatgggtgcataaatattggatttgcaatagttaatatgccaccaggttttggattaatgcccacgaatttgcatgaatgtttgtcgcaagcttagagttaatgcactaggtattctgttcatcatgaaacttataaatcattatatggcggaataatcatctaagaagaactttatgttggcactgactaagcatttctagttcataacacggctaaatggatatgtttgtgtagtatatttagntgtgttatnaantagaaatgnttagtcaatggngacataaagntcttcttagatgattattctgccattgtgctgctttagctgtcactgagtttggcatttccactcttgcagataactctacccaggctgagttgtggctggtattggcgatataagcttgttagctgttttctcttgtgtctttggtcttcatctttgattacgcgtcattgaaaagactgtacatgagaaaactcttttgttgaaacatttctcttgtaatatgaatgtattgagtttgtgactatccttctcctgtgctagaatcatatatttcagcttcaaagctcttatggtacttttcaagtttcctgttgaaccgaatacctagtgcattaactctaagcttgtgacaaacattcatgcaaattcgtggatattaatccagaacctggtggcatattaacattggatacttggtcaactggaaaattggagctccttattcatgtcatcaatggagagcctagcacagttagagctgttgtgtgaaaagctttacaattctagagactctgctgagcgagcacacgctgaaagcatcctcaagtgcttctcggagaacagtgactacatttcacagtgccaatatatattggacaatgcctcaacaccatatgccctgatgctggccagttcaagcttgttgaaccaagtcaacgaccgcagtctttcattgcaattgcgccttgatatccgtaatgttcctttccaaaaatctatcatgaaatcagttattcagctatttttgcttttctattgcatctgcatggcatgttttcatttacgtctctaccaatttaatcagttatgattagttctgcgttgcaagttactacagaaagcagtaagcactcgtttgtagtgccatctagtataagtggccatattttaatctttgttgttccttccttaacttatttctgttgcctttgatgtcttatgcttattgaatatggctcgagttgaatggacaaatattttacattctattcctgacttcatttatgcctttgcagcagattagaatggccaaatatttatttccatttattcattgttgttttatgcattgttaatgtagctaaattgcaaaaatacatgtgtataaacaatgcttaaatctattttgtgtacttttgtgcccttgtctactgctaattttaaatcaatatattgtgatctgtttgaagggaattatgtcataaactatcttgctacgaggggacctaaactgcagacgtttgtgattaaatccctaattcagcttgtctgtcgaattacaaaatttggatggttcgatgatgataaatgcagagatattgtcaaggaggcagccgatttcttatctcttgtaagtttgttgtctgttttgttggcatttagctgagaactttttaactgttgatgacatatttaaggactatgcacctttgatttgagtggagctatataccttggtacataaatccttggcaatttctatgaccaatgcccattctttagaactaagtaatatgaaaaaggataaccagcctaccagatctattaaagaatccatatgaggaacatttataggttttattccatgctctattgcaagttaattgatgcatactaaagttgctgcttatgcttttcatttcaggcatcccaggatcattattttataggattgaagatactatatcatcttgtaggagaaatgaaccaggtgccacctagaaacttcttttttattataattttcaataactggtttgatcctaatcaatatgataatgcaatttggcaatatgtagattaatttaaaagttgaaaaatattttaacagtattaatttttttttatgtttagaactgcacaatgtgcttgttggcacttataaatcgcacatgcacatacattcataaaacatcggatgagacacagaaggtcaagcgtacatgaaacactacatatatgcactaacctgtgcacacacaattcataccaaaaggaaaagttattctttattttcctttccgatgcttaacaaagagttataaacatgcagatagacatatataggcatagtattgtcaatcaaaatattaatggttaatccaaccaatgttaacaagccaaagttaaacattgacactgatggttactatattaatttccatttattttaaagagtattggcggcaatatgatatgtggcactttactaaattgtgttggggtagtgttggtagcaatcttttttaccttcttggaactgtgatgcacatttcagcctttttactgtactgtcccacctttctgttagcatgtcacttctttttattgccttctttgacctcttaattttttctggtatagtttcttgaatatgattgcatgtcactgtatttcttgtaatgttgagtttcattttatttaacatgaaataacacagattgcttgcttagtacaagaaaagaaagggttctagttctacaaatatcttctgtgaactgtgtctcttttttccgtaaacaattctttcaatgaatagttggattgaccattaagctttctcagtatgtacttggcttcttcttactttttgcatgctgtcttctgcttatgaattatagtgttggtcaatatcttcacttctgattgggttatgtacttgtgttgttgcttatatattttcaatatagtttatattgttttgcccatttttatccactcttgttcaatttcctttgtcaggtggactgtaatgtatttagctgactttttgtgtctgtgtatgcatgcaggcaaacgcgatgcctttgacacttcacagaaaaattgcttgttcgttcaaggaccagtttcttctacagatcttccaaatttctttaacctcattacaccaactgaagaggaaggtaaagttcaaggaccagtctcatccattttgttaaaagtagtgtgtattggaatgtccacactttctcacttccatcttctgatacgatctgtaattaaactgcagtacctgatgactttaggcgtgatcctctcttgcttgcattaaggtgcttgtcatatgactttgttggttgtcctgtggatgaaagctctgaggaatttggtacagtgcaggtatgttagtttgcacaattgttatcttctctgtaaaacatttgacctatcccagttggtctatttcttataatttatgtattttttttattgatgcagcttcctgcatcttggaggcctctccttcaagatccttctactgttcagatcttcttcgattactataaagtcaatgatacatgtgtttcaaaagaggtatactttgattgggtgatttgaataatatcgacaatataatctctgattattttaccaagtgctttgtccattactccattaacacaaaagagatatattttgcttctagttcctcatgtttagaatgtacactttgattgcatgatttttcattaatacatttttcaaacttatttctagttagctaccactacagttttacaaaatttacttccattcagcagcaatattttcccaatgttttcttttaaaagtatgacttcctcacctctgtgaagcagcaatattttcctaatgtatggatctctaagaggcatgctttattcctttcaagaatctctaagaagcaatattttccttgtgaatttatcttacaaacagctgttactcttttctttctttgtaagtaatgtgccatgttcagtggattagctcttttcttgactcttccccgcgcccctctcctatgcacttctttatgtgtcctagcccttcatttctgcaggctttggaatgtcttgtgagacttgcttctgtcaggcgcagtattttcgttgaggacccttcaaggacccagtttctttctcatctgatgtcaggcacaaaggagatactccaaactggccaaggttatcgctttgtccttttgttgccaagttctgttctattttagtcctgttacaaatttcagtaattaggaccagcgatttcaattgcaatcctcttacatagagtgaaaagcctcttttatgtaaggttaagaggcatttactctaaacacgagttgattgactcatgcctggtcacgctatgtggtgcactgtagaaaccagacttgctttttataagtaaaagcacacctttgtttattagtaatctttaaaattagatacttgtctcaaattcgctccatgcaggaacaaaaataaatgctccatatctttacgtaatttattcttctgatgtgtgatctgctcatctacaggtcttgctgatcatggaaattaccatgagttctgccgccttcttggacgtttcaaagtgaatttccaggttggaatcctgttacttaaaatgaaggatgaagctaacttgtttgttttgtgtcaaggatttgctctttgttctttccctttgcattcttttacagaattaatgacttgctagtttttgctacgtaacaaccgatgaattagttggcaacagtaatgatgcattaattatgaagtgcgcattgagttcttttaggccttggttgggtggcccaattctggttggtatcctggctgaaatgaactgggatggcggggattttgtgggattccaaacatgccttactgatgttattttaccctgatttgtggttttgtactattgctttgaaggaacagtaataagtaattccatttgtttgtaggttctagtcttttggctttactgggagcactaactagtcatactgatatgcaagtcaaggttctaaatagtggattgcatttttagagtgcattggttttgatgtagagcatatcgtagtgatgcagtgcatgttgtagtgaacagttgatggaatagttaatttgtattatatttataattctacgtaatgaactgttgtgtatacgatgtttatatgtatttttggtattgtttgcaacttgcaagtgctatttttgttgactttttttttgccttacagacatttggtaccaatttattagctttcaaagtttcaataaacaatggagttgttctctgtttagaaagcatttaatacctgtgtcatagtgttgtcaagtgaagatggccattgttccaaagtttcttttaccaattttctatatgcattcattgtcccaattgcctattactaacttactgtttgttaagttgtatctatcgtatatgttctggaacaaaaagcatggttcaatattttcttaccacattcataatttgccatgaatgaccattccttcttatctagaactttgatagtaatgtagttatgtaaattagtctatgttgatcatgaaaacaaaattgaactgtattatgtttgtttgctgttggcatatcttcattgtgtcattcggaatactcccggcattgactaccaaatgatttggttggttgattgttatcagtgttactagataatgttggctgcactggtttttgatcctttatcaagttctctgttattgtcatagtaatatccagctatgaatggacctctttgtgattaagtgtgggctcttgcattgttgtacttcgcagttgtcagagcttctgagtattgagttttatggtgaatggattggtttagtagcagaattcacaactaaatccctgttgtcatggcaggtctgtttccctttttttttttgactcattctcttagcactggattattcaataatcaatttccaatagttttaactatcgaatatttgcagtgggccagcaatagtgtctactatcttttgagtctttggtcaaggctggtgacatctgttccttacttgaaaggcgacacaccaagtatgcttgatgagaccgttccgaaaatcacggagggttttatcacctctagaattaattctgttcaggtactgatttctaatgagatgatggaactgctttctatctcagttgaagcggtaacgtttgttatatcctgttgtttctatccatctcaggccagctttgcaaacgactcatctgatgatactttggataatgtggatgttcttcaggagcagttggagtctcttccttacctttgtagattccaggtcgctatttcctgtcaagttctggtttccaatttaagagacaattttctgttaaacttttgattggatccatctttgtaatcatgtccacctgtagataagatacatcgcgtaatcaattgaatgttttcttttatggagattaaccctgttccagcttttcacataacaggattcatagttttatgtaattgatctttttattgaacatatgcattggttctatctacttgcagtttactgcatgcacttagtaatttcttgtatatggtaccagaatttctttctttaaatattgaagaactaatagaatcattacacaacaacaatagatgcatcaaatttaagtagcattatgctattcatttttatcgtatttaattatatgattttaaaacaagaataaccagagtaaatttttggccaacttaagtgctttcatattgtggacgggtgcagaaaatatagtaaataagataaaaaaaatacgacaaatttcagatgaagatctcttattatcgtttctgctgttttcagctaatttatatgccacttcattatatatatctgttactttttgtctggatggaattcttattcttatataattattttgagtcactactaacctccttgcccgttaccaatagtatgaagaatctagatgaaatgcccttattgttcttagtctcttttttttttttgagagagaattgcattttatgacatgcccatatgatgattttcttttgctgatttgcagtaccaaaacagtagcatttacatcataaatattatggagcctcttctacaagcttatatggtatgttagtgttatttcacaggcctctttttggggcataaagaatgccttttcaaagtcaaatacttttacaggaaaggtcaagattaccagctcctggagatgcgaatgagctctctgtcattgaaggacagctcacatggctagtccacataattgcagccattctcaagattaggcagaccattggttgtaggtgagaaattaacattccttgcttccttccttatattctgtttgatttccttttcttttcacttacaatgttcattttgttatgcagccaagaatcacaggagttaattgacgcagaacttgcagcccgtgtgttacagttgataaacgttactgacacaggggtgcacgcacaggttagatgaaaatgatttggtcatctaacatgaaagctgagtgctgagctagtgtacttgtagcaacaacaattttcctttctagtattgtctgcaaattatagaatataattgcatatgtaggtaggactggttttgttttttcacaagcatttaattttttgtaagtagttacatgggcacgggtcaactgttctttaaaatgtgcagcatcaaataactaaggagcaacttagatattttcttaattttatcgccaatactgtaacatagacaaccaattacttgtttctccattcgtcatgaagcttggagtcacaacaacacatgtggttgttgatggtgttttggtgtttcttacagttatcatgagaaatgaaagctgtgaatttgcacttaaaaataggctgaaattgaatttatttaatgaaaatatctaaacaatgttcccatatgaacttaatctttggccaaaatcagctcactttaagagccatttttcatattgtattatgtacagtatgtaaaccacatattgtccccataaaccaaatctgtttctgtattgcgacactacggattacggaatgctctccaatttgtcctttactttcattaacctgttttagctgctcttataaccattcacagcttcacaagtttgtgaatgatgacttgcggtgcattctttgcagagatatcaagtattaagtaagcaaagacttgatcgtgctattcttatctttgtgcaaaatttcagaaggtcatatgtaggagatcaagccatgcattcttcaaaggttagaagaaaccgaataatagaacataacaattataattttcttttttttcttgatgtacctttttttgtaaatccccatcaagttttacttctttgctgcagcagttgtatgcaagattatctgagcttcttggactgaatgaccatttagttttactcaatgtcattgttgggaaaatagcaactaatctgaagtgctatgctgaggtacctattgtttcgacgtttactgattttaggcatactttgatctatatgctgtggctgatcctttgtgtggttacagtgcgaggatgttattgatcatactctgtcccttttccttgaacttgcatctgggtaaagttgtagctatatgtattcactttacatttctcatgcttattatgataacaattcttcatatgtattttcgtagcagctatatgactggaaaactgcttctcaagctggagagtacaaaatttataattgcaaatcattctgtacagtcttctcactagcttctgtttcatattatccctgtgtcattcctggtcttagaattgattatattttcattattgatattttcagagggagacttttccatttcttgaagaatacagatgtgcccgcagtagaacaaccttctactacatccttggctgcttgattttcatggaagacaccccagtaaaattcaggagtttcatggagccactcctacaggtgcattgctacttgtattcatactccctctatatctggccctgtccagatcgtaggtagaaatagctatattttggggcgtagagagtagtagttaagttttttctctattcttatatggttttcttctttgtattctctataggttgcagttaatttggaggcaactgctgatgctgctttccggactgatgttgtgaagtacgcatttattggtttgatgagagacttacgaggcattgctatggccacaaacaggtgcacaatttgattatatatagtatatgtgtacatcaactcttcttttggaaactaactacttttgttggtctgatccagccgcaggacctatggcctcctatttgactggctgtatccatctcgcatgccacttttattgaaagccatctcactctacgctgatgagccagaggtaactatgaaatcgcaatgctttccttgcatagctgttcttgctgaaaaagtttgaactgttttttaaaaattatctagagccttatgttttttttgttcagctactataaaatcacaactttgtgttcatacaggtcaccacacccctgctcaagtttatgtgcgagtttgttttgaacaaagctcagagattgacatttgattcgtcatcaccaaatgggatccttttattccgggaggttagcaagctgattgtggcttatggatcacgtattctgttacttccaaacggcactgatatttatggaagtaaatacaaaggcatatggatatcacttgctgttctttcaagaggtgagttcagaaaatatgttttgaaaacacatgtatgctctgcaattttattacagtttcagcaagtctacctgctgttattcactgttatctaatgcttgatctttttagtgaatttcatcctttacaattttatgtgttactctcattgcactttttttttgtttgaaaaaagtgtgctttaggttacacttgctgtgaaatgttatttgcattccaacatgtctacgaaatttcatgaccaaaaccttgtttttgtaccccattgagatcattgttttccaacagacaatattagcttatccccatgggccatataatgacctggactgtgaaagcttgttcatttttgttaatcatttaactccttactgatttgtgatatttgagttgaattgttgcctcgtagggcttggcagatgataaatatttaaattgcataagatttgcagtagttgagaatggatttatgatgatttaggctaaactgaaatttagctgcaactatggttaaattctgttgcaaatatggagacgttctatacttttttggtttcatgtgtgctacgatctatggatttcctttttcaagaggatactgatgtacttgaatttggtataagatgttacttggagttttctgttagggtgacagcttagttccaccctctgattcaaactttttgttgtgcttttaatgttaaagaataaaattggttgagttccactcaacttgagcccaactatttgttcttaaactgtatcttctgggaacctcatctccaattgcagactaaagatttgtatttttttttcttgtactgttattctgactagaaccattgcagctttatgtggaaactatgtcaactttggtgtatttgagctgtatggtgacagagcacttgctgatgctcttgatatatctttaaagatgagcctctcagttccattgtcagacatattggcattcaaaaaggtattcctggcaactttagtgatttactattgttttgctgtgtagtgctattgcttttattgatatggttagtaagatctcgaaaatattcatgctaagttttatagcattgaagatgtatagttcttattatatcacaatgaaagtgaattgaatgttatgtatatcaattaagcagaggttacttgtgcatcaggaactggactgagtgattttagtgccaatcttgtaatctaactgagaaccctgcatttacacccttggtatgttgatacgtttagttgcatgaattgatcagatcctagtatcctaacctgtctagaaagatttgtatactctgtcataacagcgctgtcatttttttatttgaaaacatacacattaaaattaccaggagaaaacatgaaatgagtactgccaacagtgtgctccagagtcctatcgggaagctttttctttggaacatgggatgctgcagttattttttatttttatgccagacattttcaaacattttttcaagagcatactcccaactcctagaactgtagttgacaacaaataggcagcagcacagtgtgtttggactttacttgtattttttttcaacattttgtttgtagtcttcttggcattttaccagcaggtaccctgcatgcaagcttagtatatttatttaggtgatcttgcaattgcccactggtaacatgcgtacaggtttagtgctatgttttccaacctatgtgctttttactggcttgatcacagacaaataaacagcctagacaccattccaggtcttgcgttgtcccacattgatttatgtttaaccagatgattgagatattcttgtttcattcgtggaagcattcatactaggttctttctttatttcagctgtcgaaagcattctatggatatattgaagttctgttcagcaatcatatcacttttgttctcaatttagatacaaacaccttcgtgcatattgtcagcactcttgaatctggcttaaaaggtctagatacagggatatcaacacaggtatgtggcatgatgctttttactgcttgaaaaatgttcctcgcttcttgttacaacagcatcggtggatcagtgcttaaactgtgtcctatcggcgaagaccgttccaatctgtggttgctggcagataataattgatgccatcataatactctattctcttttttgtgttttccctattagtttcttctcttggatctggatgtcgtgtgcaacctggttagggcccacatagaagcagtagtcaacctctctatttaaatcatttccatgtgagcagtaatgggaacaacatctgcctatggttactgttaaatcattttcatgttctttgatatggcatatatagtaaaggattgggttgtatctctatttattaaggaagtaatacacacaagcttttagtccttccgttttatctcctgcctccatggtgctgttgcactgcttggttccatggacattgattaagcctaagggcccttaactatgctcatcacattggaatccatcattgttctgtagtgctttctgtttggactaatctgtaaattattgcttccttttggcagtgtgcctctgccattgatagcttggcagccttttatttcaacaatttcacagctgctga

SEQ ID NO: 58407 - DNA, 4150 bp, Oryza sativa
tgcaagaacacgcatggcggcatgggtgagtttcttcagacaagtacaggattgagcttctcggccaccatgatttatgatttacagagctttaattgtcagtaaaattgcaagcatgaatatggcagaagagggccaaccatgtgcaaccaaaaaaggctccaacatgataaaagaacagcagaaaggtagcctggactagaccttcctttcctttgctttaacttttgagtggacaggaagactacaagcacagctgcatcattgttcgtcatctccagccatggaaattgtctcagtgtgcaagagtagagcctgcagagagatttctgaattgaagacaactttgtggtctgaaaaaatctgaaatctgcagggcattgattcatgcagtctatctgatctactgttgagcagaatttgctaccaggaaaacaatcagttatgattttgttgcatttgctaagattttgttgtcataagatcagatattaggtggactataacagttattaatcaagatatttaccatgtagcttgcaattttcaggtgattggcctgaattttagcacactaacaggaaacatgaaccctaaatctatctggggctcatggcatgtccaaggagatacgatttgcggttttgcaccccaccaacaaaaccacacaatgagaagctctcattccacttcagaaaagaatgacaaatactactataatgagaattatgaacatatggagaagaggccaaaaggggcatggctgaagtatgtgcaaagatcatagatggtgcaggatataatctaagaggcttgctctcattccatcttgcagacacattcagcaagtatcacagaacatagtctaagaggctgctctgaattctgatttccatcttgcaaacatattcagcgagtatcacagaacaagcatgctgcaagacaatggtgggataacaaaggtagcaaccacccattggtattaaactgatgatctccaacaactagcagattaatttctcaagttaaaaaacggctagagctaacaaagagttcatgacgcctaactagattctgctttcgttttctcagcatctaaggctgagagcccctaaaagctcaatgcagcagattgagatgtgattatcagctcacttctacgaccaaggagcccgcctaaaattcaatgagacagattaagatgttcttcactatcagcttacttctacaactgaagagttcctaaaactaaacgcaacagatcgagacgttcccgaccaccagttcacttccttgggtgtggaacagaattcctcagctgcatgaccttcttatgagaattggagtgtatgtcactcacaaaagttggactattagcaggcctgtattccggcagcagcctgccagacttgaacctcacaccgcaagcattgcatagcgtcttaggccccaagggaccggtcctccactgtggcgtcttgtaggacaagcaatgggtgcacctcttcattggctcctccgatagcagctcatcattcacataaacagccttcttgatcttcttcttatctcgccgctttcctatgtcctgttctttgtcaatctcttggccatagcgcttcttggaactggtggtgtgcccattcctcgcctcaatcctcagacgacaagcatcgcaggtaggccctgatggaccatcccaccactgtggtgattggctggacaaacaatagctacaagtgatcaccagttgctcctgctggaattgcattcctgcactcattttgtaattctcttcctcctcttgttcttgctcttggacaagttcttcatctttgtccttcttggggaggataagctcactctctgctagccagtccttatgatcgagcaggagtagcggtggctcgacaaacagcgtgatacaatgttggtcatcagtgtcgcttatgacagatgccaggctccttttcttttttcttgcattggtagatgagcgtggtggtaactttggttttgcagcaccttgacttgccattgtaataggcggtagttctgcagagacagggtttgtgcaggatgcagaggttgacaagcagtcctctacatagacagagagccactctatgccacttctatcactttcctgcaaagtaaagaaatgttagacaagattgcaatggcgaaaacaattatctatccatcttttaaaaactaaattacataacagtgaaggaattatagctttacaaagctctcgttctactagattacagcaagacatgcatggaggtccaaaatcaaaaaataaagttagctgaagcatggcgcaattaaattcctcaaaagttttttttttctgacaaaaattagcaaagacaaaattccaggggtcagtatcagctgtttctggtatacagcggtaacaaacttgaagttcatatatctcaagcatcaagaaatttatggcccctcaaagatagaatgtgcagcatctacaatttgtaattgtggcaaggaatacaaaactgccacagcaatcactcagttacaacttgcaattaaacactatagcgggcagtgggcacacaataggatcaattgcagtaaatgctatacctgcaacagaccaaaagaaactccaaaccaaaagagagctaggcaaccacatttcacatggggatgcaggcagtaggccctttattgaattctaacagtaaagctttagaattacacaataaaattgaacaatgcctaaaagaaattaggataaagctcagtgcctcttatcaattgtttccggcaacaataaaggtttttcacccgaattgacaaagtaaaaaaaattggctgtcgcaatcttgcatgcacatcatcccatcgacgaaagaagatttttacaatggacacgtctatgcaatgacagtgatggtaagggaataacatatacacacatcgatattgaaagtcacaaagcaatacatgcatttcttccctgtgacctcacaactaagccaaaaacaagatgcaagattggcatgaacatagtcttgtttattttccctatgaagctctgctggaaaaaagtgtgcggctgaatgaattgctcaacaactgtaaatatatttgtttctctatgaaccaaaaaaattctttccaatttataggtaggaaaaggtgaagaaaagggcgaggaaatgcagcacgcatgaataggaaggtaagatagttcaagaaacaaaggaaaatcccccattttcttctatgcaaacataatagtggagaaaattcatctaaacggtaaagaacacaagtgaaaggaaaaaaaaacccaaaccctaggtcctagaacaataatatcaagaaactagagaataggccaccacaaccgcaccaaattcttgtaccaaaaacccccaaaacccccaacacaaaaactcccaagaaatccccaatttagaaagaagaaaaaaagaaaatccccaaagaaaacatccaatactccccaagaaaaagaaaccatcttcctccccaattcctcctccccacggaagagcaacccaaccacgcccggttcttggcaagaaaaaaaaacttataccaaagcacacatacacacacacagcaacagcaagaaggggggaaagaaagggggaagcaacaaagctaggaggcccggagcactgaccgtggcgggctggtgcgggaacaactcctccagcgaggaggcggccgcattcggcgggtgcacatccatgcccagcgacgaggaggaggcagccgcacggttgaggagagagaaagagagagagagagagagagagagagaagcggaggaagaagagggggtaggtttccgcttggagaggggagggagggtttcgcttttatctgagccggattgctctggctcgctcagtgagcccagccgtcggctcgtgagccgagccgagcaagtactcaatactggcgataatactggcctgtttagttccgaaataaatttttcatgctatcacatcgaatgtttgaatacatgcatatagtattaaacgtagacaaaaagaattaattacacaattcgccaggaaattgcgtgacgaatctttgaagcctaattgcgccctgatttgacaatatggtgctacag

SEQ ID NO: 58408 - DNA, 3351 bp, Oryza sativa
aaaactatgatttatgtgttgctttgatttgaatgctcttccttagaaaagcatgctcaatagtttgttttactttttggtttcacaacctgaagttatgacatgtatgcatcaacaaataagaaatatatagaacagtttatgctttaaacgtttccgtttttatctgaagtcattactgtttggcaggttgcaaactccaatgtacgccataattctttgcaccttctattagatttgttcccccttgaagacccggatgtgacaaaggatgtcaatgatcctctactagagaagcaatacttcttgctagacaaacttctcatggacgattgtccagaaatacgaacggttgcgattgaaggactctgtcgtattcttaaccagttttgggaagttattccttccctaactatttcaaaatttttaagtaaaattgttgatgacatatccaaagattcttgcactgaggttcgggtgtcaaccataaatggtctgatatacttacttgacaatccgcaaagtcatgaaatactgaaagttctacttccaagattaagtgacatggtctctgatcctgctttatcggtcagatcttctgcagttgatcttcttttggctatacgtgatcttcgatctttccagtttaataaggtacattacgtacttcttcattacatatgcatgtgataattgattctgtaacttaagtaacctttggatctttattttcttcagtttgagactttgaacaaacaaactagatgtatgccttttgtttcaggttgttggattgggtactttgctgtcttcactctcaaatgaccacccccgtgtcgcacagaaaatcacaaagcttctcatcccttcatattttccaacaaaattgccactgaaagaagcgtgtgctcgctgcattgcacttataaagaggtcacccacagctggagcaaggttttgtgaatttgctttatctgaagggtctcccccaagatcccttgttgaactgatcaaagtctctattactctggcactggcaccaacaggaatgaactctgaacagactgatggtcttgttattgcttcagccaatctaattaaaagcttatctgaggagcgctctagtttagcttccttaagagaattctttgcaaatgcaaagttgaagctactctttaaaacagaaatttctgtgggagcccggtctgctctactcagtatggctccagttgtatcacctgatgatctatctgctttgcacgatgaatgcatgaatgtagtcatgaacgctgcaggggtttccacgcaacaaggttgccaagaagcagtgctagcagcacataagttggttttttcaagtggctggtctgacgaaatgtttgaagcactgacaaatattctgcaatctaaagtgtcttgttttgctgagatttatgatatagaacctcctatctgtcccgttgctacttcaaagaggaagaaaggaaaatcacttaagaaaacaccagcaaagtctggtcatgatattggaaacgggtcatccagtgaagactttgatattgttgcaggtgcatcatggcagattaatgacatactgaaagatgaagaaaagagagttgcctttctacaatcttcttattcagacgtcgcattttcatctctgaaggtcatttgtcaagtgtacattgagcagtgcctgcagtttgactctttaaatgccacacctcttttggcttatttgagtttggctacacacagcgctcttcaggatattgaccaaactgatatcagcacctctgaggtgagttaacccccacgattccaccatgcccactttctttgataattggcacaaaaatgttgataaaacagtcagttccacctcactgtatagttgtcacagaaatgttgatgaactcaaacactagccatctggtcaaacattgatggtaactggaaccgatatttgttggttgcacttaagctatttttgctacggttatgtagattattgtgaatgtgttcaacatttttttttcatttaacaattaacatgttgccattctcataagtttgatctcttgtttcagtcaacaaccatcaatcactcactggaccatctgctgaattgttttgacaaactcctaaatgaatctgttactggttccacaaactcattgaagttgaagcagaataagaaatctgcacggcagaaacaccatcatggagttcctgaaggtatacctgcacagatatttacaacttttgatgcagaaaacctctttgatctgaaactttatttattaacggaatattgatatgattttcgaaagcatgctagagaaagtagttatgtaattaactttaaaactttcaacttgtagtcaccaaaatcagtatgttatctatctggcattatcacatgatataccttgtaaatgagtgggttatgtatcttgtgcagggaatgcattgagagggacagttaatgtatacatgcttggcacttcaattctcaagtttatcgttgacacaataaccatcaagttgatcagtgataataaagtaggatgtctcaattttgcattgtccttcacaaaatatgcatcatcagccataaaaatgcatcaggagcagagctcatctttcaaagggaatgatctgaaagacatattgatgcttatacggagttccttcacatatgcagccaagctgcttcatttggtcctagcaaactcaattgagtcacagagtcccccagaggaagccttctttcttgccaataatcttcttgatcttgtaccctctgttgagtctgctgcaggctccaaatttgctctcagtttagtttctgtcgtaaagcagtggctaccagttgtcataatgggtcttggatgccgctggttgattgggccacaggctgagggtaacatgtgtgactttggtgggtcttgcttgccactatgggtggttgcattggccaagaatgagctgcttgatgatgaaaaacctagagatgatgatcaaagcgagcaggccagtgaggactcacagtcatccagaaaactagcagaaatgatggtaattcttctgaagaaagggagcccgaaaattcttgattctgtggctggcgtcttcctgtccaccctcaagttggcgctgcagagagcggagtacggtgttgtcttgggcttgacacgctttgtctgtgtcaggttgcttgggagtgactcctcggcatcggagaagctgcatcttgctcatgattcacttcgtgagaacttctttgagattgacaagcatgtcatggacgatctagttgacagcgaggaatcgaggcagcaactggag

SEQ ID NO: 58409 - DNA, 5024 bp, Oryza sativa
ccgtcgctatattttaggtgccggagataaaagagttctcaacctccccgaaagaacacgggctacgaatcatcaaaaacattaatcgccactctctattgaaggtgtctagacggcggctttcagaatctcttctccttaactttttcatgatgctagcggctagcttgatgggtcactatagctcacttgttagtctcctttctgtctagttttaaggcgctgatggatgatggatggaagttagtttatgacaattactttaaatattagaaagctaaaaggtcgatttaattaagtttctttaagaagtactccctggttctatattaattgatattttggacaaagttaaggtcaaacttttataactttgaccatcaataactttaaaaatatttagtttaaaggaactagaacaacatatatagatttgtcttttaaagcactataataaaagtaaacatgcatttatttattatatatattataatagaaaaataaggtcaaagatatatcttgtagaccgtgttattatccaaaacgtcaattaaaatgaaaccggaggaagtactaaggaagaaattagttttttcttttataaaattcgtacacttcgtaaggctgaaaagcatgccctgaaatcgctcttgcagacacaacacaatgtttttcatcttctctcgacaggtaaagaatgcgatggtaatgtggacagttggaagcatttcaagtttgcaactgcactgaaaggagtaatactcaaagaaatgcatagcaatattcacaagtacacatgcaaattaaaaatgatgatgatagtatgatacatcagtgttaataagaatttagtaagaaaaagttagtatgtatagccttttttttattttgcatgttagctttaatcgtgctacaactagcaatcatcttttttacctccttactcaattaattaattattctatccgttctaaaatttaagaaattttgcttataatttgggaccgatgtgcaagtaattaatgatcacagtagtcctttcgcagttggttaaaaataaaacttgcaataacccctttcaagaatcccccaaccgtcaacagaattatttgttaactaatcaccgacaacacatttgggtggtcaccataggttcaaattggtctttctcttcggaataaaattcattaaaattaccactttgcagtacatatcgcgctccattcatatatattggtgcaatcttcttttccaaacttgaagccgttggtaaggaaaatattttttttgcaggaaattaaaagtacttatttttaaaaacctaagccagccgaactggttttgtatctagagaggtaagcactgtacaggagtcaccaaaggtgacaggagaagaacagggggaggtcagtagaaaggaaaaaaggaaaaattacatcttaggaagtagctaaggaaaacaagaaagtactttttttttgcacgaaagagaaaagttaattaattttgatatgatgtttcgcactatatgtgatcagtgtacgtgacatattcatgtgattcttttagtacttccacagttaatgttctaactttacaaaaaatattattctgactgcaggaagaagtcaacctgccacttaaaaaaccagtcgatctcgagctgattagccgtaataaacttttatatgtgtgtttctactttctagggacttataagccaatattgaaaaatagattatgatgaaaaaacatcataatcaactccaaaattaagatttaaaactttgggtactagtgataagctgaagagtaaacaatgatctatttgatcatagatttgtagttccagccaatgtctacctcatttagccctttatgctctactccctccatttcaaaatataagcatttttagcatagtgtcaattcaaacatttttaactttgactattaatagcaaaaaaataaaaaatataaatcatgtaaaattgatgttactagatttatcattaaacaaactattataatatgcaactgtttttagttgaaacatcttatttttatatagatattgttaatcaaagtagaatctcgaagactgtgacgaagtccaaaaatactggtattttgagacggatggattatttatttcctcttacatggggctccgccatcaccttccctctgtataggagtagtattttttttccgtagttttttttaaccttagcactttagcggtctttctgtttcctttctcttttttccttgttcccaagaaatggccatttggctggttgtgttgtgtaacaaaaactatgatttcttctaatacatcgaaattcaatctttttacacgttcgcagaaaaacaatttcctcttacatattagaaactatcacaggcacgcttcctaaacttataaacggtgtgaatatctaagaataatattaaaacaactttaattttcaactttgtactagaaaattcattcatttgtacccttaaaacattattacaaaatcagataacgtatcatttactatataatcagacaaaaagaatagttgcagagaccatcgtggctccatatcatcatataattaaagtcataagtacaaaatacggactttaaacaataaagtactccaatttcgtcatgcccaaaataaatcatggcaaaataatacggtttaccgtttatgtgacaagttgacggatgtaggaagccggtttatttttttgctgaatggctcaatagctaaatgatttttggactcgaaagtacaaacaaataaattaattattataaagttgaaaagtaaatttaaaacatattttaagacattcacatatactatagagttttatgaaaatcacagagagctgcaggtgaatgcaatccttccattctttagaaaagaagatacctttaccttataacggttccttgaaagcacatcaagtagtattaaagtaaatttattcgttgaaaggcacagaataaaattgaatccggcatgcatgtcggaatctttagtttgggttcgttttctaataaaaactagtaaatggaaaataaattgaatttcataataaggcactgcctactcctacctagctaacatttgataaaatattcttaaaaatctattaaacctaattatggcataattatgttgtaattataatataacaagcatatgccattacaatagatttcctcgattttctcttaatttttctagcgaatgttttttttttgcggggaatttttctagcgaatgttatgtaacaaattaatccgattgtaaattaatatatgcagtctgcagaatgaccaccatcaccgtcagtgttaatctctggcaacaaactgctcttggtcaaggatgcagacgccgggacagtagccgtacagctgcccagctctcgatcaacttggttttccatcaaaattaaaagtttggttaaaattaaaacgatgtgatggaaaaattaaaagttgatgtatgtagaaaagttttaatgtgataaaaaaagttaaaagtttgaaaaattattttagaactaaacacggtctatattaaggtcataatgatctgatcaaaatctcataactagccggctacctagaatgtgttagctcttgactctttagaagcaggcaggacatgtgttgaagtcgttctctttgtcagtctcttccatagcttaatttaattcgcacactgatcagaccaagacaatcaatcaagacgtcagcttgattagcaagtgcattgttgtgcacatgaatgccccagttgattccaacacgagatgacaagagtgcgtgtcgatctggccttgacaaaagctctcgtcaccctcactgcattatttctattctcctctgccggccgtagacgttttaattattacaaagttaaaataatagatttatttgatattttaaatcaactttcatttaattttttttcttataagatatattatttagcagtttaaaaaatatggtaacagaaatcgaggtaaaatatatattaatgaggaaagaacaccatccacgctgtgcataggtcatggccggatagtagttataaaatatattttaatgctacgaatttttataatgatccatccagatttactagtttgctacttcatccgtttcatattataagtcattttgatttttttctatagttaaattattttaaaagtttgatcaaatttatataaaaatataacaacatttcgaacacagaagaaacatattgtcaaaatatattgaacgatagatttaataaaattaatttgttgctgtagattttgctaaatttatctataaatttggtcaaacataaaaaaaattgactagaaaaaaaaatcaaaacgagtaataatataaaatggagagagagtatattttaaaatgagtgaatagctagctaggatgcattgcgtgcagcactacggtacgtactgtgtacaccgtagagaggcagctgtactgagtacactgtggccgagctagctagtcgccattcacgggcatgtacctagcttaggctttggactgcacagcgatatcacgcgtgcattgtcaccgtggccacagggcaccggcggctagctatcgagtacgatcaatcaatggatatatcgaacggccagccgcgtgtgttcattgaatgaagtgggccggccggcgaccgagacgaagatggtgcatgcagtgatgagatctatctctcacgacttcgtacaagtgaagtcaatcgccctacgcccctaccataggtggaggtagaaaggaatgaagagtgtgttgcttgagttttgatcgatgcagagtgcttaagtttacattgagggcttggttagttcgcaaaaagaaaatttttgggtgtcacatcggatgtttgaccggatgtcggaaggttttttcggacacaaatgaaaaaaaaataatttcataacttgcctggaaaccgcgagacgaattttttgagcct

SEQ ID NO: 58410 - DNA, 7748 bp, Oryza sativa
cttgtattgtggatctctttcttgattctattctaactgtttttatttactctgtgtgtcttcttctgtgtatgcagggcgacatctttgtacacttccgctagatccaaacattggaaaaatgctgcttattggatctgtttttcagtgtctggatcctgcattaacaatcgctgctgctcttgcatatcgtaatccatttgtgctcccaatagataggaaagaagaagctgatgctgtcaaaagatcatttgctggtgactcctgcaggtaattaatataatcttttctctgttccgtattgattccttttgtcttacctgtactaaaatatctttgtcaccatataatgcaaagaatgtgagtgttatactgttattacctcagacataagtaccaaattgatgtagaatgctgggttgcgtactaggttaccgctgataacttactttgacaattataacatttctacaagtactttagttttgaaagtaatgttatgttgataattttttgtaacttatttttccagtgatcacattgctcttgttaaggcgttcgaagcatggaaggaagcaagacgcagtggaagagaacgctctttctgctgggaaaatttcctttcacccatgaccctgcagatgatggatgacatgcgtaatcagttttttgatctactatctgacattgggtttgttagcaaaacaagaggattgaaggttgactatctttccacattacattttaattcaaacatgtagtgcaatctaaattttcaaaattaattatatagcttccttcaacttctgattgtgtttgctaccgtgctaataaatagcactatagcattcatctaagctgaggtctttatttcctcacaagactgcattagtttcactatttgtggtgtttatgcattcacttttgcacttgtccaatagttactgtcatttgattgctacttaataaccatggtctgtaaaatttagtgtttaactgtacgggcacatatggggcctgtttggagagcccaaaattatggacaatccacgaagatgggccaggattttggggcctcctaaacgatcttataattatctcttttccccatttcaacacacttgaatcatatctactttcgtgttccagaacataagtttgcagtatgggttcttacttccatgatataatttcaggcatataattattatggaaaggatctggagatggtatgtgctgtcctatgtgctgggctttacccaaatgtcgttcagtgcaaaagacgaggcaagaggacagcgttttacaccaaagatgttggcaaagtggatatccatccatcatcagtcaatgcgggaattcaccaattcccattgccttatctggtttatagcgagaaggttaaaactgctagcatttatgtcagggattccacaaacatttccgactatgctcttctcctctttggtggttctctcagtgagagcaaaactggagaaggcattgagatgcttggggggtatcttcatttctctgcaccaaggcgtatcatagagttgatccaggtatctctaacttccctacaagataacttgtttgaactaaagaaaaaaggatttcagttattctatttcgtttctattttaaggtttatttttcgaacaggaaaaggtattaaatttcatgcttgctatttgatctacattcctttgttcacactgagcaatcattttgcttgactgatttacggttttagtccctcaaatgcattgcagcgaatagaacatcttcatttcttcacatgtctgcacagaacttgctttattttcttgtttgcacaagcaaatcataaggatgttaaaacagttttggaatcactttgttgtaatagatagacctatatgccttcttctctaatttaggaatgtttttatttgacagagattaagaggtgaattggacaaactcctccagaggaagatcgaggagcctgcacttgacatattttctgaaggaaaaggcgttgtggcggcagcagtagaactgctgcacagccaaaacgttcaccactagatgctatctataccggttccatatagcagttttagaactaaaataacagctataccagggagtgcttttgtatactcccttcaatttcgtttgcttgttagagttgaccccttattttttgtgattttccgggagcaagttgctttttacatggacaaacgggataaaatagataaatcaatataaaaatttaatacggacaaaaacttcgaaacatttttttgatctattgctgggacttttagaacagtactcatttgccaacgaaaatggaagaagatctcagaaattgaaccggtctgtttcctttcacgatatgaacacaatggaagaagataccgagtcctcttgttgttaatagaggcacaacagatattgaactgatctgttgaatgacaagcgcttgcttgatcgtattatccagcacttctgtatttttagagaagaccgagtatcgtatgcaagaacacaatagtgagaacttgaatcaaattgcaattgctaaagcggttattttagtccttgtggtttgaaaagtaatactccgtgcaatttttgtttcttggtacatgaaacagaagttacatggagcaaacatctattctgacattcagacttgaccaagacaatagtatgtttgtttcttcaaaaaaaaaaagaaagaaaaaaaaatgagcagcatgtttttccatcaatcatatctgtcgacttgaagcatcacacctactgcttacctatatgatactaaatttcttgtcattctgttatgatactaaaaataaaacaaattggctctatcgcaaaaagaagaagaagaagaagaagaagaagaagaaaagaaataggaaagaaagacaaatcggcccacttgacatttcagacaatatcttttctgttcaacacaatgaaatgcaatttaacacttcatgtgttgtttattaactttattcaatgatagaagtagtaaaggtgacatcgaactgtatctctgcttaaacaatttattcatgtatacatcattacaaagtatgtttatttcatcgactattgggagtaaaaaacatgctcgattctattcaatccacaagcagaagcagatgatacatcatttttcccacaacaccagccatctcaagatgtcttgcgggtcagcctagacatcatatgatcagatctctgcaaatatgaaaattctgtgcttagaactgcttgtcaaattcagatcagcaagagaggtaataagatggaagaattctagtaaaaagatagaatgggtataatgattaaatctgtaactctgtagcctcatccaacgcttatctgctaataataatcaaggatagtacaatggtgtgacggatcacttccaaagttaagtataatgtaaagcatatattcaattccaaaatcttccatacagacggcagatgattcaacatattcaattatgcatcaattcaaaaaagtaagatgattatatcgagaatagggaagcaagaaaacactaacctgctcactgtaaggaagatatttcccatcaaatgtgaccaccacgcgatcttttccatcagcaccttgtaccttgtcaaccgaacagtagaagtctatagctgacatgctgcattaggaagcagttaaacggattctttcacctttttttttcaaaggatataagcatggcagccaaaattagatggtcagtagtcttgaaatacaaaggcctctatatcagcctgaagagaagaaaatattttacttgacatcctgataagaatatagtgatcggttaccagctaccactaataagaatatagtgattaatctagacttaatgaacctccagggattgttcccataaaggtacatgctttgcattttttttcagagaaaggtgcatgctttacatcagtgcttactgtatacaaatccttaacttcgtccatgtgcagttaccaggaacaggaagtcaagaaatactggggtaaatgaaaatcaaatagaatgaagcataggcagatatcttacattccatcaccaaactcctcattgataatttccttgatgctctctccaaaatgcataacagcttcattcaatctgagcgcaatatataattaaaaaaaatatcaacaagaatccttttctagagtgttgtaaaagtgcattaccacaataatttaaatcaaccgtgtactaaacttgtaataatctggtaaattttcatagagacaacatcttccattacaatagcacatatatgtcgataaaaggctcttgcatgttacaaagcaaacagaactaatcatgttctttagcatattctcttacaagttaactatttggcttcttaattttaatggaaaaatgaaataaatattcactttctgacatagaatccctaagaatataattagtcttcgccaacgcgatagaattaagcaacatcgtgtctatttttctatgccaaaggttcaaaatttcagaatcaagaacagcacaaagaaattacttaatttcgccatcctcacaactctagcaagcatgtataataaataacgaaaagataaagagggctgctaccccacggtattccgttgctcctagcagtcacgggataactaaaatcccgagagatttaataagcttcatcaattttgtggggaggcccacgctatcctgcgattccaccatatccaatcctccttggtatcttgggtaaggtaccgaggtggtacctggtacattggtatcagctggtaccctggtatcgactatcgactgatacctggtacaccctagtatcgactgatacctggtaccctgggtatcgagctgatacctatgtatcaggccttggtacctaggtatcaggtcttggtacctgggtatcgactgatacctggtaccctgggtatcgagctgatacctaggtatcaggccttggtatctgggtatcagtgtgatatcccaagagagaggaggaggaggagtcgtgggtcagggaagtcgagcagcggggcgacggcggaggaagaggaagaggaggcgatagatctggtgcctaccttgtgccattccgtcgctcgtcgtcgtgcctcgctccaaaccgccaaacccgtggctccattgacgccgcctagagcagctcctcgtcgctcatgttgtgccaagtgctcgcccccggtggccgcgtccatcgctccccgaccgtaggaggcgccagcgccgccaaggaggaggagggcggcagcggcgaggaagctaccgacaagaacgacgaagaggaggagcgccttgaggagcttgatggggaggcttcttgacggcggccgtcgcccgtggtggtcgggagctccgccgactgtcgtccaggtcgtccgcgggggctggtggtgacggcaccgtcgtcgtcgttgccgccgccgtcgttgccgccgtcgtcgccgttgccgtcgccgtcgtcgccgcctccgtgctcatgggtggtattcacagagagagggatcgaatggaggggaagagagagataagggagtagtactattccgtctccacggaaaaccgtaggatagattttctcaaagataaaattctagaagaacaatcaaaaggaaagcatcaacatgtatggtttggaatcagaggcgagactcaattgagaagcagagtacggtacggccatgggagggaggggaaggaggaggcacctgtagatggcgggctcgtggacgatgtccgggtggtaggagcggaacggcggctccatcatgagcgcgacgaggtcgtcggtgagccccggcacggccgcccgcagcgccggcgccgtctccggcttcagctgcgcctgccgccgcagcagctgcgccacgtacacgttggtcagccccgcctcctccccgatctccgagaagctcttccgcgactccgccttcgccgccatcagccgccgcaccacccccgccgccctctccccgccgccgccctccatatccctctcctctcctctcctcccgccgccacgcgtcgcagtcgaggtgagtgggtcgaggtcgtcgtcggcggcggcgcgatgcacggtggcctcaaaatcacagcttttgtatgctcatcttcatcatcaccatcaagaacagaaacagaggagcggggggcgctcgcctgaccggtggggcccacttcgctgacagctctgtgggctgtgggtcccacgtggtaatgggccggaatttttttcctggtttgggggcctggtaaggtttttgggcttgggcttgggccctttacgcgctcagccaggatggggagagaagctcagatcggccgttcacctcgggccttggctcagggaaccttgggcctggaggtaatgtgggcaaagggcaaccaaacacgggccttgcaaccatgcgtgcaagccaaccattatcactgtatgtaggtaatcaaaacacgtgcttaatgcttatattacgtggcagagggtggttacccctcctatgtggtaataatgacagtaaccgcagtaaccagttatcaagtaaaaccgataaaaaaaccaaataaattttatcggaatttaaaatattatttaaattcttttgaactcggtcgataccgagcggttttcgttactgcaccccaatggtaagtccggttgcccgttggaccgatgataatgcaaaccctgtcagatatttgctagctagtgcttttgttatctttccttctaaaaaccagctttgatttttttttcttttcaccagaagaaaagttaacaaattgtggtcctccaaaaggaattaatgattttgaagataaaaaaaggacggttgggtccagtgtctcatatatccacccttcatgcctgtagctccactactgcaagcagagattgcacacatgcaatttgcagtacagactacagttacagagacgctcaaattccagcccaatttatgccaactttccagcagcaaatgcatccgaacgcccaatctatgcaacctctgacagaatgagatctgaaaattaaaggagacatataacaatgcatggttttatctgatctcttgcttttgctggccaccacactgaataatgcagatatcagtcaggaatggacaggcaatcgtaaggttaattaatctctgcattgatcaagcctacatttaattctgaagtactggctctcgatcgattaattgatcaccatttagtttaggccctgtttaattcccacccaaaaatttttccccgtcacatcgaacgtttaaacacctgtatgtatgaagtattaaatataggctaaaaaaactaattggacagattgcgactaatttgcgaaacgaatcttttaagcctaattgttccatgatttgataatgtggtgctacagtaaatatttactaataacatattattaggcttaataaattcgtctcgcggtttactgacggatactgtaattagtttttttattagtgtccaaacaccatatgcgacatcatatataatattgacacgccaaaactttacatccctgatctaaacacccccttagtagctagcttggtccctcccctgcgtatcaaatccagaacaagtagcataactgaactataaatgaactggacctaactagggtacgttgatgtgcttcatctccgatcaaatgg

SEQ ID NO: 58411 - DNA, 16606 bp, Oryza sativa
  unsure (1)..(16606): unsure at all n locations
tgggtggccgcggctgcccccaacctctagtcaagatatcccggttcccatgtcaccgacacaacgttatctctaaactcaccgagaacggtcacatgagctcgataacagttactctaatgtctgcgcgcggttgagaatatgaattcattcatttgcatcgaagttgggggctactgtcagggttatggataccacatacctaatagtagttgactaaatctccgcaggatccaccacataccatgtcttatacggaaactgacttcagatatggagggagttctggataaggaaagacaaccagagttctacatggaaacgacaaggactactcggattgtatccatattggtttccctagttctacttggacaagaggaaacctgtgggtataaatacaagcccccctaggaggacagggggacacccatgatatgagacgatcaacatgatcaacaaccaccatgggggacaagacaatcaacacccaacgggattaacacctgacaggatcaacacccaacgcaatcaacacagaagcctacatacgccaagacacgccgccggatatcgacttcagggataagcacggctagtaccctacggtgtcttcggatactgtcaggagagacgaaagcgctatctttgttctcgccgggcacggattcgaggtggaaggctaccctgttgtcgactacgagtcagatcgttagaccgccatgtcgacaacagttagataggctaccccaaacattgtactggtgtgattatcatgaataagagcaataccggcttcggccaacagaatgtagggttattacctgaccgctcaggggcccgaacctgtataaaaatcctcatctccatctcttttacctcagtctcgcgtataccctagcaccgacgatccccatactatgcaaataccagaattgcgacatcaaacgtcgacactggcgcgccaggtagggggattttggtgcttcaggatttcgacgagatgggtttaagagatgaactctccgacaaccagctgagatccaacctaaccagatcggaaccatcatcgtcatcgacaacttggtctatcgagatcatccaagcctcaatatacgcgacgtaccaaaagatgtcagatcatatgatgtccaacgagtacgcaataagataattggtagattggtttttcaaattgatctactaatttcgtaaatacatccggcatgtatctacaaaggtacgcaatattttatctgcaatttatcgtacctattcagatcatacatcattgtcagatccatgatttattatgtttacctagagcatgttctttatacaataatatctgttgcgcgagtgtccccgatgttaaatcgactacggtctaacgtagggggctcgctctattttcttctgtataaatcatgcttgtttacggtttacataatgcctgacatttacatctgctcattatatcctgataatactagaagatccatgcagtttttgagtacatactcgatatcccatgctatatatcttgtcttctagaaaatatttttcaggaacaattgagcactcgagtatattgtggtcgagtacaccgcattatcgagaacgatctcgacaaatgcagagtcgtcgcgcccaacctaccaaagaagtccgacgacctatctcatagcgctagccatcgctggactactcgagaaaaggttgttaacggataactcctcacgaacaccgtcggcttgatcacccgacatgattgcgagcggacatccggatatgctataagttgggtatgtgagtcatgctggccacatgatatgcacatgtaataaaccaactttagcgcccctataggtgattaagagactcctactcctggttctcgaaccagcaaaatgtagtgatctctctcgcctcactttaagtggtcgagttacgactactgcctggtcctcgactagcgatgtagcgtttctcccactacttctactttcagtggtcgagttacgactactgcctggtcctcaaccatcgatgtagcgtttctcccactacttctactttcagtggtcgagttacgactactgtctggtcctcgaccagcgacgtttgtttctcccactacccctgcttcaacaaagttgataccaggtgcacaagatcgccaagggttttacccagagatcccttacccagatgacacctaacgttgaaacctatcctaatgtccctttacgccgtcttgacaaggcctccgatgaacctgagggaacttcggctagggacgcctagagccgataaggccttgttggatccttcagagacgaaagaccatgtaagacctggtcgtgtaagagttctcgccgtgcgtattaaccaagccgtgtaattggaaattgagttttccaacttcatggctggggactaggatcagtgcttgttcaaccgaggcaggtcaaaggtccaagagccttgacatccgagaacgattctccgacgacaaggctgggggctaaggagagtgtatgactctacaaactgactgatcggagtcggtaagagagaagacgctcatatacaaaacactagtctgtacattcaattcactagtctgtcatattataacatgtcaccctttgagaattcgctcgggggctatttctatctaatattcttttctgagtattgattttaggaaaattctattcgacattatcgaggactccatgtctctatggttctaaaccaagattgactaaggcgagtgcgacaaatgtcgacaaagttctatcgcagactctacgccttctcgatcgctcgagaacggttgctagatctcgacaaggaatacggaatgaagaaatggtgtacccgccgagataaaatttcttgacttcaatccaaattctcgattacagcaagacgtgagacttagtcgtacgctctatattttctcggtcgacatcaaagattgacttagacaaaccctttcggtgcccgcacgaggctgacaaaggaagtccaacgtgacgaagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctcactcctcttttctccagtccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgaccctccgatgggatgggtcataccaacctccactccgccggaagcaggtgcaacgtggaagcacggttgtttgctgatgacgtgaccggcgtcagaccagtcacaaaccggtcattcttgtctaccacgtgtcagtttagcatgccacacgtcagcccttcttcataaaatgacttccttgtaatggttgcgatgaagcctggtatgaatctagccgggaccgacgtgctaactccaggagttcccacgccggctccgtctagggacgagtgcctagaggctctcatcatttcgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccaacccctcggggagatagagggaggggcggcctcatcaccctcgggcccgacccccccgagggggtcaggccacgtgggtgaccgcggctgccccaaacctctagtcaagatatccccggtcccatgtcaccgacacaacgttatctctaaactcaccgagaacggtcacatgagctcgataacagttactctaatgtctgcgcgcggttgagaatatgaattcattcatttgcatcgaagttgggggctactgtcagggttatggataccacatacctaatagtagttgactaaatctccgcaggatccaccacataccatgtcttatacggaaactgacttcagatatggagggagttctggataaggaaagacaaccagagttctacatggaaacgacaaggactactcggattgtatccatattggtttccctagttctacttggacaagaggaaacctgtgggtataaatacaagcccccctaggaggacagggggacacccatgatatgagacgatcaacatgatcaacaaccaccatgggggacaagacaatcaacacccaacgggattaacacctgacaggatcaacacccaacgcaatcaacacagaagcctacatacgccaagacacgccgccggatatcgacttcaaggataagcacggctagtaccctacggtgtcttcggatattgtcaggagagacgaaagtgctatctttgatctcgccgagcacgaattcgaggtggaaggctatcctgttgtcgactacgagtcagatcgtcagaccgccatgtcgacaacagttagataggttaccccaaacattgtactggtgtgattatcatgaataagagcaataccggcttcggccaacaggatgtagggttattacctgaccgctcagggacccaaacctgtataaaaatcctcgtctccatctcttttacctcagtctcgcgtataccctagtaccgacgatccccatactatgcaaataccagaattgcgacatcaaacgtagataatatgtatgtatattatgtatatatgcacacgtatatacatatgatgcatatagtatatatgagagactagagggggggcgattgaccgcgcgcctcctcgcgcgcgcagctgatcgcgtatcagcaccccggggggaggggggacaagtcgacttgttcgcagctaacttttcgttaagttgattgatatcacttattctcaacaccatatatcttttcactcctaaattataaaaaaaccatgtaacttagggtgagttcgagaagaggattgagaagattgggaagatacgcaaaacgaggtgagtcattaacgcatgattaattgagtattaactattttaaatttcaaaattggattaataagattttttaaagcaactttcctataaaatttttttgcaaaaaaacacaccatttagtagttcgggaagcgtacacgcggaaaacgaaacaaacaaactctaaatcacctcaccacgaatgcagccttagatccgattaattacagtaaaaacctcatttttccttgttttttattacatcgtagatgtctgggcccacttgtcaaccaaccaagctacgaccaccatatcaccgagagaaaaaaaattggcgctcgtcatcgctccgctactccgcctcccgatctctcctacttccccaccacaaccgatgccggcggtagccccctcccccccccccccttttttttcctagcgtgtaactccatctccttggcgccctccccctcttagcaatagcgtctgccttcgtcctcagtgcagcaggcaaccgcgccttgccgttgcgaaacggcttcgaccgctggtggacgaggaagctgttgctcatgtatttgtagacaaggagaccattggcaagcctgacgtgtcatcgcaccatcctctggttcagccaatgcagtcgctgtgtttcaacgagggctcacaacacgataaatgttaggggacggtggttgccactgtcgccgacgccgcgatgttcgactcgaaagcgcggcttgaggtgtacaatggctgtaagcggtgactgtcgcattcgacgagaagctcccgatttagagattgtggccatcggcagctagtcggatgggaagagctccctccttaaggccctcctcgacttccacttcaatgtccgggaggtcaagatggggacctaccgtccctttgtcctctagatggtccacagcttcaccgtcctcgatccatggtgcctcttccctgtgcgtgttccgcttcttcccctaggcggcaccctttggacgtcaaggtctccttctcttttgaggatgacaaatgggcctgaacatctgtcatgtaagagaaaacaagggaaattgggatctatactactacgagacccaagttcggttttgtataatttaggtgtatagatttttggtattgagattaaggcatgccaagcaaattaaactcgaaataaagatgagggatggtaagtgaacttttctgagcaaaaaacaggtcaacaatgagaagcaaaaggaaataaaaatctattttgactctcttaactagtagatgaatctaattcgtaatcctccaccataaaatcagatatgaatgccctctcaactatcaatatctgatcaatgtacgtcctttgatggttcttagagtggtttcgtactatgtgacgtgtttgtgacgtgttgactagtcaatccatgttgagtcatgagatataagtatataacaacatgacattgacgtggtggtacagccagaaaaaaaagaaaataaagaaaaatcagaagctcattatcccctccttcctccggtctcagaatgacagacatgaaggacaatactccatagctccatggctacggtgaggagcagcagcttgcagcagaggaagcagcgggcttggtagagtcctcggcggcatgcagtgactccgagctacggtggtggcttggcgggtcttgtcaagccgaaggtggagtagggaagccgaaggtggagtagggtggcactaggggcctgtttagcacagctccacctccacctccacctccacctccatctcttttggagctggagcttgagctcagctaaacagtttcagcttcacaaaaactggaagtggagttgggtggaactctctcacaaaataaactagagttgtggagctgggnnnangcngntncacnnctctactccaaacccaactcttaggagttagagctgtatcaaacagacctctataattgaagttgctgggtcaacaagctcggtccaagctttcatctgccacccgaccgcccaccacagttaccgccacagtctcacccaccagtgtgaggacatctcgctacaacgacgcccccgctggccagcctccactcacctctgcccgctgccggtcaataaaagaaccattggtacacttcactctattagaatgtactccctccgtttctaaatatttaacgtcattgacttttttaaacatgtttgtttattcgtcttatttaaaaaaattaagtaaatattaattatttttttatcatttgattcattgttaaatatactttcatgtatacatatagttttacatacttcacaatttttttaataagacgaatagttaaatatttgctaaaaagtcaatggtgtcaaaaatttaaaatttaaaaacggagggagtaccataagcaatcaacaactaatatgagactcatctaataaacagtgacaaaaaatacattatactatatatcaggagaagtatatgcgtatatctaaacggtgataatttagtgttcaattatccaccgaatgatcacttaatcacatgatgactagtgatactgaacacagttcctctccttggcattcactgatctggctatctagaccattaattagttttgacgaaccaatgtagttagtcacatgcatgcaaagagattaattatttcagagacagatcgatgttcttttgagggtgagacagatcggtgttgaaccatccatttgtcaccttctagcttttgcagcagtagttaagtacaggagataactatatactatttgagtcttgagagactgattattgactaattgttacatgtgtgacagctcaggcatttctcccgttctgctagacacatgcctgagctgaagaaaaaagaaagaaataattggaccttctcctgatagttagtagtaccatgcatgcatttaagcgctagctaatccgagtacaactcactgcatatatttataagtataacaaccaatattagtcattgccacacataggatgtttaatactctctccgtactttaacgtatgacgtcgttgactttttttatcaacgtttgaccattcgttttatttaaaatttttgtaaaaatataaaaatatttatgtcatgcttaaagaacatttgatgatgaatcaagtcacaataaaataaatgataattacataaattttttgaataagacgaatagtcaaacgttggacgaaaagtctacggcgtcatacattaaaatatgaaggtagtagttagattaagctaagtctttttaaaacaaagaatattttaatgagtagtaaaccaaataattggctgaatcgatcgctaagatatgaccaagttgtaggatcgcacagcaagaatcgagcccaaacagacatgggataacggttgtagtaacaaaaaaaccaaaacttttagcaaaattaaaagttatccttgtagctgatggagatcggtctgaccggagtatatacaccaatctgaccaatcgaagacctccggcctaactggtgttgaagctctagtctgatcgcctaccgcgccgccaacacctgtcatcgccgccggtccaatcgccatggtgtcactggtcttatcgccggtatgatcgtcaaacctgagcaaacacaaattgaagatctctcaaaagtaaattgaactttattacgtctattcgtgtttctaaagtgcaacaacatcactcctcccacaaaatttaattaaactcgaaacattaacttttctctaaactcaactatgtcaaaatcaatatcgggaggcctcaaccccctctctatttataaccaacttgtacaagaaattctaatccactatgaaaccttcacatgcaggacacaaactttacaaactccaattatattaaatttggactccttccaaattcgactccttatcccatacacacacaatctccctatcatatgccacaaataatttttatcaaccacgtacattgttctttagcctaagcatcctgcataatatcataatcgtccggacgtcattttcttccaagttgattcccgatccatcaccagcaacactctcctgaagcattaagactcagctgcacatgaatcaacaagaaactatattcgagcacaagttctctccaacttgactcaacattagtacacaatagtattatatacatataataaacatttagaagtcataaatataaattaatcatgaatatcaaataaataatccgaaactgaaaccgacacaaatttagccgatcagaccgtccgctcgcataactccggtctgaccggctccactcagccgaaaacttgttcatcaacaatcactattcacaatatttgtctaaccgatacacaaaacccgggttgatcgaaccacttttctaaataataaaatcaattatctcaaatactaattgttcgtcatgaaataataatgaaaagacactttgttcacacaagttggctgttaaacaaacagcatcatttgctcatcagtcatccccgtgaactagtaggtacaccggacggaagatgagtcagccattctattatcagatctgtcctcggaagtcggaatctttacttacaaaatattgaccgaccaggaccagcatctttggagacgacaccaacgcgagatcgccacgtcgtgccgatcagctcgatcgtgtgttttcctccgtccggctcgcatggccggcgtcgtcttcctcgtcctcttcgtggcggccgccgccatgccagcatcggtcaccgcagcgacatcacagaccgatgcgctgctggcgtggaaggccagcctgctgctgggcgacgcggccgcgctgtccggctggacgcgggccgcgccggtctgcacctggcgcggcgtggcctgcgacgccgccggccgcgtcacttcgctccggctccgggacgccggtctcagcggcggcctcgacacgctcgacttcgcggcgctcccggcgctgaccgagcttgacctcaacaggaacaacttcaccggtcccatcccggccagcatctcgcggctgcgctccctttctttgctcgatctcggcagcaactggttggatggctctataccgccgcagctcggcgacctctccggcctcgtcgagcttcgcctctacaacaacaacctcgtcggcgccatcccccaccagttaagccgtctccccaacattgtccatttcgatctgggagcaaactacctgaccgaccatgacttccgcaagttctcgccgatgcccaccgtcacgttcatgtcgctctacctcaactccttcaatggaagcttcccggagttcgtcctcaggagcggcagcatcacctacctcgacctgtcgcagaatgctctgttcgggccaataccggacatgctcccgaatctgaggttcctcaacctgtccttcaatgcgttctccggcccgattccggcgtcgcttgggaggttgacgaagctccaggacctgcgaatggccggcaacaatctcaccggcggcgtcccggagttcctcgggtcgatggcacagttgaggattcttgagctcggggacaaccagctcggcggtccaatcccgtcggttcttggccagctccagatgcttcagaggctcgacatcaagaacgctagccttgtttcaactttgccgcctcaactaggcaatcttaataatctcgcttatctggacctgtccttgaaccagttctccggtgggttgccgccgacgtttgcagggatgcgggcaatgcaggagttcggcctttccacgaccaatgtcactggtgagatcccaccggcgttgttcacgagctggcccgagctcatatccttcgaagtgcagaacaactcgttcaccggcaagattccatcggagctcggcaaggcgaggaaactggaaatcctttacctattcctgaacaaccttaacggttccatcccggcagagcttggcgagttggagaacctggtagagctggatttgtcggtgaactcgctcaccggaccgatccccagctcgctcggcaacctcaagcagctcataaagttggcgctattcttcaacaatctcaccggcgtaatcccgccggagattggcaacatgacggcgttgcaaagcttcgacgtcaacaccaacattctgcacggcgagctgccagccaccatcacggccctcaagaacctccaatacctcgccgtgttcgacaacttcatgagcggcaccatcccgccggacctcggcaagggcatagccttgcagcacgtgagcttcagcaacaacagtttctctggcgagctgccacggaacctctgcgacggcttcgcgctggagcacttcacggtgaactacaacaacttcaccggcacgctgccaccgtgcctgaagaactgcacggggctgttcagggttcggctagaggagaaccacttcaccggcgacatctcggaggccttcggcgtgcaccccagcctggagtacctggacatctccggcaacaagcttactggtgagctgtcctccgactggggacagtgtaccaacctcacgctcctgagcatggacggcaatcgcatatccggccgcattcctgaagcatttgggagcatgacaagattgcagattctcagcttggctggaaacaatctgacaggaggtattccacttgatttgggtcatctcaaccttttgttcaatctcaacctgagccataattccttttccgggcctatcccgacaagtttgggcaacaattctaagctacagaaaatagatatgtcaggaaacatgcttaatggcacgataccagttgctcttggcaagcttggtgctctgacatttcttgatttgagcaagaacaggttgtcagggaagataccaagggaacttggtaatctggttcagctgcagaccctacttgatttgagcagcaattttttatcgggttggatcccccaggcagccttctgcaaactgctctctcttcagattctgatcctgtcgaacaaccagctgactggaaaactgcccgactgcctatggtacttgcaaaatctgcagttcttggacctttccaacaatgcattctcaggtgaaatccctgcagcaaaggcaagctacagttgttcccttatatcgattcatctttccagcaatgacttcactggagtttttccatcagcgttagagggatgcaagaagttgatcaatttagatattgggaataacaatttttttggtgatattcctatttggattgggaaaggccttccatcattgaagattcttagccttaaatcaaacaacttcagtggtgaaattccatcagagttgtcacagctttctcaacttcaactgctagacatgaccaacaatggtttgacagggttgattcccagatcttttggtaaacttacttccatgaagaatccaaagcttatatctagtcgggaattattacaatggtcttttaatcatgatagaatcaatacaatctggaaggggaaggagcaaatatttgaaataaagacttatgcaatagatattcaattagtgacgggtatcagtttgtcaggtaactcattatcacaatgcatccctgatgaattaatgaacctccaaggccttcaatttctgaacttgtcaagaaactatctgtcacgcagcatacctgagaacattggtagtttgaaaaatcttgagtctcttgacctatcatcaaacgaactttcaggagccattcctccaagccttgccggtatatctacccttagcagtctgaatctctcgaataatcatctatcaggcaagatatccaccgggaatcaacttcaaaccctcactgacccatcaatctacagcaacaattctgggctatgtggccttccgttgaacatctcatgcacaaattatgcacttgcatcagacgagagatattgtagaacatgcgaggaccagtatctatcgtactttgtgatggctggagtggtttttgggtcttggctatggtttggaatgttattttcaattgggaacttaaggtatgccgttttctgctttgttgatgacattcagcgtaaggttatgcagaaggtgtcctgtattaatcaacttctttcaagagggaatactgcccaatatctgtagctgtgtttccttaaccttctgatgatgaagtatgtgcttcctttgtattaagagtaagaaaaatgtaattggaagggacctgaagaaacagagaacagctggtttaatgacaggtattgatttacaaagcatttcactttacattgaaaccccaaaatagctgacataccttcagggcctctggtttttaaacttgtcagggaataatctatcacgcatgtgttccagaaagaattggcaattactatatcttgggagtcccttgacttaattatgcattgagctttcaggtggcttctctttgagaacagcctgccatggacctacattggatgagaaatgaagaccatcaggaacttgataagttcttattttactctctgagttttggcattgttttcggattttggctttggtttggagctctacttctacttgagccattgacagtcttcagaataatttcagtacatgcatcaccagttaaagtaatagagtactatcctaagctttgcccctggagttaatctatctaacaatgcatttatgcatcttaactgtgaaattccaaccgttcccttcccggcggcgggggaacgggtgggcgggagtcgctccggcgagctacggtgatcttgccagtaaaaagagagggtaaaggagatttatcgcgggtagaagacgatggtcacctcaatttcggaccaaggaactcgggtgcgggcgaattctcgggatttggtggagccggtgaaagctagggtattcgccgcgtttgcgcccgggcgacggcggtggaggaggcgaagtgttgtgcggctcttgggcggaggcggccgtctcttttgctgttggcggcggcttgatcagttattcggtgagagagattgaggtggatgcggcagagctcctcgctcctcggcttggcttgctgccgctgcgaagctttggaggggggtctcatgcagcacaagctgctgctcacggtccagactgagctggcagggccacaagcgaggaagaaaagaggaagataaaggctgtgttttgattcaaaattttctcatcaaacttctaacttttccatcatattaaatatttgtacatatgtattaaacattaaatgtggatgaaaaaagaaccaattgcacagtttacatgtaaattgcgagacgaattttttaagcataattacaccatgatttgacaatgtgatgctacagtaaatatttgctaatgatggattaattaggcttaatagattcatctcgcagtttataggtggaatctataatttgttttattattagtctacgtttaatacttcaaatgtgcatccgtatataaaaaaaaaatttggcacacgaataaaagtcaattttggccttcctcgttctctctctcggtctttgatcgaatcgtctccctcaaccgcaaaatcgggtctaactgtttacgctcaaatttaacacgtaggttcaaattaaggaaatttgccaagatttaggaaagtcgccggtttcctctacagggccggtcaaattgcggcttgaaagccggtctaaccggcggtatgtggccggtcagaccggcagagtctaagcccgagtctattttcatcaggtctcgagtttccttactcaaaaatatatgtttcgagtttccattggtttctatcccaagttgacgtggaggaggatttgtagtaggcaagaccaacccctatttaaggggcaaggtcgattcgattaagaaaatctctctcccccaacaatctctacaattgaatcgttttcttttaccttttacttttcagctatgttttctactttaccctagtttagtctatctttatcggtttgcgccataaatcgtccgccgtcgctgcaagagtgcgattacccctttgtaggtttgtcccgcaaaccttttgttcgcccacgagacgggtagttatcatcgtatcgatcaaaatcggctccgctagccggtttagcttttctttctacaaaacccattttgaactagtttttgcttgattgaggtggttagcgactccatatcaccgcaatacttttaggtgtcccaatcatgtttttcttcttgccaaaaaaagtttccaacaataatgtctctctatcttcaaaatccggtgtaaatcaactccttcggtggtttaaaaagtagtttatgttgatgtggcaatttaggctggtcagcggatggaacatgagaggacgccgtctgcgccggtgaggaaggtctgagaatagattaagtaaggtggctcccgccgctggaagggtgagagggaagagggaaggagagaaagaagggagaggtgaagaagaggatgagatgagcaggaagtcatttacatatggttctcgcttgctgatttagttagttaaccatggttaaactgtcatttcagcataaaccacttctaaaacctcaaaaggaggttatttcgaagttaggaaagattttatacccggttttacgatgatggagccaaaatagacttatattctgcaaaagaattaaggggcgaacccgtcttgggagcattgtcctcatacctctggtctagtgtgacatggggtgtggtggtgtgatgtgattagttttggcgtgtcacatcaggtattatatatggtgtcgtatagggtgttcgagcactaataaaaaaactaattacagaatccgtctgtaaaccacgagacaaatttattaatcctaattaatccatcattagcaaatatttactgtagcacaacattggcaaatcatggagcaattaggcttaaaagattcatctcgtaaattagtcacaatatatgtaattagttattttttagcctatatttaatacttcatgcatgttttcaaatgtttgatgtgacaggatgaaaaattttagggtgggatctaaacagggtcgtagccatttttgaaagaaaaaaaacaaatactccctccgtttcgaaatgtttgacgccgttgactttttagcacatgttt

SEQ ID NO: 58412 - DNA, 13782 bp, Oryza sativa
ttttaaaaaccatggcagatgaaattactcagatactatatctcttcttgcaacagaacatctctctttctgatacggtgaccacatagcataatccagctaaaacttattctgatactttgcaactgaatcatcaaccttgagcaactgggcagaacccatgcataattgcagcagaccaaactttgtccatatcaagcaccttgtcaccacattcatgctcattccatccctccaacgcatgaagaattcccgcgattcgccatgcgctcataaccctccttggcagccaattctgtcaaaaaaaaagttcaaaaattttgtgattagatcatgtgaagttcgtctgaatctctggattatttcaacaggttattactactacctcgcatgaatgcacattctgcagcgtttttggtacagccattgcaggagttgtcgagtagctgcagctgtccttgcgtaccatctttggaggaaattgtgagtatgggataaacagagttcctttctgtgctctgaattgttcagcagaatctagaccatcaccaattaaccaaacctgaaaatttttggtttattaggcaatgatatttctcttatacattctattcatttgtccagagaatgtaggaaaaatgaggaaatctattcttacctttgcggtgcctgttttcgaaaacgaaagattgtcagctacagtttctggtatttctggcttgagtaaatgataatcttgcttgtttgtcatcgtgacctgtacaagaatagtggtttgttacaacatggtatccttttgcatgctataaaataaatcagaggtgagtagtggattaattactttgatatttttcttgcataatgcttgcgctacagcacgcgccaccttggaaacatttcctgcaagaattacttggtctgtgccttgggggatactgttgacaaccactgcagcagctaagctggttccatcgacaattcttgctcccaactttgggtatttcagcagatattgttctccacttttattcagggtatgtgccttatattgaagatattgtatgtcaattaccagttcaaccatgcatgagtacatacttccctaatttctacatattgtattctcatgaaatgtacagaatttattagttctgttggactactgtcaacggactctttgctacttaatttttttattttcctacctttatgactaaaccttttccctgaagataaacaattattaagcactaactgttttatcttgactaaaatttggcagtacatgtggacatatagctaacatctgaattctgaagtatggatgataatgtttcaacttgctctgaattcattaggaaatgagctacctgattcaggagtccaaggcttacaactttagccccattcttgtcagcttcacataccgccttttcgataagatcattgatagcttccttctcccaatccaatccatactgcacaaaacaaaatgtttctaacctgattatcaatttatcatgcacaccatctgtgaatcatgcactgaacatggttactcttacatggaaactgtatcttggtatggcccatgactgcatcctgatcttcttcatgacattcctctcaacagtgaatgaagaaccgtacgtccatgtcagcaccatggagagccatgacagaggccacatcatcctcatgtaccacctggaaacgtagggcctggacgcaaattcggcgaaaccgggcctcatgtggtagatggaatgcagggtggtcaggtgtgtaaggtgaaccacatccactgcttcttcttcctcattgtttttcagtgagttctcatacagagtgtctgatgacttgtccatggtgttgtagatataatcgtagaacggcatgaaaagggagtagtttgtccgaaactgagtgtggtgcagagaatgaaacctaatatatcacataagttcagattattataacagtgaaaacagcatgtatgatcaagttatttattttgcagagtgacatgcacatcatcttcttttatttggctttttcaataactatagaccatgtgcatcctagctatgcagatatcaggagtggttttagagtatattgtatccaagatcaataaagcctcctttatcttaaaagaaatactgaaaaccgtaaaatttctccaatataaaatatggtacttcccctatgctttcttaaaaactgtaaagttactcttttacatactccctccatcccaaaatatttgatgccattgacttttttaaaaatatttgaccgttcgtcttattcaaaaatttaaataattattaattctttttctatcatttgatttattgttaaatatacttttatgtatacatatagttttacacatttcacaaaagtttttgaataagacgaacggtcaaacatgtttaaaaaagtcaacggcgtcaaacatttaaggaagaaggaagtattattaagagcctgatgaagtacttacgatggcgtgtacatgagatacttgagaggagggaaccatgtgaagagccagctgggtaccaactcgaagttgcagtgccccatgttgttcatgaaatcaatgtaaatcaaatacatctcgaatgcaattatggaagcagttccagtcaaggcacaggcgatcagtgggatcgagaagagcaattcgtaggcaacgagctcagcaaacggatggatgacggctgcaacaacgttaggaattgtaggtaatgaacatatatgcatttaggtatatgtatctgcttgctcaattacaaatactgcagtctgcagggttctcttcttctgcagtgtaaccagtagacactattggtttttttttaacagtacttaaagaaaacaccataatcttaaagggattttatggttatcaagaatcactgaatatatcgtgttctctaatgtaaaatttagtactaatacaagtagtgcattattttacatttgaaaagcgatttctcccattacacatccattcaaatcactttaaagtcaatttatggtaccgtcttgtacatcttaaaattacaagatgacaccaaaatctttactactattaaaagatagtagtggtggtagtgaatctgccatcaccacaatcactgataaggggcggacccagaaataggccaaggcctaggccgccccatggaaattttggcccaacacaaagttacatggttgaaaggaggaaaaatagacttattcctagtaaaaatgcatatttctcatcgggcctttcatctcaggccctgggccgtggaccagtttgcccagggcctgggtcactgatatatgggccatggtattaaggtttgggagagtcgcctgtactatatatactgtactatactttagctctttaattttctaagcatggcatttttgtttgtttctttaagatgaaaagttgtgtttcaaccatttttttttaaaaaaaatttaacaaggacttaattttgctatttttaataatccgttgcaagttgcaacgcactgatatttggctagcttacacgaaaaatatagtacttctcgatacctctcaataaaaaaaactcttccactcaaaaaaaagggggaaaaaaccccttagaatgtgatttctctcttgtctaaaagtctctgatacgttgttcatggaccacgtttgcttctccgtttggtcaggcattcagcaacggattcgatgggctacataaatttagctcgcgatcgatcggtcggcttacttcgatctcaatggtccatgaaatatcgtgtgtcctttgcattccttaactcacacactctctaggcctacaattattgttcaggcatgcattgaaggaggagggaattgaagtagcgatcgactggccacaggaacactctgtgtttcctgaggaacggacacgcgcgacacttgcatctgacgaagtacacctcctgttttgtgtccttatggaaaagacttgttttttactttgttctattggaagattaccgtggtttaatttatcccaaggttacaggtctagtaatatttctgtctcaaaattttaagaatttgtattaccaaaatcttaatattcatttagaggtttgggacgaaagtaatatcatgtaataggttgtttggagcaatgatggtacaactaggtagtacaacttacttcctctatttcaaattacttgtaactattagtattgattgaactttgatcattgataactttagatgatgaataaaaattttgtaaaaatatttatgacgcaacacaattcgatactaatatagaagctcaaaggttattgcctaaaagagaatgtaatgtttggagcctcgaggataaaccgtctctagtggcaattaattacgtacatgtgatgggctcagtgacgattgaagagtggtggtgcgagtggtagtgggtgtagagaaagtggtggtgcaacgcacgatggaaccagtagtagaggaactccactggccccgcatgcagcaaggcgatcagccccgcgccatccgtcctccacagcggtaagtgttgcccgcccggtacgtacagtgcgccgaggtatagtaggataccgctcaggatgatctggtcgtccctgcacgcacaccaccatacacgtaacaacacatcaactataatgaggttgaattaattaatctcgaaggtgaagctagccgccacgaacacaccgcgtgggttgtacgtaattttatggtgtttggcataccagttcctctcgcggtcaacctggtcgaactcgatgccgcggcgaacaatctggcggcggccacgggcgttttggaggcgggagatggtgatccaggcttggttgtgcagcatccgcagcagcaacgacgggaggatggcgatgtacccgagatccacctcccgccaccccttggtcgccacctcataccacccgtgcgctacccacggcgccagcaacacgtactgcatatgcacacatatacatgcatgaatccatccatcgaattaactcacatgtgctataatttatagctgaagttactgttgtaatttgtaaaggtcggaagttgtgtatactgaatgtttttgcctaatcaaagacgatgtggcaaaagcttatttaaccatgtactctttaacagtttatttgctgcacagaggtgctgcaggaaagttcatgcccctgcattactgatctgcagcagatgcaagagaattaatctcatgcactgctagctgcacatgcggcaatgtatgctttgatatcaaacagaagctagcgaactcaaacaagaacataatggtcatggtgcagtgctgccatggatggaactagaagctgtgcgtttatttgctcgatcgagctgccagaagacagtgaagtaactgaattaaggagaagaagatggaaggttaattttgattaccttgaagctgccaagcttcttccatggccactccgtgaagagtcctgggtttgtggccatggtagacgatctatgggtgcagaatcttcttgcagcctctggctagctagctctcgtttctgcagtctcaacacggcaagagtcttgcaagaactggcctgagaatggaggacggatatatctcaatttataaactcgaccagggcttcgatctagctgtgcgtacgtgtcagagtctcatatactactcttacatagtgctcccccatcttaaaatataaggaattttagttgaatatagcacatcatagtactttaaatccggatttaagtttttttagaacggatagagtagatgagaagtatgttcagatttcgttgcactgtaatatatcccatcaaactaaatttgctttttttttttttacggaaggagtaccagagagaatgccagtaacttctgaataattctaccttcaaaataaatattcttgcattgattggggttgctcgaagggaagatatcggtcctttatgaatcatgtgcgtcagaaataggtaactagggtcaggtttgtgatagatgcagcagacggcatgaatgtaccaaaaacaaacgagttactgctaagctaaccttcctgtattatttttttattattatttgtaacataattaactgcaaataataaatatatatatataatcgaattccatcatgaaaatgttgtttttctttttcctaccaaagcatttcaacattgatacgatcattatgtatttttaggtaattctttacgggaggaggacgggttattaattccattttgatactgaacaaaatgatagtacaagtttcggcgttaaaccggtgttcgacgaggggtttaaagctatgatcgatcgtctaaaacttaatagatagatttttatcaggtttgggtctttctgaagataatagctctagtgacccggctatattttcttatgtggattattgatttgaatacaaagaggagagcttaagggaacacaatcttctccatctgttcgggcagtctgtgtctttgagaagagtaaaaaagggaaattaagaataaaagaaaaagagatgagtcattaatgtatgattaattattaattattttaaactttaaaaagtagattaatatgatttttaaaacattcttataaaattttaaaatatatatgtatatatgtatactgtttagtagtttttttaacgaatcggcaagctgccaatttcattgaatagagaaggagtaaactttacaagtaagaaaaacaaggctcaggaccttcggtccaaatgagctaaaattataaagcaagccagctaccaagatgcctcgcccctgcccgagaccatgttttggcctcctctttaattttagccaacagacttccggtagatagctctttgtgctggaaacctcgcccctgcccgagaccatgttttggcctcctctttaattttagccaacagacttccggtagatagctctttgtgctggaaaattctacagtttctctcgttctagatttcccagttgaccaggagtgttaacgtgtggagtgctttctttggggctttcttcaagttagcggtggcctctctgtttagcagtttgaaaagtgtgcacgtgaaaatcgagggacttttgtgcctttttgtttttcaaacgaacgctcagttcgggaagtcagattcctacccaaaaccacttttgaagtctatgtatttcttgattctttattattattattattattattattattattattattattattattattattattattattattattattattattattattattattacacacgcacaccctacccctatgagcacctccgtaagactgggccggcatgtcttgagattgacgaagtcaccataggtgcctcgctgtcgacgagtacgtcgtctaccactgaaaaaataattagccgtaaatgcgagcacccgtgtcaactctaggatttgaacccgggtgggctggttccaccacaagtaacctaaccagttgagctatgctcacttcgcattttttattttttattttgctagctgttttaatcatatatacacatttattgacacagattgtttccagagtacataataaaaaaaaatagaactacggctcgagaacgccggaatgtcaaccagaacattcagaatggaattgatgacaaagtatggtgaccacgttcgcatgaatgttatgtcatatccattaatttgaataagttattcttttcactacttgcgtattctttcattctaaaataaacaaatctaaataatacaggataatatatatctcggtatagatttacagtatcaaaatatgttatatgccgtacagtattacgatataatatatacctcggtactgtttatgatatttaacccaaatcaaatctatcgacaagttctcattcaacataaatttgtccatatattccgcagcaaagcaaataactttatctagctagcttttaataactttgtaagccacgatctgtacacttgtaagccacaatgcaagtacggttcagctcacctgcaaagctgagcgaaattaattaaggtgaagcctgaacattgttacgagtgacggtgacaatgcgcaagaacatggccagttccgtgtatacactgcacactgtacgtttcttttcgttgcacacacaattaatcgtcgtcagccacgctttaatttgttcaaccagatttggttgcaagtattggttcggtaataatcagatcgacatatagagtatacatgcaccacgcgtgcattctatcactaattaattgactatattttttttagataatggattttcattaataatccagcctctatatccacgaaggatatacacagccaaaaagatacaagagcacttagactcagatctcaatagagagaacacaaaaccaaaagaaaaagaaaaaacaactaccggcacatccttgctttccgacatcctctcctaaatcagcgagattcggagtggaagtcgtctagtcgtcaacgcccctagtgcgtcgtcgccgcgagcctccgctgatgccatcttcattcgcttcagatgagttgatgtcatacgtcccggtttagcccaccttcatccgtcgttgcccagcctaaacaagccaaccaaatgcaggccgacagatccatttccgcttcactgaattcctaggcctctgccgcccctagggccgtcaccatcttcgggatcctcctcccctcctggattcccagctcgtcaccgccccaagggccgtcgtcggagacctctggaaccgctgtcgaggaaaatcaatctcttccaccggactcccaggcatctgccgcccctagggcagccaccgtcaacgggatccgcctcctcactgcgaaccttgaactggcactcaggctgccaccgtctcggttggacgctgcccctagggccgccgccgccgccggagaagccttctgcccggactcccaggcgattctgccatacgctgttgcgaaagataccacctccacccaatcccgctatctccttgccaaggatacaccggcgacacttaggccaccgccgtccgaagggacgccgccgtcgactccagaacacctcagctcccgcacttaacaatcacatggctagatctctgtcctccgtcgccaacttcaccaccgcgccgaaggggacaggccacgcgcagaggaaacatatatatatatatattgttctagttcttttaaattaaatacttttaaagttattgatagtcaaaattataaaaaattataaaagtttgactacaatcttgtccaaaacgtcaagaattataaaattagtgggagtacacgttaagtttataatagtaactttcatatgctgactcgtggcattaatttcgcgtgccagaatcagctaaagcctcaacctagctcacattcaatcgagccttaatgtttgcggtgtatgtatacaacaaccttaaagctagcatctattactatgattttaattattttttgttttaatacgaagaaactgtagtacatggatttttcgtttctacagtgctcatatgaaaccgttacaatattaccataagataaaattgtgacagtatatataattagttaaactatatatctcaacaatttgattagctgtaaacttgtatcgataagaatcctttgtatacagtgagattgacaacgtgtgatgagatccatattgtctcctagagttgtgtaatcttctgctcctaccccagtgtgaatcgttaaaaaatactccctccgcccaaaaaaataaaccctgggtttctatgtccaacatttgaccgtccgtcttatttaaaaaaattatgaaaaaaattaaaaagataagtcacgcataaagtattaatcatgttttatcatctaacaacaatgaaaatactaattataaaaaaatttcatataaaacagacggtgaaatgttggacacggaaatttagtgtttgtttttttagacggagagagtaattacttgtataccgtcagatattcaggttgtcagacgactaagtacgacagtgcatttggttagtggttggtaccggtacgcggtacagtgcaacttttgttctgtcacacacttggctggttgggttttaatttctacttctcttgctgattaattggcacatgtacggcatacactacagtgctcaaagcaaaaattaaaagaaaataaagaaaaaaacaaatggcacggcacgtattttagagggagagtgttttgcaagcagcttctcgttgcatgctattcaaataactaagattttttttagaaaaaaatgtctcagtttatattattacctgttattgtactagacaaaccatgcatgtgcgcaagagtaaaaaattgatctaacacgtggagaatatatatcagatatgcatttggatttatttttgttttcctccttgtttttggtgaatttatggaacgatatgatggatatgcaattgtaatatactacatcgctatttttttctttaaaaaagttataattatttagataattgacgaaggatatgcacatttaaactataaaatggctttccgacggaagcatatttgaaaagcatatatagatacaataaaattgttggtgtcatccaagatatatctaatcgatatatagtgtactatatagttggcattcagatccttaatttggatttactacaaggagctgtatatgtagtgggttggatcgagttggttaaatcttgtatccataaatatatatagctgtgtttcagttttagttggtatagttatttgtataaaaagcagccagccttttgggatgggatattttcccttccgttttatattataagctctgacttttttgacttattaagtttgatcattttttttaaaaaaaatatactccctccgtttctaaatagttgacaccgttgactttttagcacatgtttaaccgttcgtcttattcaaaaacttttgtgaaatatgtaaaactatatgtatgcatataagtatatttaacaatgaatcaaatgataggaaaagaattaataattacttaaattttttgagtaagacgaacggttaaacataattaaaaaagtcaacggcgtcaaatatttagaaacgaagggagtatatagcaacatctagaatatcgaatgagttatattaaatataatattgaatatatcttgatagcgcgtcttttttaatgttagtttgtttctaaaaacttagttaaatttaaagaagtttgttttagaaaaatagttaatgccaattataatatgaaatgtagtaaataggaaattaactaagaatatgagtttaggttgggttcagaaggatgatccggtggtgcaatggggtgcaggggtaaaattaataagatgtcgtgaagtcatagaacagagacgatgagaatgggtcgaattatcatgtttctcgtggcagacgtctgaatatgccaacgatatatttcctcttatctcaaaatataataatttagaatcgaattaggcacattctaatttaggatcgattagacacatcctattatgattaatccgaatagaaggtttatccatcgtaatattagaatgtgtttaatctgatattaggttgctatactccctatgagttgataatactttttttttacaaagtcacagcctcagaaaataattttggtaactattttctattacaatatatatagaattatcaacaaattacgatattgaagtattatggtttatattttatatttctaagacaagtattttagaaactattaataatcaaagattttaaagtttaacatcaaccttattcacaataataagtattgttaatttggaggacgtatattttaagatagagcagagttatgtacttactaggcgtgaccgtgtgagctagattggacatactccctccattatatccgttatatttcaagtgcaatcatgagttttcgtgtctaattttgatcgtccgtcttatttaaatttttttttataattagtatatttgttgttataagatgataaaacattaatagtattttactcgtgacttgtgtttttaattttttttttaaaaaaaataaataagacggacgatcaaagttgagcacggaaaattacagctgcagttaaaatgggaccgagggaccaaagagtacagcgattcgctgtgagattggacaaagaacacatgcacgcgtgtaattaattagcctggaactctggacatggaatacatgcatgcatgtccggtcgtcatgggcgtcaacgactcataaatatcgacctcaatttgatcataatgatcagtagcagcaactccgcatgctatgcagcaatgcagctcaaaaaccgttggcaccttttattatagggctcctataatccaaagaatttcaaaggaaatttgaagcatttcaattcaatcctgatgatttttctttcatattgcgttcgcgaaataaaaagatatttctttcatattagcttatttggaacaaaggaatacgattgggaaaaatcaaccaaatttgaaatgaaaaaaaaaatgctagttcttgtgttttgaaaatcatgtgtcaaataagccctatgttacatgtgtattttagggtagataggagcagatctatactatttgaggggtgctcacgattggcggagccaccgcccggtgaccccgggctcgtcgcagcgaacacctgtaaaatttgttatattatggaatcgaacacaaaattttcatagcaaatagttgctgtggttagtgttggcaacttattgtgacaagttggcaagcacgattgcaggacctaacgctttgcggtgatcttagagtcgccaaccaccccaatctaacaaaagctaaatcaatataggattttaataaactaaaccggctagcggagccgatctagatgaaactatggataactacccatctcgcgagcaaaacggaaggttttcaggacaaaactacaaagaggtgtcgcactctcgcagcggcggcggacgatttacggcgcaaatcgacaaagatggacaaactgaactagaactagaagtaaaagtaaaataatgattcgattgattgataattggttgattttttacaatgaaccagccttaccctcttatatatgggttagtcttgccctctataggtactcctccacgtactattcgggatagaatccaaaagaaacccgaaacatgccttcccgagcaaggaaacctcgagacccggtgaaacagtcctgaacatggactctgccggtcagaccggccacacaccaccggtctgaccggtccactgttggcggtctggccggatagtacatggcggtcagatcggccctctcagaggaaaaccggcagatcgtccaaactttggcaatttccctattttaattctaggtgctaaaattgggtgtaaacagttagctagattaattgttctggctttgaaaactttctagctctaccaggaatccaaccaagaattttttttcaagatataatttatctatttttatcatatgtgcaccactcaggtccgtttagttccccaaatttttttcccaaaaacatcacattgaatctttggacacatgtatgaagcattaaatatagataaatgaaaaaactaattgcacaattaggggagaaaatcgcgagac

SEQ ID NO: 58413 - DNA, 4589 bp, Oryza sativa
ttgttgatcctctggcgacggaagcgttgaaaagcgcgatcattggctcgctttgtcgtccctttgcagattgtctgatgagcactaaggtggagagcaactcttttggctctgctctttgtgtcgccgcgcttgtgcaatccaacaactggcggtttgcgtctaacgagctggttaatgatgtctgcttgaaagtctcaagggccctagaggaggcgcatgctcagagtatcgcgcacttaaacttggtggttgttttgctgacacaaaatccactgatgcttgagccttatggccgatctttgattcgatcgggcttacagatactggatgagagtgctaaggcaagcagttctcagatgattatttcatcgattcaaatgatacattccatcatgaagggtttggatctaggcattatatcttctgagatcagtagtattatccatgctatggaacaattccaggacgacactatgccagccatcagcattgcagctttcgaggcatctgagactgctaagctacttgttggcaggcaaaaagagagtgggcatgacaataatttgagtcagttagcaaactattctgtaagaaatggcagaaagggttcatattcacattctctcatggatgatgcggatatcagagacgatggttcatgtgattcacattcttgtgacctgaactctgttcatttgtctactgattttgattctcaacattcagtgggacaatgtggttctggaagcacacgtgcaaggcggcagctatggtgtaacaaatctgacaaatcacatggaatgtccaatcatgacttatttcgcactgttattccagatagtcatgaggcttcaggtttgatggcacatttcagctctgttgatccaattaagccagacaggaggttgtcagatgtgccaacaagagttgctggcccatgttatgtctgttcagcagcgcatgaaacgaatcactgctctcaggtatgcggcagaaactcatagcagctttgatctacttaaaatgtcaaatgtgttgtatgattaaatacttgcttttctttaacatattatttccattccttagccccaaatagcatgaacatattttgatgtcactttcatataccatccacatatatgttaattgtttggatatgcattttcattagcgtgctgaagatttgtctttcagtggtttatatttgacatgattttgggttgaagacataacttccttagaattaaatgaatttacatctctctcactttgtctcatgttttatttcagatatccagggcacaggttttatcaggtgacatgaggatgaattctactccaagaaagcaactccattcttgcaccttctgtagagacccagaacaagatggtcacccaccacttgaaagtccagctatacaacactgctcagggccaggtactaatattcttcagttcagaaaaaacagtgagcttaaggaaagaaaagaattttgggactcaattcggcaggaaaatcaatgccatatgcaaaacactgatgccctaatagaagatttgaagttcccggctgacgatgatgatgaggattttgatggtgcagccaaatctccatgtcaagaatgtcaagctgtgaatgagaagaagactggaggcaagaaaagaaatgcaaaccgttctcactatccagtttttcttttcgtttttgttgtggcaatcattgctctcttctttccttggtggaaggactacaaagagccttatgttgttcctacataaacatatctgtttgttttgcgatgtgcatcaagccatccgttttttcaggaattgtatggtggcaatctttagtatacagaaattataggcagcagtttacatggatgactttgaatggtgtaaattctgtgataaggtgatggaatggttaaaaagttgtaccatttctggatgtacttttctcttatgtggtcataaaaatccttagtgttatgtatcagcatggaagttgaagttctctgctatgataagaagtttcagtactacaaggcagcacgttcttggtatcatgggtaccaggttttttatcttccgctgcaaacgttggttttctcaatttaaaccggccgtttgaaacccttgttctctgtaatcggtgattcaaacaatcaacatggttagcatcttgtgtgagttaagattgtggcattacaggacagcatgcatgtgtaactagttgctgggactagatactctgttacattgaatttctttcttgtttatttcaaaatgcagataaaactctccattgtatccattgtattaatggttgtcaaaactcaaaaaggatattatacaacttacattcttacaagcatatgactgaactttgagaaactataaataagggactgtttagatctcacccaaaaattttacaccctgtcatatcaaaagtttaaacacctgataagtattaaatataggctaaaaaaataagtaatttcacagattgtgactaatttgcgacgaattttttaagcctaattgctacatgattcgacaatgtggtgttacagtaaacatttgctaatgacggattaattaggtttaataaattcgtctcgaggcttactgacggctaatgacggattaattaggcttaataaattcgtctcgaggcttactgacggattctgtaattattttttattagtgtccgaacaccccatacagcaccctatataatattcgatgtgacacgccaaaactttacacccctgtatataaacaccccctaaagcactgtagaatgctacacttcactgaaaggaaagcactgtttgattagcattctgaatgttagttttcttttttccttgatctgaatcgcaatatatattgtagattgcattgcagttttttgcttatatatggcttcgtctacatccagaaggccacaggagagaaccatgagaaatgcttgggcactcggaacgacccggcggcgcggcgagccgtcgccttcagttctccccgccggttgtacttgagcccaaacacggcgacatggacctcacattgcggcggcgtgaccacgccgccgccgtcgtcgccgtcgcattccacgcagtcgacgacgcagaacttgctgtcgcccatgtaggtgagcgtggcgcgtcgacggccgccggggcggcggcggctcttcttccacgacggcaccacgtcgtcatcgtccatggtgtcccactccggcggccgcgcgccgccgcgggacgggacctggcaggcgcagatggtgtccccgtggcgcgggaggccgacccaggcgtcgagctcggcgtcgaagaagccctggccatggaacggcaggagccagccaccgtgccgcctccactcgccgcgcttggtgtccaccgtgtacgtgccgccgccgccgtcgccggaggtggagacgaagacggtgtggccgtcggggtgcaccgcgtaggcggcgacggcctcctcgaccggcggcggcggcggcgccacgggcgcgttctttcacgaccagccgccgcccgtcgacagcacctcgaaggcgcgagggaagcgctcgccgagagacgtgagcgcgtacagcctctcgccgccgggcatggcgatggccatcccgccggcgaggaggccggggagcggcgactcgaccgtcagcgcggccgcgcccgtgtcgtacaccagcgtcggcgccgcgtcggacaccatgtcgacactgtcgccgcacatggggaagaaccgcgcgtcgcacgacgacctcggcgccgcgaaccggacggctggaccgccgccgccgccgtggataaccccggcgtcgtcgaggtcgacgtcgagcttgtggatgctgtagcctctgtcccagtcgtcgagcaccaggtagagatgcttctgctgcggcggcgccggcggccgcggcctcttgtcgtggtgatgtcgccggtaggcctcgccgccgtcgtcgtcgtcgtcgtcccgccgccgcctaggcatcccgagcgatcggtgtttgggcgcgagctagatggatggtttgatccactttgattacacgtgcattgcatatatatagccgaggtagttatggcggttgtagtgtccgaatccgattcgaacatgggttacatggggtgagaaaccgactccgactcgacctacaggagaaacggagtcggacgcgctgtgtgacgccgttgtttcggacaaactttctccaagttcaggaatgctgggaggcgacagcaaatcgagtgtttgattttaacctttttttttctttaaaatttgggcgatgttttaccgctacctgaaaaatgtttcatgtattgaaacgtactattattttcacatatggaacattaaccaattacaagattcttaaacaaaaatatgaaacaccatcgaagtatcaaggacaacgtttcaatccaacccaagaaagatgcattttctgaaacattaaaaactcataaaaatgtactagtacaaatttgatttcttcctcctatccgcctatctggtgggctcctatggtttctgctgcaaatcca

SEQ ID NO: 58414 - DNA, 1822 bp, Oryza sativa
cctacccgcatttattgcgggttgaacgagcgcgtcacgccgcatgtaatgcagcgcagcgcgctcgcttatccggtccgtgaccgggcgcagcgtgtgaccggtcatagaccggtcagatcgcgggttaggtggtggcaggtggcctgttacacgcctcgccccgtcccgtcggattgatgagagcctccaggcacttgtccctagccggaggcggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcataggcagacaaccgcgctcccgttttgcacctccttccagcggagtggaggtaggtatgacccatcccatcggagggtcattcggacagcagccattgcaaatctctgcccatttatgaagggatgacaaggtgatctccgggagcagacgagtgaggacgcctggccacactgaagaacaagctgtgttttagcttccaagagaaggtgagccaagttttggtgaagatagggtgggtccccacccaaaagaaaagtaggtagaagtggagcatgtgggatccccttgagttataaaaggatgaccttgcccaccgaaaagaggaggaaggagaagaaagggaaaaagaaaaggaaggagaagagaaggaaaaagaggggttctagagcctgagctctctagctcttctactctctgtaattccttcacactcagatccaccagaacacaggagtagggtattacgcttctcagcggcccgaacctgtctacatcgcccgtgtcttgcgtgtttgctctctcgtgtacattccacagatcaagggcttagagcctcactcagcgcccccggccgaaccggcaaaggggggcctgtgcggtctcctggtgaggagccccacgctccgtcagcatcctataggcttatacccatatggatgctcaacgacttcccaagtaccattagacataattgagtccatctcactgcgtaccgcttccttacaatagtcactgttaggagatgaatatgcctcttcaatggttcttggagtgacatccacaaggtatacaatgtagtcatctccaaaggattttgcaaccctttgtctcttactcttacgagtatctacaatgttatcctcctcaggattttcctctggcgtttgatcattgtgttcttgttgacggtcattatcgatcagtcttgaccgtcaatattaccaaaatagaggagaactagtgatgctttcaatgcatatatatatatatatatatatatatatatatataatattccactagtattaggtttgctaacctttttgcagagaatgacaataaagtggaggagaatcgacatcaacatagatgataaatcaatcggacgatatcaagaatcagacttatgtatgaatgggccaagaactcagaattgacacgatgaattgggccaaaattcacaagtctacgaagagaagcaacagaggaggccgccagccaaaattgggttggattgggccggccctaggttcggtgaaccagggggttcagccgaaccctccttagtgccgttggatccaggttttggctggacggcgtggatcactccacaatgacggttggagggcaattccgaccattccaactaccacaaccgtcattggcagcctatttaaggagttcctctcctcacttcactcacacacctcaa

SEQ ID NO: 58415 - DNA, 643 bp, Oryza sativa
ctaaaacctgttttccggtggggttgggtgcatgccagttgtggaaagtaccacccgggcaaataaaaggattaagctcaggcctctgttgcaaagcactaccgtactaaccacatgtctaatgggtaaggcttaactcggtgctcagtctagtcctgaacaaaaggatacagatagagatggatgaagtcgttgcgatgatggatatctctgaggcaaatgaaggctacgcgagctgcggctcggtaatcgagatgtctaggcaaattaaggctacacgggccggtgtccgttagtcgagatgtcatggcacgggactagtacgtgggtggtctcacccctatgtgtgttgtcacatcctgatttttgtttcaggatttataaattatttaataaattattattagaatttatattaaatgttctttaattttcaagtgaagttaaatgtgggaaataaaatttcctaaatttaaagcatggatggatttaatttttattaaattctccatgattaattacactctctgaaattttctcggatttttcggagctcaattcctaaatgatacaaagaacagttcagtaattagttaatcaattaatgatctaattataattgttaagagcttttcttgtttaa

SEQ ID NO: 58416 - DNA, 12567 bp, Oryza sativa
atctggaccttgaagattcaacatggatgacatatcagacatattttcctcttcctctaaatctgcatcaatcactataggaggaatgtcatccagagtcgcctctgagtcagaacttgaatattcagaaccactcattggagctacgccctttgaagcgttattactcatagagagagagagagagagagagaggaaagtagtataaaggggatagccttaaacaacttgtcaaatatataatactaacacaaaagggtccaaaatagatgttgtcgtgtgtgaatacgtcctggttgccctgaacatttacagctcatgcttccaactggaattggtggcatactgtagtaatgacaaaataaagtgtatcgctttaactgatacatatcttcctccatacaaggattcaacatttaatgcgatatatatttcttcaatatatgggcgtatcatttaattctacatatatacatctttcatttgcacaatttaattctacctatattttgcttcttatttgaagataccatttaatgtgatacttttttaacagatacacatatcttcctctgtagcacaaggctggatcattaaaatttaatgtgacagatattttgatccatttatggctgtgtcatttaatacaatacattttttcttccttgtatgggtgcaccaattatttgtgacaaatattttgttcgtatattcacatatcattcaatacgatacgcattttttttcttacaaggatgtaccttcaagaaatacatgctttcttcctcgtctggttctgctgtttgttgcaatacacgtcctctaacagatgcctgtatttacaaagacatttgtcccaccaactagagggaaaaaacaacgtacctcatgacaagcatgcatctgtggtccacatgcataattacaatattataattctttatatctttgcccttttttggatgtccttccattttcttattttgaatgtacatctacataaggatagtgtgaataatccagagtagtaacattctccaatgctttattagctatgtaccaaatgaatggcacacctaggaatgtgttccaagctgtataattttttggatgaatgtacaccgcaagtaataggaaaactttgaagcactttgtttttcttttctattttagcagaacaattggcttttctaagaagcaaccaataaattggttagccccaccttaccatggtcaccttcgcatccaaataggtcatggttgtagcatgttacacatagggtttaattactggtagttaccacgaaaactaggcttaccatcgagctttagtagcggaaacgaccagtaaggtttggcaaaatttatttaaattcatttctttttccaaagagaggaaattaaaaataaaatcatataagtagtatagtgctatctggtgaaacatttatgaaatatatgaagttaactttatattttgtacccaacccaagttgaaaataaaaaaaagaaaaataagcaaatgggctaggctaatagtgagtgctattcacaaaacctatcttagagagccgatcgtgatttctactatgtttcagtttccaaaatacaaaaatggtcacacgaaattgcatgcttgattgctttattcttttacatcttctgaatttgccctactttttctagaattatctatgatttacctgaatttttgaaactttttctcacttttcgggtttcccaagaataatgtttgtccccctgagtttgaatttttgaattcaattttttttaatatgaattttatcagggttatggataccacatacctaatagtagttgactaaatctcggcaggacccaccacatactatgtcttatacggaaacaatcttcggatataggaggagttccgcacaaggaaggatgaatagagttctacatggaaacgacaagaactactcagattgtatccatattggttttcctagttctacttggacaaggggacacctatgggtataaatacaaggctccataggaggagaggggacacgaaacaatagatcaagacataagatcaacatacaagccaacatacgccaaaacaagacgccggatatcgacttcagagataagtatggctagtcccctacagcgtctacgaatactgtcaggagagacatagcgatgtctttgatctcgctggatgcggattctaggaggaaggctaccctgttgtcgactatgagtcagcacttcagaccgccatgtcgacaatagttagataggctaccccaaatattgtactagtgtgattatgatgaataagagcaacgaccggcttcgaccaacaggagtaggcttattacttgacaatttaggggctcgaacctgtataaaaatcctcgtccctatatcttttattacaatctcgcatatatcataataccaacgatcctcatactatgcaaataccggaatcgcgacatcaaacgtcgacaaatttcatctagttttcacatttaccatgtgctatatgtgttatcctagggtggccgtagggtttcaattatcaaagcacaaggtcactgataagtccgattttcccgtttatcgctacccccgataaaatctcctatcggccaaacatttcgggttttttttgaattttctggacatagcgtcaataactactacaaagttgctttgattaattcgttatgacctgtaggttttaatcaataggttttgtgttcgattcaagcaaagatatgaatttcttctctctctcttttttcacttccatttgcttgcgttgtgtgtgctataaaaatgttgatattatctcatttataaagtatatattaattttttatacaaaatggtttggatataatctgtatgatttcctaacaacttttgttcaatttcttttcaaattttatccaaattttttttctatcaccgttagaattccgataaatctgataatcccatttatcgctacccttcgatattttttagctatcgataattaaaactaactgtggaaactactagctttttatttttttttaaaaaaggaaacaaactggccttttctaagatacaacaaataatttggttagccccacctaaccattatccacatcaccacccaaatagtccatcatggcacgcattaagcccatccacaaccaagatatcatgcatggtaactaggtttacaaccacgcaaggccttcttcgtttagtcaacaagagagggattagagggattgtgaaaaattaattccacatctcaataggtgtggaattattctcctccaaatcctcctcgatccccttgtgggtgggattaactgaacaaggtctaaatgatagccaatctaattagttgtagtcacagtcaaagacttagtgcaataggtgatgttgtcaagctaaatggtcttatgggcgagaggggatagatgcatagtactccatctatcctaaagtctttatccaatttcattttttgtatttttttttcaaatgagatatgcttatctgtagtcttcatacatctaaaacttaaataaaagggctgtcttttcattttacaatgctaaattaaatttttgatcgaaactagagcgaccatcttaatattcattggttgcatgcaaacatataatttcttgattttgttatatgagggatgaattaatccctccttaggttgtgttcttctctcaactttcccaacctcttctctcttgttttccgcgcacacttcccaaattgcatttttttcgaagattttctatagggaagtttgtcagggttacggataaggtataccctttatccttggatgtatgttgtatactgatacggtatacccgcgcgtatacgaatagtttccgtatacgttaaggaaatctatcacgtgatagagacggtatctacggatggaaggagttctactcggacaaaactgggtctttaccatatcgtgaggggtccgatatctccgagtcctacttggagatcaactgacccgcggtatataagggaccccctgggcaggacctaaggcatcaaatatcactgccaacacacccaccacagcctacggagctagagcgtgcaggagccaagtcgccgggagatatagtcggaccaactcgactgcggtcttatcggtatcatcgagttctgctattccctttgtaatctgtggtttccatcatataatgccataccaactggattagggctattacctaccaagggacctgaactagtataatccttgtcttttgtttgcttgatatcgtactacgtagatcctcataccaacggaccccaataccctctatatccggtctacgggtatcccccgtcgacaaagttgttttaaaaaaattatattaatctatttgtcaagatttttttaactaatacttcatcaattatgtgctaatattttgctttgttttccgtggtggtgtttggatccacggattaaactatcacatcggatgttttgacattaatttggagtattaaacataggctacttataaaactaattacataaatgagagctaattcacatgacaaattttttaagcctaattaatctataattagcacatctttatagcatcacataggctaataatagattaattaggctcaatagattcgtctcgcgaattagtccagggttatgaaatgggttttgttaatagtttacgtttaatagttctcattagtgtcaaacatccgatgtgacaggaatatttgggagacttcctcattgcaaggctgttaacagtcatatatttgagttgaattaatttagtcggtctgaaacgagcttaaagaacatacgagtatttttccctatgcaaaaaaccctttttaacctttgtatgtggctgtgtttttgaaatgtacacaacatgcaactttttgacaaaaggatttgctaatcaaatccttctctcccacacaacgcactccgaagtccaaggaagaattctccccatcaaagctgtaattgcaaagccagcaatctcacgctgtcacaaaatcagctaaacttgatgcctatcgcacaatgccaaacccaaaaaataaaaatatcaaattttggattgcctcgagcccctgcattttgtgcggatcaatgcatcggcctgtagtagctgtaggtgccgtagaaggtctgcgtcatggtgagcagcagcaacaagacaccggcgaccaccgagacgatcgcccatgggttgctgaagtagttgtgcttgaggctggcgatccaggtgctccacttgtggtcgtagtacctgttcacctggtccgagagccccgagaggtagctgtcgttgatgtcgaacaccacctcctggcacagccggttgaagaggtcggccacctcggcgtcgctgcccagccagtgctcgatgatgccgcggtcgtggaggtacttgacgtcgtcggcggagttgatgaggttgtccatgaagatggcgtaggaggtgatgttgttgccgcccggggtggcgatgtccatgtggcattgctcgaacgcgatcaggttgaggaagagggacttggtgccgtcgtggatgaggatgcgcgggatctggagcacgccgtcgtggaacctgatgtcccagaagcggtccgtgttccgccgccggcaccggatgccggcctcccggagctccgacacgcagtggacgaactgctgccgccgcttgtccgccacgcgccggagccccgaccacttcttgagccacagccgcgcggggggcggcggggtgggctgcagccccgcgcggaggaggctgcgccggaacacgtcgaggcaatggagcatcgggccggacagcgggtcgaactcgaacgccgccgccgccggtgaggcgccgatggaggactccagcttggaccggtccttgcggagcagcggctcgtcggtcggcatgagcgggtcgaagaagcgcacagcgaggccggcgacggcgccggtctgctccgggttgccgagctggaggccgagcaggaggtcgagcacgaacaggggtatctggttctcgagcaggatcatgtcgttgcggatggcgtgcatcgcgccgcgcatggcgaagatggggtcgtgccgcgagtaccccaggtcgtcgccgagaccccttcccgccgtcgtgcgcgccgcggaagagctccagcacgaaggtcccgtccagcaccaggcactcgacgagctcgttcccctgcatcccggcgacgcggccgtcgtagcaggcgcgcgcccgctcctccatcggccgcagcgcgtcgaggtaggcggtgacgtcgtgccccgtgcgcttcaggacgtggtgcagcgcgcgccacttgtgccgctccatctcccgcagccgccgccggccgcggtggagcgggccgatggacaccacctgcggcatgtacgcgcgctcgtcgccgtcgcggagcgacttgggcacgcggtacacggacagccgcgcccacgggcacgctgcctcctcggcgcgcgcctgcgccagcttcccgcggatggccaccacccattccgggtcctgcggcttcgggctgtgcgccggcgactgcacctggaccttcacctcccgctcccgctcctggcgcggcggcagcgcgtcgcctcccgctccggcggcctcgccgttggtgagcagcggcaggttgcggttcagcgcctgccacagcggcagcgcgccgggcggcggcgcggacttgttgaggttggcatcgacggtctccttgagcttgaccgtgatcaggtaccagctcaggacgtccttgttgaagacggcgaccatcgagatggaggctggcagtggcaggtgcagcggcttcgccggcggcgtggggctcgccgcagtagcgtctcgtggttgccaagatcagtggccccgggacagagagagcaagccaactcgagagggaggcgaggcaagcaatgtacctatgaatatcttagaacgataattttatcagctgatgatgattgatagtggaatttttgggattgcttgcttgttgtaaaatattgtgtggtctttgacaaaattaaataaagtttcctcttgcgatcatgtgcaattttcaacgatggacattgctgccagcctgcgatgtgcgctcatcagcaacttacgctgcattgcacgtactccattccgtcgaagactaattggcgactgcacgataatcccaccgctgtaatataaagaatatagatactttggatttgtaatataacgatgtattccatctaattaaaatattttatattttaagacggattgagtatttaactacgacacgtatgatcggtactccctccatttcataatataagactttccaacattgctcatatttatatagatgctaatggactagacacacatatatatatttagatttattaacatttatatgaatgtggttaatactagaaaggcttattatgaaatagaggaagtagttcgctaccctaacaatctcagagtttttcttttccggagaggatctagacatgtagttcgatccagtgcactgtaaccgcacacaagctaacatcgtagaagtacctaccacaagcgactgaccagcgatctgaaccagaagattactctacccgagcaaagcgccaaccagaagcccagaggcaaccgattctccttacgcttcgggaatcgtggaccagcgaaagctggcgaggcagtccggcacatggccgcatgcccgcatacatgtatccccttgattcccatagccgttgggttgcctctcggggatcggaagtgacgagctagtgcgacgccacgatgaacgcacatcctcactcacccagcgaaagccggaacacccagctgaagccttctgccggcatattgtcacgcgccccactggcgaaaaatcacgccgcccgtgctacgaaatgtacgcgtcgatgaagatggccgccaggtcaggtcaggtcacgtcaggcgggtgcggaagcggtgggccgatggtggcaggctgggcctgttggaggcagcctgcgggcaattaattggaaggcctgcagtagcagcatgggcgcgtatttagagcaagttcaatagtataacccgctacagacttcaaattaactataactaatttaatagcttatttatataatagttaattataaaaatatatattactcctattaatatccggtctcacatctcatacacacatacgtcttgaaattcatgctgcagctggctacaaatatatagcccgctttcttctctctcttctatttttttctcgatacgtggttataggtggcttatagcctgctattgtcgctgctcgtatgctccggggccgggggcaaaggtggataagctctttcggtgagacggtgacaattattgaagtaactgatcgtgattgtgatcccttcattgcatgatcaggcaatatttgagcagtagtaatttttgctgcacaatagattgggccttcaaacaggccgatgggcttcagtgcttcaccaagggaataagttcacttcgtgacccttaaaaagtgatcaaaatctaatccgtgaccctaaactacaaaaccggatatctcgacccccaaactcttaaaaccagtgcaatttgactccttcagcgtttttggagagcggtttcgctgacgtggcgcctacgtggcatcccagtcatcaaataaatttaaaaaattaagtggggcccacctgtcagtgactccctcctatattctctctttcttctcgttggcatcaaataaattaaaaaaaataagtggggcccacatgtcagtgactccctcctatattctctctttcttcttgttggcagcggcggcgggaggatgaggggagcggcggcggctggcggcaccggggcgcagcggaactaggggcggcggtcggcagcgtcggcatccggtggtggggacggcgttcggcagccgggggaaggagccgttgcccaatcgacaaagccatcggcttcctccgcctcatgccacttccactcgcttcctcccacggcggtggcatgatgcggtcgggagaggggtggtgagcggcgcaatgtcgccgcgggacggcgctagacgccgcagccttcgctttggcgccccgacgcggacggccaagccgccgctcctccttaggccggtgccgcttccattcgcctcctcccacaacggcggcgggatacggtcgaggaacggggtggggagtggcgcgagggacggcgctggccaaaggagttgctgccgggggacgcaacggcgaccaccacgacgtcgccgtcctcgcctttcgacccgaccgccgcgctgccggggagcggctcctggtgttctttgcggcgtccaggtcgcgcacccgcttcttttgctgcagcctccccttgccgcccagcgcagctccagcgctcgccacctgccgccggcagaagggggagaatggatgagaaagggagagaaagagagagaaaagggagagaagaagggatttatgtggagaatagaaatggaatccatggcggcggctccggcttgctcccacccgccgccatccatggcgaccgccggtgccggaaaggagaatagaaaggggaagaagaagggggagagagagagaaggaagggaggaggaagaaggaaggtcagagggaggactgacatgtgggccccacatgtcagtaggcccacatttctttatgtgtgaatgactaatgggtcccacgcacatttttttatttctaatgccacctaagtgccacgtcaacgccacgtggaaagaagaccgagtcaatactgctacgtaggcgccacatcagcgaaaccgccctccaaaaccgcccagggagtcaaattgcatcggttttacgagtttgggggttaagatattcggttttgtggtttagggttacgaattagatttcgatcacttttgagggtcatgaagtgaacttattccctgagctaatgacagaagggatgggcctcttgagttatgtatgaagaggcatcatctcaggcattggtatcaatgcactgcatcaactttccttctctttttcagaatccgagggagcgatgcctatccagattttgtttggatgggaaataggaggctatccagatttgtaatattagaatatgtttgtttcaaccaaaataagggagtactaagtacatggacatcatactacttctttgttcatcctcaaataaaatgttgctacctagtatctgattggagtacttcctagtacaaagaatctgaacagggagtatctaatcaagtactaggtatagtaacattttaggacagatgaagcaaatgatgagcagcagtgcaggtgatgaagtggtcaagagactatccttctcattgcactagatgtcgtagcatgccacgcctctcataccgctacggaacatgacgatggggggcatcgccgcgcaactagaacactctgggactctgagtaaacatatttaagtataaataacaggacctcacgaggaagaaaaatacatcatataaaggtagatactatatagaaaatatgtatcagattaaatagtatgtgcatataacaaacaaaatatttgtcccgttaaatggtgcactcttgtgaggaaaaaagatacatcatatcaaatgctacatccatatcaggaacataatatctatcatattaaatggtgcaaccttatatagaggaagatatgtctatcagttaaagctaaaaactttattttatcaatattgtagtatgcccccaatttgcaatataagttgtaaaagtttgaaatacctagaacatgttcacaaaacacgacaattattttggagcatttaatgttcacatggtatatctatcaatgatatttcgcagaagaaatgtttaaggttaatggatagattcctcctatccccttacattttactttctctttggaactctatccaagagcactgaagctccaaagagcgtagccacaaagagagataggagtcgtctatctgttacccttaaacatttcttttgagaaatatcattgagagatatatagtgtaaacataaaggcttcaaaatagctgttgtgttgtttgaacacgtacgagtattccaaacatttacagcttatgttgccaactagtgggatactacaatgctaacaaaatgaacttctaaaagctttaattgatgtacatatctttccctgtacaaggttgtgtcatttaatatgttagatattttgttccttgcatagacatagcatttaatatgtacatctttttttcttccttataaaggtggaccaattaatgtgacagatattttgtttctataccttttaatatgatacatattttcttccttatatggacgggcctatatgaaatacattttagaatgaaagagtagtaattatcccatcaatcaactctcatttaaatttcttcatatctcataccccagtcatccttgaaccttatccacctctcatttaatgttgtgtgccaaagtgttttgttttttcccttattctctataattattttataaatgattattgtagtcggagggggtatattctaggataaaatttgaactctaaaaaagagatattccctctgtcccagaatatgaggattatatttttaacctaagttaaactattttaagtttgactaagttttaaactacacccgtctcaaaatataacagaattttcccatataattacatgagccaaatcacttattctttgaaatgggtatagcacagaagaatattaacatctaccacacaatctaccacataaaaacagtaaattataatgatatattttataatgggtctaatgatgctcatttgatattgtaaatattattttgttttcataaacttagttaaacatagtttgacttacaacaaacataaggtcctttgagacagagggagtatatgatatagtagtaccgaatgtaagagcatctccacgagtcccctaaacatattctgtaaatttaaattttgggaattaagttaaaacacatgtctccaacaaatacccaaaagagctcccaaattttaaacacctctaataccggcgccatcctgagctagatatggggcacctcatagaactcccaatccccggccacaatcacgccaattttttgccgctggcatcattttttggcaatcgtgcgcgatcaacctcgcaatgatgtacaggagaaatataatcggccaaaaatagttgaggagggcccactagcgatgagataatatatttcaatgttttgaaacctaagcactgactctgttggagaagtgggtgattttcttcttgcatatttttgagatgaccataatccaagattatcgggagtacaattttaagccattggcctaatctatacacacttatcacagttaacaagtataatccaaaattagcaggagtttaattttg

SEQ ID NO: 58417 - DNA, 2248 bp, Oryza sativa
ccgggctcgggaaaaaaatggggaaacggacgaggggagcacggggatgctttttatgggctcgggaaggcgggatcgaggccggacgtggcggaatcggccggcgaagtggagcgccgtcgtggggtggtggaggggttaaccggcgccgtttctagcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttaatttgttttctttttattttaattgatacaatgatctttgtgttattaaaactatttctcgagctccgaaaattcacggaaaattccggagagtattttagggcacaaagaatattgcaaaatattcccggccaatgatttttaagggaaaattttaattctcccattatttcacttgattaaattgattaactttttattcaatttctaggaaatgcatcattaaatgatttttaatcccgaacgaaaatcggggcgttacaaatctaccccccttacaggaatctcgtcccgagattctgggatggctagaaagaaagccggtgctgatgggcggtctgactgatctgctgacacatgctgcctctttctgattcgaactgactgactgactggtttcatcggattagatccctggagttctggtacccaacacgaccgattagctgatgaaacctatacgagcgatctggctggattcaacactgttgtcccgttgcttcccaaacctgaattgattggttctgctcaaactgacgcagactaggactgcctgtactcataaaacttacttatcttgggctgaactgtcaatactagcaatttgataacccgacaattcaccaagctggtagaagagggtgaaacttgcatctggcatttgtaactcattgatcctacgtccgcttgaacgggtcctgactcgaatgacacgtaattccaggaaacctgcttgacaagtctttcgtctgaactacaaccgtccctgatgctgcttctcaaagctgagctattgacctagcctcaccggtgtacctcagaattcaaacggatgccctaagatcggcttagctcttctgataccttgcaacaggcttcttcaagtgctacccggattgttgcagtgggttgaaccttcaactaaaacagcgatgaggtgagccaaaactcatctccgagacctaccccccttacagtgggtagtcttactttcgcctgactgagaacctttgaactgttgtccttgaaaaaatgaccaacatttctcggatttacagatgccctgactttgaagactaaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcgctccttgcacgaagcttgaggctc

SEQ ID NO: 58418 - DNA, 2740 bp, Oryza sativa
cccagccacgatttgttgcttgccatcgtgccacccatccccgagtcggcgagccccctactagtgcgccatgctactcgctgccgacacgttgtcgattggaccactgttcgaggcatgccaggctaccggtgaccaacaccgttgccatgttgtagtgatatttcacaaaaagaacacctagctctttgtttgtgttatgctaacaaacttggaagcgtatgtgagcggttcctttaagtagtccacatagctagtaccacctctacttccctttagaaagggattcaaactttacttacggatggtaaggatgtgatggggctaccaacacgaaaagaaaattaatgggctgaaaacattgagttcatgatgtcaaaagaatttggagcgcggagtaggaacacttagtaaaaaattcctaaacccgccactactttctagaaaacacattgaccattatcttcatatatcctcttaaaatagagagaaaaagactttgaaaagacaattgtaatcctaggccattttgcaagaatccattcatctataaagctaatgcccactaaacacctaaagctcaacatgcaagcatagtatttattagcactcctaaaatctaacatgcaagcatgccacatcaatccactaagcatacaaagctcaacatgcaagcacatagtaattatatatacaatttatttcattctaaaactaaatatacacatgctaaatcattattctcaaatcattttcacaatatttcaatccaaatcatttcaccatttctacaatatctaacatatatatcaagcaacaaagcgcggggcatcatctagttataacaaatattactcaacaaaacgtattttgcaaaattaaacttgtcccaaattgtaaaaatcaacaacaatttactgaaggttgtttaaaataaattcatttaaattctattttcacggttctttaaatttacgaaattcattaatcttattatttttatttttaaaatttgttattaaaaataaattcggttaatattttttcacaatttaaattttgtttttttaaaacgtttaaagttcaaccaatatttttcagttttaatttttttgcaattcacatatttacaaatatgggataagttttgcttattttttttcaaaaatatgtttgcatgtacctattatttgttcaagaattatcttgcaaggtggaccaaatttaaatttctcttataccatattttctcaccattttaagaagatatattaaaataatggtcggagtgtttttggacaaaacaccacaaaacaaagatatcctaaagcataagcttttgaagaagataaattaaaataatgatcggattgttttttgggcaaatcaccacaaaactaaaatgtcctaaagcataagccacaaatatttagtgtcctaaagtaaattttgcttaacagttaaggataggaaaacacagagtttaacaaaaagcaatagagatttcacaagtaaactaacttgacaaaagaaatatatattttataaaaactaaactaattactacataatgagataaacaaaaaataatcataaagaaatatgatagcatgttccaaggaattggagaaattacctgctcattctattctactactgatgatggcgatttcactaatcctaaaggttgtccattgtgttctatctcctacaaaacaaaaaaagtatggattaaaatattgttgatcaatcctacaatgaaacatatttctataataaggaactttcaaaaagttattcactaaatgcatgaaccaaaatgcatgagtagtcaaagggcgtttcctactgacaagctgctaaagttgcattagctaatagtagtagctaaaaatttcaaatggcatgtcggtgcgtagtcatagtcctctttctaatgaatccgttgaaacaagagttatgtcctctttctgctcctccacaggcaattcttcatcactaccagtaacctctctgtggagggcctccgcgagcttcttaacaagatcatccttcaagcctatgatagcttcctcctatggagttgttccttcaattcagtaaccttctactgttcaaaatcggccggttgttcagcacaggatacattgcactgtgacttctaaaattcacagctacaaaatcaaatggctaaacaattagattcgaacatcatggttgtcaagatggtaaggcgatctggggcaacccacccacgcattaccgctataggggtaaagcgctaaggtgcggggacgccataaccttcatgattagcagcgattagaaaagggagaggaagaaaattagcctagtaggccatcccacaaaagcccaataaccttcatactagcccaaggtcaaagaaacaagcgtaacacccgcatcaggtgcgtctctcctatcacagcgtcgcctctgatgtcgcttcttcccaggggcggagctagaatgagatggaggggggtgccacttgtttaatttactctgctaagtttaagctaatgtgggtgtctgaatttgaattgaggggggtgcacacatggtgaaaataggttaggtaaaatggcatggagtgttaccatataatctctgaatcagtactagtagtagttcttccttagctagtaagcattgtattggtcaatagattttttccttctccaataagctaagacctgctagtaagtcaagtctgttt

SEQ ID NO: 58419 - DNA, 15532 bp, Oryza sativa
aagttatatcattaaaattctgaggacatgatctgagcaaatagattggtgaaatacgtttcaactaagtttgcatcacaatggaccaactacaacacaatttctctttcaggcaatctaccgatatgtgaaaccagcattgatcaaaacactcgtagttcctttaacatcattgaccagaatattgagatacgcttgggggtgtgggtttagttaactattctttcctactaaaatcttcaacctgagactaaaacaaaattgtgttccataaaacaagtaaagtaagactaaaacataattgtgttaaagaaaacaagtagtgctcataagtaatgaatcaataaggagattagcaatgctatctgtcagtaaaggtgcagtcggtagcttaccttaactgctgtaagtctagttatttcattacccattctatcaacaagaacgggaaggcatgccggcagttccctttggagaccatcaccaaacgtggatagcgcaaggctcatgcaagatatggcacactctttaacttcctgaaacaaatatttccataagagacctgagagagaaagagacagatgaggatagggaggtgttaattttgctcaacctgatcctgatcctgatcctgatttgccaagcgggccaagatagccttatagattggaccaatatatggcctgtaatctggagagtgtggctgtatcacaaacaaacaaaggcttcaagaaacagaacttagattttgttcagcaacatatgaaatacaagattgacctcagaatttggacgaagtacacgaactagctcttcgcagactcttaaagcctcagcggtgaccttgtcatatctgtctccaatagcagacaatattgggccagaaagagcctggaatttcactacgatcaatacaatgatgacaaatgccataagtatattttactgaagatatatgttacagttacctgtatgtatggatgaaacacagctggggaatgtgaagccataacaagtcttgtaaatacaagggcttcaatcttcaggttggaggtagatgacttatcctatgaaaaagaaaacaagttagcaacaagtagaagtcctgcacataatcttttttagcaaaatgggaatcaccaacattcaaagcgttctcaatcccaggaacaagtgacccaatatgatcagcaagacagtctggcagtacaacaacaagctccttcaatacagagaatgctccaacctgaaattttatctaaaatcagaaccaggtcgatagacatgatttgcagtcaaagagctcacctttgtcttgattgatttttcacgcaactgcctattgatggatttgacaaccttaggtacttcttgtttcagcaaccatctagggctgaaaagcaaaaggattgccaacataggctcagtgctctaaacatggtagaatcaacttcaagcatgtaaaagtatttcaccaataaactgcataagatgctataacttggaaaagttgaaaataatgatgcaaataagagcacaatagacttgcctagactcatcaatgtcaccttatccttttgtcatgttaccagtttggcgtaacaactcaataaatgtgttaaagatgtcgatctagaatcatatagaagcttcatcagattgacaaacagaaagacaactcagagacaactcagagactgacaaattattgatacaaagcaattacctttacattttcctctctttccctaaaccattcaattaactttggacaagcctgcatatattttaaaaaataaaaacatcaaagttaaatggggcactcaaagttaaatgggtaaaaatcattacagaaacactgtctgaaacatgggagaaatttaaacatgccatcaaacagaacatttttcagataatcatatgttggtttaacatgattatgtcaatatacctccagatacatcttagacaacatttcaggacgagatactataattgcatataagcactttgctgaagccctccggactttccagcttgcatcctcatcatctgtgtattcatttgcgctctcactggagaaaatatcgaaaacatattttgatcaagtaaacagataacatttatctattactgtaagagcatcaattaagtactcatcatcttcctcatcctgagcctcatcatcagtgtcctcctccatactatcggtgaaattaggatcatagcttatatattccaatgcaagatttaaaatactctcacaatatggagatatatctcttggacacctcagcataaaactctcgagggcctacattatgggaaaaaccacaggagtcatacaagagaacactcgttagtcatgtaacattggaaagaagaaaattgctagcctgcaagctgtattcacagagctcttcatcattttctgatgcacttgtacaatagtttatgagcaaaggaacaacttcagcaaggtgtggcccaaaacggtatccaaccgagcgactgtaaatgaaacaaatattgaatcaaaacttggattgcagcacaccagataagaaccactaaatcgccaaaaagtagtaaatatctggatttcaacttgctagataaatttgaagtgtgaacatgatctcatctaagctattgcgaacaaatgagtgtgccctgttcctcaaaagaactactcaaggcatacatgtacagttgaaagccaaagtaccttagagcaccaatcatctggatatttgttcgggcaatttcagattttgcacttctatttttaagcaactggacaacctcaaaagttgccttggctaataaatcatcagacagacatgcagcaagtgatgctgaagaaaaatagcatgttaacagtcagtgtaaacacctttacaaactcaagccacgcaaaaaacaacatataatagcacagcacatcagttcgacttaccaatgcaagaaatagactttttcctaacacttgcttggttagagctcaactgggataacaaggcagtcagcatgcaatcatgatcttttgtgatcaagttgccaaatctatgaagtacatcccccaatatatcaaggcactcgcatttcacttccgcactttttccctgtcaacagaagaagagttatcaaacctacccaagacatcccatggtataacaaaaccagttatatgctactaagccccaatccgtatattggtgctactaagccccaaaatccgtatattggtttatctattataggcaggtgttaaacatgatgtgctggcaaaggcaagtaattcaataaaccgctcttgttttttttaaggtaaagacgtaaaggtgaaaggtgttcttatagttatgtggatagctagacattgccagatttgcagctaaaatctgtcttgtgttaggaaggatatcacagtttcctaattaatttatccaaataaaagattgctcgtggtttaccatttgcattgtatttgctgcagtagctaaaattgcggtttgaaatttatggtggctagaaaaatctagcaatattgactggtctggaaaactatccaactttctgcaatagcggaaggtactgtactatgccacttactatcatggctctcaaactagaaacaaatgttaaaacacactttctttttggctctctgtgctgataacataactctggagttatgatactagccagcatataatgacttaggctgaattcatttcagcctgttccgaacccctctccctcgttttccgcgcgcacgcttttcaaactgctaaacggtgcgttttttgcaaaaagtttctatacaaaagttgcttaaaaatcaaattaatctatttttgaaaaaaaaatagctaatacttaattaatcacgcgctaatggactgctccgttttccatgcggaggagaagggttcccaacccccaataacaaacacagccttaaattgaatatggcaagcaaacatggttgcacacctaaccagactggatgaatagggaggtaaaaataaatacatagttacaaggtttgtaaatgtgttctttggtattacacctcacaaaagtagaatgcaccatcagaaacgcggtaaacttaattagcaggctgaaactttcaattgtaacggcaaatacaaactacatggtacgaatggcgcacaccgcaagattaatatggaagcatgttttaccacaattaggagacgaattaagaacttacagcagtggcgcccttgattagctgtggggcaagagacaccaaaatcttttcagcaagtgttgttgtcgtaacttccgcaatgattgtcttcagagcaatactagcagtgtctcgatgttggtcctttccattgagtaacttatcacaaagaatgttggtcatctccaccacactatcctcaccaaccttcttgacaagtggagccaagctaaccaagagaagtaataatacagattaacatagcaaaccatgaagtgcagaacacaggaatgtggaaaacataacagaacaattgggtatcaaattgctatactaaatgtgcttcaatggatgcaataattgagacatgaagatgcagtgaaaaaaacagcagttagagagatacagaaaaaaataacatctactgtaataatcaatgtcctatattaatccagaaaattgaatgaggcagtgcaaatccttaacaatagcaactgcacctaacataaattacaaaagtagcgagatccaaattacagcgaattcttgcaggaaggagcggatgatcaccattaacaaaacaaaatgctaataagacgataccgctctcaataaagggagaaagcacttaatgcataccatttaacagctaaaccagagacttctcctgaagtatcttccagttgttgaagaacggtagtagtcaactttggctcaatgtcttggtcagctttgaagccctctttgttcaatcgctaagcaaatttgaagttgccatatatctgtagtccttatctttccctgtcatctgaaagcaaattttacacgacgatgttaaaatcaaatcatagataaataaagagcaaaattcaggtatacagttcacatgcagatcagtgaaacccataccttctccaagatggtggttatgttcatgtttgccattttagctaaaccgtatccaaaagtccttttccacggaactaatcactgttgccctggtggaaataataaaaatcgagtataatgagattaagttccattactgacaaggtaaacaacacacattgtacacattgttgagtatttgcttgctgacacagatgcaaaactccagctcacgatcacagtgacaatccccagtacctccctcctttaaaaaggaggaggtgggcgtgatggtgtggtgtgctctattctgccccacttcgggaaacaaaagatcctgctctctgctagatctacggtaacacacagaattggaaatatacaggtataatgaaacgaaaacagattaaactatcaaactgcaatattctgctgaagctgcataaatgacgcaaatagtaaagtcatgtcatgtatatcacaaaatttgttcttcaaacgtcccaaatcctggattttggtgcaaaaaaaatttatactgacatgctccatatcaaaacaaactttacatttgacatgagctatatgctacatgggagcgtatcctatgcacacagaccctcgcgtgtacacaccatgtacaccaactaaaaattatcacaaaaaattttagaaaaaatcatacatgtactttcaatagtattacatctacgtgcaaagtcgcatcttcaaattcattctacatagagaataacaaaaaagataaaattctgacaaaattgcaaccttaaaactgtcagattttttgttttttttttgttacggctaaaatataatgaatttgacgttaagattttaacctcttaaccctaggtgtaatacaattgaaagtatgtgtatgattttttctagattttttggtgacattttttagttggtgtgcacgtgtgtacacgtgagggcctgtgtgcataggatatgttgccatgctacatatgaggggaaaaatgcaagatggaaatccgttctctatgtaatctggaaaatcctgtacaattcatttcttaatgaaattcaggtgggggaaactgagacttaagtcccaaatattttacctatcaggtgcccttagtcaggatgtgcgcaagcgcaaccagcgtgaactgagtagtcggagataggtggcggagaggcgccgccggcggatgtgctcgggtcgcggggtcggcagcggatgccgaaggggcccggcactgcaaagagggcgctgacgaggatggaagggtggcggtggtcgggggtcgggggacggagaaaggaggaggagagaagacgacgagctccccgcctccccggcggcgtcgagaactcctggggcgccggcgccggcgccgccaatgacacggccgacgacgaggaggatgtttggtttaatccacatgttagcagtcttaaattgagcccattaccggaccattcggcggcccatccatgtctagaacatgtttggatgggccggattcagcccgtgtcggatcccgaaaactgttttgtattatgtgggccgtacttggaacctgcaatggtataatcacctgacgtccctcaactttacgtcgactttgttcaagttccttagaccttagggcctgtttggttggtgccctgagtgatgagcctaagaaaaaagcatgcctaggtggaagaaaatctataaaatgttttccctggtcaggcatataagagggtttgttgtttggttggtaccctggacaagaaacaagcatgagagcatgaaaccatgtgaaagcaaacaagaaaatataaaatattgcaatctcaaccggttagtacaagtaaacattgtgaaatgacgccatgcaactagaatattccaacctcacctaatctaccttctttaattcggttgcctgagtcaggccacccaattcaagcgcctgagcctgagcaaccacgcctgtgtccagcaccttctcaggacttgaaccaaacagaccaatgaaaatgtcaggcatgcttcagctcaggcgaatttgctttagggcagcaaccaaacagacccttaatctctagtactagaaataatctctatagtactagaaatccttactcctagactaaacaaaatcatgcaatttcgatccttcgacagtatggatatatggtttcgctgatgtggcatcttagttagtaaaataaaaattaaaaatgttatgagactcgtattcgaatgatttataaagagtaaaataattgaattttgatccaaggccagcagcaacctggaggctaaaagatgaggcaacaccgaggcggtcggctggagcgtcaattgaggagtaatcttaatgtctgaatatttagttgtcaaaactcccccaataaactcagattttcatttagattttaagaatatatagtcctgcaattcataaaataaattagaagttattagtagttggaaaatcagatatatatttttttcagattatcaccaaaatcttaagattttaagctcccttgccttagttttcaatcttttcgtgagattttctacatggggtagcgcttttctttttctccttcctaatgcagtgatgcacaaaaatataaagtgcttttttttttggaacaaccgactagtaattactttactaatataacaattgtattatttatgtaatataaaagcataactattaagtattttgaaggtgaatttaacaacatcagttttatcataaattatatcctaatggagtactccctctgtttcatgttatagggtgctttaactttttttttaattaaattcttgacaatttgatcaagtttatagaaaatataaaatttataataccaaattaattttattaaacctaacattgaacattgaatatattttgataatttctttgttttaggttgaaaatattgccatatttttctataaactataaacttagtcaaaggtgaataagtttagaaaaaatcaaaacgacttaaatataaaacagaagtaccttatttttgttttttgtttttttttatcggaggaccaagttctgaattgccaagtttatgcattccaaaagttttccctaatctattttgtcgtctatgttctatgacaaaactgtgccgcacaaaattacacaaacattttctttgttttgcacctccagaacataaccaataactgagtcagaactgcaagctatttcttgaaaaactggacaaaaatggagtcagaactgcaagcttatttcttgaaaaactggacaatgggttaatggaaacagtcagttttcctctaaaaaaaaaaactggacaaaaactcgacagcaactgtaactatcattgattgattatgcacaccggttttggcagaattggcatcattatagcttaattaggggtgctatacttgcatgttcacttgcgacaacagtttcatcctaaacaacataaacagggaagggattccaacatgttcctgagtctgtttgagcatcacgttacgtgttagcgaatgccaacatgatacagaccaacagattggtaagtgatatggcacatcacaagcattgacaaggatcaagactcactgcaatttgttcaatacttgtctttttctcccttgcaaaattttgagtaatcctcgtcattcatgagcgaattgagctcgcctgaatcactgatcttgaccacgataatccaccctgtctcgtatggccttgcatttacctatgcaggtaacgacaaaaaaaacagttagcaggttattaaagcgttttttaccatactcaacttctacagcttaccaatccaggtaaatcgcttagttgatcattcacttcaacaacctctccagatactggtgagttaatacccctggtggttcccttcacacttacaacaacaccaaatttatttccctgggatacactttggccaacttctgggagctccacagacgcaacataacccaaatggtcctgagagcaaaataaaataaaataaaataaacttaagaaccacaagcccttattctatacgctgaatatggtaacatatgttggacctaataacgtttaagaaatagaacgcatgctctgtgtacatgcatagagtgaagcaaatggatcattcaacacactgaggccctaaaataaaaaaaaaaatgctcagagtgatagaacatctaaatatgtacctgggcatgatctgaaatcccaattgttgcataatcgccttcaacactaacccattcatgagtttcagagtacttcagatccttcagcactgaaaaagggaaaacacgaaagataagtaactgcagctgtgttttgacaggcagcaatgaagctcaaccatgcaaatgaaaaatctagaaccattcaaattagtggcaccctgaaacaaatttatgggtgcttctgcgtatcaccatttgtccaattacttttgcatatctagataataagctcttcccttggctcagttattgtgcgcaattactttcgatttatagatgtgactgtagcacgccaaatgtaactggaattgaggtctgcaaagagtccaatatgtaatttttttgccttttgtatatatgaaaacagaaaaataaatcattatttccaatcatatattggataatagccaatttctcaagaacaagaatttgccattactcaagaagagcctagtggcatgcagttgttatccaatcacaagatggaaaatttatgcttgtgaaaacaagcatcaacaaagatggcatagcaagaacctttgtaggtgcaatttttttacttttcatgcagtgaaaaagaggtggtggctgagactattgcacccaatccaatggcacagaatatcctagaattccctcaaaaaggaatatcgtatactttcaaaagggaatagattttactttttcattgtggatgaaatttagttgagaattttaccttcaggaaatggggcaaaccaagctctcatcttgttatcaagaaaatgcatgtaaagataaccaagagatccatactgtggacagaagaaacaaaagaattagacaccattatgcgacaaaaatagacaatagatttggcataaaacgaagttacctccttatcaacctgctgacacacccagtccttgaacattccacactctcgttgtgcatctgtgggcatctggatgaatgaaaggagacgaaattttatactcctaagaaaaaaaataaaaaaaggaaatatttagatacaataatacatacataagcacgagtcctgcccacaaggcgatgaacctacaaacaaatgtcaaacaaatatgaatattataggcacaagagcattagattgtctatttgaaaatagcacaaaccaaatcatccatgtggtgatcagcatggggagtgctgaactctttaagccgtgtagtgtaactctacatgcccatcgcgtataagcttgagcacatcttcatatgacttgttgttgaagaggatctcagatgcaatgaaatgatagaagtcgtatctatcattcatcctctccatttccttaagaagctccaagcaatcttgcacagcagcttcaatttggaagtacagcatcttctgataagattgtgttgcaatggtgatggctttggctagaactgtatcttctgtgttaccacactccacggtatccatcagcttgtgaaagaataggatatattgtaggtccccttcaaacgtagaaggacgcagccaatcagacgttatacgctacaatagtagggaacacatgttattgttaagaggatgaaaacagttggaaaaacatttttttcctcaaaaacgaaatcaaaagagtagagacagaaacaaaaacgatgtcagtgttaccggaacatcagaatatagcagaacagaactatcggaattatgtttttttgtaattattttcatgggttatcagtacaatatgttttttttcagaaattctagatgaaaatggtatactgataaaaagggtaattcagtagcattttcacccctattaattgttgacatgtagcaatatatatgctaattagttggacaaggtagtgggagtaaatgatactccctccttcccaaaatataagaatctaggattggatggaacatttcctaagctgtctagattcgtattactaggaaatgtctcatccagtcctaggttcttgatatatgggagtgttgtattttattttagctaagtacatattatattgtttgcatatgtgtatgtgcaactactagctgtagatgatacagcaatatatattggaattttctcttttctaaactcagaacctatgatttaattatttgagatatgttgcaatgccgcgagcacgaaatcaagccagaagatttaaatagagatataaacaatgcttgcaagtgtcaataacatgctagtcaaatatttatgcacaatgtcaggcagcaagagtaaaaattgttgggagggaagttattgaattaccggtgaacggttgaagtcggggaagaagtgagcgtaggagggcgcagacttctggcatcgcgaggcaaagcagaggtaaggctcttccagcttgaaagggaggaagagctcctccacatcggcgtggctcgtgaagagggtgtgacgcgggatgtggttgcagttgcagtgatgtatcctgcgccgtgtgttctccacggctagctccagctcactcaaattctcctcctcctcctcattgtctggggttaatgcatgtgttcttcttctccctcttcttgttgccttcatattaggccaatcccctctcttcccacggctttctgaacagattactgacagctgttgtgacatcctcaggaagtcgtcgtcgtcgtcctcccacggccatgcctcctcctcctcctcctcctcctcccaccgccgcatatccttctcaagctgccgccgtctctccgcctcccgccgccgctgctcctcaatgcgcttcctcatgaggcccttgtcgacggggtcacggagctcgtacaggggcactctgatgaacgcgacctcatactccgggatgtcacggctgtcggcgaaagcctcgggcggcaacactcgggtgatgaaatcttctggagggacgtaatcatggcgctccttcagctccatgaagagatccatcggatcggacaaacaaacgagcaaattccgcccccggtgaccggtggagcgagagtgcctggggttgggggtgacggtgggtgtgggtggccgccgccggcgatcggtggaggcggcagcgagattggggtgggcgcggctgatcgatgccctacttttactgaggatggttacgatgaggaggagttggagggcgacgtctgcttttcatggcccagcccgagcccgacccagccaagccagtacgaaaccgactcttgaaaaccaaaatttaaattttcaagcttgatttttaaggttgattttataatacttttaacataatctctttttacattggcttttaagttgttacaaacaaatacataaaaattttatctcctaataaatcgttttggcttaggaggaaatattagcatcccatgaagctctcaaggagttgttgaactgggcttgtatgtttgcttcctgaacgagactatatgattgccatatgtttttttcgtcccgtacaaaaaatagagagtaaaatgcatggagtatcaattaacttgtttatgcaacttgggattttgccacctaccaaaataccaagtatattattctattcctacacatatttctgcaaattttctccaaaacggtatattctactgaataaagtcttgagcggaataaacagacaagtatgatgaaaggtgtctcacagtgagcgactactaaatgaaagaatcttttaaataaaaacaagggtaatgaatgaagtctggtttttaatttatttttttttctttttatttaaaaaaccgattttattcatgacccttgtttttatttaaaagattctctaaatgacaatgccattattatcgtcctccaataaccggattatatccaaaccggacgtacacgtacacggtcattggaggatgataattatgacatggcattttgattggaaagatgtattttagttaaaacagaaaataacaaggttcgtagcataaatgaagtgacaaaacatcttacaggttgggccagtgataaacaaacatcttacatgttgtttgctctaacagggaagaagatgtgaaagaaaatagtggtgagagagacaatcgagtgactctgtctcgagtctggctcgaaccagcatacataaagcgatgccgtcctatggcgatgtcacgctgatgctcaacaaaatttctgagaaatctcaccaagctgaccaggctgtcatcataatcgtcccaattaatctggtttgagcagaggaaaacagaaaatttggtgcttttctttaccatcgactgccacacccagtctcgaaagttttgcttgagagaagtgtttagatcgacacgtttgctctcagcaaggtcatacaatctctcattcatgggctcaatagcagcgactctttctttatccgaggccaagatatatggatgtttcatgattacctcgacgtcatcactgccaacaaagcgaagacatggatggttttgaaacgatcgaaaaggtgcaagatatatgaaaaacttagttgttttcttgagaaagtagtcaagttggatttactaaagtgaagtgcatgcatgctacgtgaactgcttagctagttttgagctattagatgatttgtaacaggagatgtaaaaacgtgttattgtagcaggtcagtggctagcccgataaaagaacatataggctgtgtttagttcccttcaaacttctacaaattccatcacatcaaatgtttggatataaacatggagcattaaatatggacgagagaaaaaccaattgcacagtttgcatgtaaattgcgagacgaatctttttagtctaattacgccatgatttgacaatgtggtgctgcagtaaacatttgctaaaaagaattaattaggcttaataaattcatctcgcggtttataggtcgaatctgtaatttattttgttattagtctacgtttaatacttcaaatgtacgcctgtatacgtcaaaaaaaatttggaggaggaactaaacacagccatactcctataaaaaaaggtctttgattttgtaatatatgataataaatactctagtgcatacaccttctactcttttatcctgagtagtgattagagctaataattttaattgttaaacttgttaggaatgtatataagtggtttctttagcccttgcattaattttttttaacaaaaatgaaatttggagtaattagttactaacccgtattgtacggtcaccttaaatgcttgatagccaagtgtattttctgccccgatttttcgaaggaatgtgcaaaatttcactcgctgagactttttggttctagtatcatcacatggcaagggacatccaccgactatcttcagtagcttgtcctgatcattaccctgaccataagcaaaagtgatggttgaattcatatagttatttccatatcccgccacatgaagtgcttccaaggcttcaaatatttcactacaaaatagattgtatgttaaatttttttacctgagctagatctatcatatgtaatctatgggtaagacattacctgatatttttcctccagcgttgttttggctgttgttttttttcactgctagattgttggtgatctattctatcctctttaaaggagaagcggttcagccgctcataacagacaaaatacttgcataagcttctgttatagcctatgaaatatgctttggcaactcttttgtggttaacttttagtgagcaactttgataactttctgcagtagccagactgtctacgagcagaaaagagcaaagaatgtcatgtggtttatcttctaccaggaaggacatcttgccattaatgaggtttgcagatccaccctcttcagatttgtcatcttctttatctattgtgtatgctattagaactcctccaacgacaagatcattggtggaacgtaagtgttgtggcacgttccactcaatgaattccttctccagcatttggacatgccatggcttctctggatcaactgcagggcaaacccaatgttttagatatatgggttaacttgtctaataaaatcataaaatagttcacagacaagtgtcacgaagcaagatttattagcgttactcattggaaaattacaagagatacttagagaacatgtagggcatctggtcctt

SEQ ID NO: 58420 - DNA, 675 bp, Oryza sativa
ccaagcgaatcggccaatgaatttccggaaaagaagcgatcggcgaatgatcatcgatgcatatgcattcgatcgttgctgtctatacgtcacagatcacagatcgaataactactccttgtgttgtcgcaaagtaaaagagaaagggaaaagcgaaagtaaattttgttccaggaatgaattccgtggcaagtatacatacagggcactcttgtgccgcacaagatagaaaatggtccggaccgtgcggtgagcaacgaggcccaagcacgtacgggacgaaagcgcgataaggcctctattcgtggcgggccgtcacaggcacgacccaagccatgccatcagtcgctgccgcaatcaatcggtccactccactagacgccgcccgccagtgccgccgggcgacgagaaagcgctctgctaccgcctgatccgcgcgcgctggcgtgtacgccattccgccgcgatcgagccaattcacgtggcggccggaggcgacgagatgccgtttttctccaggtctccacgtctccgcggcacaggagccgcggctgccttcgagttcgtggtccgaaatttgagagatgacgcggtgcggctgctgcacgggcacggtgccggtcgtaagctagctagctagactgcctgtggcaacatctcgccccatattgcaaa

SEQ ID NO: 58421 - DNA, 789 bp, Oryza sativa
cctctcctttgagagggtcgtgaaggacaaaagagagagggagaagacaaaagatacatgtaggggcgtacacgtatctattccctctatttcaaattataagtcattttgattttagtcaaaatcaaactactctaaatttgatcaatcttgtggacaaatatagtaatatttacaattccaaattagtttcactaaatctataattaaatatattttcataatatatttgtcttgggttgaaaatattactactttttttctacaaacttagtgaaccttgaaacaatttaattttgaccaaagtcaaaacaatttataatctgaaaagttgtttctaagaaacaataccatctgttcctttttaactgccaaaaaagaccggcatatgtggactcgatccattaaagtcgtgcattcgttgtgagacttggtagcgaagccaagcaaaccgcaaagcactaatcagaagtaccttagacaaagatttgatcactgactcgatgaactctatcatattggtagctacatatggacatggagaccggacctgaaagtgactagcgacaagaaagatcaatcactaagccagcatgcatcaaccaatcatagtagccacataatgtccttagatatttcagattacgataactaattaaacagtgtaacatttcaatgttacaaaacaatcctctagagaagtggcagggatcgaagaagataacaacattatacttgatcctgggagaatttctcatgggattgtcgacaacaagtcctgtatatctg

SEQ ID NO: 58422 - DNA, 735 bp, Oryza sativa
  unsure (1)..(735): unsure at all n locations
ccataagtgcttgtggccaccattgtacatgtcctaacgcggcctcccaaggctgatcggctacgggtgtggttggtgttgatgtgcgggaatgggggagagacccgtcgctgcctctgatgccaccggatgccgtggcaggccttgtctgccaccaagaggtctggagggagagggatggatcagctgccctaggagatgtgtgagggagggagtaggtgtgatggagatggactagctgagagagagagagagctgagggacttagcctcgttggtttgtcactgtgctagatttagcctcgctgatttagattgcgaaaatgaattttcatatgtggggtcgaaagaggtccagtgggcttggcagtcaccacccatgatgacggactgatagggtggcgtgccgtatgttgggatggtaatgggcttaacatcttgacctacaaaatatgatggttgggccaaaaagggttgtgctgaaatttaataattttcttgtgctcaaaaatttaagagttgaaggggcttgtgaaagagtagtgagccttgaccatttaccacccctaaccctatgttcgtacattcgcgcaaacataagggaggaaaggggcataaaatggaataagttcactttgacttccttaacttgngggcgaatttgatttgaatccgtgaaccgaaatacaagatatcttgaacccttaataattttaaaacatatacatttgactcc

SEQ ID NO: 58423 - DNA, 10105 bp, Oryza sativa
ccgccggcggtgggcggcgcgtcccccgccaccaccagcatcgtccgctgcgccctgggcggcgccatgggaggaggaggaggaggaggaggaggggagggtgaggcggaggaggtggaagaggaagaggaggagctggatttggcgaggcggggagtcgagggggattggcccatgctacgctatccccggggccgcgatgggtggggaggcgcaagccatccgggtggtggacgggatgcgcggccggatctgccgatccggtttgcggggggcaagcgaggcgacgacgcctcgtctaatcgaccaccgggagaggaggacgaggaggagatggggaaagtagccgagtttagtacaccgatgcgtcgaattgatggtgagcccgtgagagcgtttcgattttctttttcctctcttctctcgttctaatctcaggtggttgggcgaggttgcggacggtgtgtgcgtcgtcacagccgagccgcctcgcggagagggcagcaccgcagcagcgtgccagcgtctcgtctctcgtggactcggtcattcgctggcgtgtggccaaggcaaagggcgtgagcgctgctgcctcggatgcgcgcagcgggtgggggcgcaaaacttgtgtgcgtattgaccgtgtttttttttttaactgaggcgggatatttctgggcttctggcgagcggcggagccagcggccagtgtatgaacctgtgggagcaacaccgtttctgaccggtttactatactaggaatttgtttggtgtcacgcgaagtacgactatattaaggtctgtttataaaacccttatcaaattttggcatgtcaaaattttaatatagctgtcaaaattttgttaattaaatatagccactttttttttataactttaccaaaacttaataagattaaaaatagcatcaaagtaaacagtctcttaatctgaagttgttgcgggggagggatcctctctttactctcttttagtacgtgcttgacctaatcctaaacaaaagaaacgggcccgatcaggtcaggtctacctcaacctcaaccggacaattgccgtgtggttgcccaaaatgggtggtctatcgcgtgacgtgccgaattacatcgtgttttgtattcggtgcaggtgtcgatttcgcgtggagagacccacaaagagctgacgaagagaaacgaaaacttgcagcaaccattgttttgttggggagaagaaaaaacccaaccaaacaaacgcattgatgacgtccacccaaaaaccacaaaaaaacgtacggctctagctacagtagcgtaatgctcgcacattgaaacagtaataatcccttgctgttgctgaagactgtgtacatcgtacatccagcatgcgtctacgctactgctcagctgtaccgacgcggatggcagttgcatccccattatttgccgggaccggtgcgcaccgggtcggaatccacgtcggtcagcgcctcagcgggcgcggcggcaacaaacagcgcgaacgctccacgacgcccgcctttgctggagaagagggaaattcggagcagtttgttgccggtgagcctgcagaattcgcgcgcgcgtacactatttctgcagcttgcggctgaattttaacagggacatcgcatcgtgatcaccacgatatccacatccactgttccgttctatagcatcgttccgtgcaactacttgaggttgatgttttcagaatcttcagacaagcaccacaagcctgcatcagcctttcggtccatttttacagactacacaagttaaagaagttgcccggaaacattagcttcggtccagaaattcagtccatgcaatggtgtagtctttatcttgctttacagctcaggcatacacacaggtgtatgtacgcagaagcgtagtaatcagtggagtcaaatctagctaggaagatttcgctttgcagttaactacgctctctttctgctaagtggtgcagctttgctgaaaagacgagcttcccatacgtagtggggcgcactactgcagaacaacaagaagaagagaaatggcgcaggacgatgtgaaatgatgaagtgattatcataatcatgtaagacaaggatgttgcttgttaaatactcgtggcctgctctgaaaagaggaggattctggataagaaaaggagcagccattggttgctttcagcacaatactcagcttatcctgtcaaagaacaaccaacactcgagtaatcattcaccattaactttcagtgaatcctacctacaagctttctgaatcgcctttagcggctctgcactcattagctaaaattgcaaaattactggaataaagaccaaagcagttcatgttcatgttcatcctgcctcatgagtcatgaataaagttacttcgttctacttttattgtcagatttccatttgatgagtaatgagccttcagatgcaaaattgccgagctggagccctggaaggtggcgcgtctgtatcaaggagccaattttgtctcttttttggagtgggatacatcaagaactactttttatacaacttcttttgtgcaattgattgatcgatcaacagtaatacagaggagatagtaagatacagtggtttctgtaagtctattataatctcatccccatttcgtcttgtctgttgggacatgggactgtatcacagtacagtcatgacaatcgcaccgccgtgaactaactgcctttcgacatgctaattatcagttcgcaactgtattattgtaattattgctgcagtctgccgaaacatttcactcaaagaatcgagattccgaaggaacccggttcttttctttcttcagccgaggtggtcaggtgggtgtgttagctatacctggtttccaactggaaccatccacacgaaaaacggagcggtccattagcgcgtgattaattaaatactctattagctatttttttctcaaaaatggattaatttgattttataaagcaacttttgtatataaaatttttgcaaaaaaacgcaccgtttagcggtttgaaaagcgtgcgcgcggaaaacaaaggagatgggttaggaaaaggggcatccgaacacaagtatagccaactactagctctaattcatctatagccaatctaatagcttattcacataatagtacctataagcatatactacaccattaatatatggtcccacctctcatatacacacaacgtattggagtccacgcggtagctggttacaaatctgtattccgctttccttctatattttcttctctcctccacatgtgcttacagctaacttgtagtctgctattgtactcgctctaagggtgtgatgatgtcacggaaactgaggattcgttgggtttaaccgtttagagcaagtataatagtgagctataagcttactgtaaacttatgtggaggagagaggtaacaaaaaatcaaggggtggctctcatgtaagagctagcttaacacaatatctaagacaaatacattaaatgtataagtgagagatagcgagaggagaagaaaattatagccaaacttatagctaattttattatatatgttggcttaaaatgagttaatagtagaagttgagttatactattgtccttgctcttaagcgtcgacggaaggttgatcgattggtgggaatttgggtggtcaatcaccgcatcccatgagatcgttctccaactgatcgaatcgcaaggagttaccggtacttctcgcatagctatttgctgctacgcagtctgcaaagtaacagcaaaatcttcacgggaacaatgaccgaggataaaaggaagtgggctttctgggatggaaacaaaggtttcattccaggatagtacggtataactctggatttcaggattggttttataattctgacttccagtgttgaccttttttcttcagaacgattggtttccatttagatgaacaaggcttcacgtacgattcatccagtgttaggaagggcctgcgaattcggcatgttttctacagttaagatgggctgccaaagtccaacaaccttaaggctcactgggatcagctaattacagtaattgctctaactgtttaattaaacctaacatgtttgaacagtgatattcatgaaacttatttagtagtaaaaaaatatagtacttcatccactcaaaatataacaacttttaatctttaaaatttgtatcaagtataactacatattcatccacattctatttttaactgatcacaacaccattcaaatttccacatacctcatctttctaatcaatcacaacattcttctatttaattctaccaacttacttagcaatcgtgtataattttaaaacttcttatgttttttggacgaagataatactccccgttataaaatctgagctaatataccacgggatcccgtctaaatgggatgataccgatcaagtatcagattgatctgatacccgtaggtaccagtcaccaacctatacctcgttagtattagctaatgcctgctgggaccacgtacctggtcgatacccgatggtactaggcgtggtacctatcagtactagacctggtacctattgagtatcagaccagagcttagaggggaagagaataagggatgaagatggttatatgtgttggttctctcacctggagatgatgacgccaagctcgatcaatgccaaatccaatagccgaggatcttggggtttcaaatttgtcgaacatgagcaacaagaaggacacttcctcccctatcctcccttgcacttggcggcaatggtggtcggtggtggtcttactcgacaacaatggcatcgacactgcctcatcctctatcaacggtgatggaggcggaagctccatgtcttccatcaatgcaatgatggcgcttcccatctccttcggctacgacttcctttgtcctcgcagcgtaagtccacctaattttattgtggtcctacggcacaccctagccgatatgggactgttttagtgcttacctgcatcttgccctccgacttgttgctccgcgttgatccttcttccccgccgtgtcggtccaagtcttctccgctgggcataggtgccggagaggggatctcgccccggatggtagggattgggtgacggtatcttgtattttctaacatgggttatttttctttagtgacaattttgttctttcccctactctaacaccacaaaatcttccccttgagttgtgattcttactatgaacatactacgtccaaaccgagataaatatacacgtctaacagaatatctaaaccgagagaaatcagaaattagaaagagaattcacatcaacattgacacgggtggttttcgcgctgcaccaatcacgaagcacccaagcacgaatctcggagcgccgatgcctcaacgcatctgagaaaccgttccaagctcgccgccgacgacccggccggaccctcccacgccgccgccatcgcgcgcgcgatctcccccgccttcctcctcatcgcctcgcccttctccgtctcccccatcaccgcccccacggcctcggccacctccccactctccaccgccgagctctccaggttcccgcgcgccacctccacgcacaccccccactccaccaccaccatcgcgttgaagaactgctcggcccccaccggccacccgagcagcggcacgccgtggcggaggctctcgaggatggagttccacccgcagtgggtcaggaacgcgcccgtggacgggtgcgccaggatccgcgcctgcggcgcccacccgcgcaccaccagccccctgcctgcgcgcgccatccggtcctcgaatccggcggggagccacccgggatcgaatccgtccttggggtcgaaccccaccggcggccggacggcccagacgaacggccgcccgctcgcctccagccccagcgccagctccgccatctgacggatgctgatgctgttctgcgacccgaacgagatgtacagcaccgagcgccgcgggtgcgcgtccagccaccggatgatgctggtgtcgtcgtcgtcctgcgatttcgaaggatccggcgccgcgaggatcggcccgatcgcccatgtctggacgccgaagctcgctctgagcatgtctagcccggaggtctccagttcctggatggtgttgacgagcacggcgtcggtcttgcggcagcacgggatgacccgccggaagaaggccgtccaggggtccgcccccgtcgcggcgagcatgtactgcgggatctgggtgcggtggaggacgacgtcggggaagtcgggcagcagcgggaactcgtcgccgccggccgtgagggtgtgcgggaggtgctcccacacggagaagaagacggcgtggccgaaggcgcctccggggaggaacacggcgtgggacgcgccccgcgcgcgcgcgacgtcggccgtccacgcgaagaaggagtcggcgatgacgcagacggggggccggatgccagcgacgaagccatcgaaggccgggcggagggactcggaggcccggaagagggtgatgaactggtggacgtggaggtcggcgagggactcggcgccgtcgggcagaccgtggtcggcgggcgcgaaggggagcgcgtggagccggatcggaggggaggtggccgggagggagagggagccgaggaggcgtggggtggagacgagcgtgacggcgaggcccgggcggagcgtctggaggtggccggcgaggcggaggaaggccgggatgtggccgtgcgcgaggaaggggaagagcacgacgtgcgggctcctcgcctcctctccctctgccgccatggtgaggtgatgatggggacggggtgttcggtacttcggtggaagtggacgctgagagtgatgcggctcccgcgctgccactgaaaaacaaaacgctgatgcgctgaatggctggaaaggcgccctccactcaccgggtgagataccgagatgtgaccgcttcctttctccaattcttcaatttcgtccaactgaactgtgcactgacgccatgatcaaacaggtccaggtttgagcagcagagcttcatcagattatcaaaaggagtacagaaagacgaagggatggcacattggtaccgatcgatgcaatgtctgcagttctccactgcattctgctggtactcctatatgtactctggcccccggtagtactaataccacatgagtaacatcagtgattatatgattattatcaaaggcgaactttaggaagggatggagatactagctgaattgcttgaagcagaaccgtagatggagataatcagagctttccaaacgggaacactattaacaggtatttggtctatcgactattatttacaacaactgggcaatgaactcgaagaaggaactagaaaaacccacatcaaagtcagataaaaaaactctagaagtaagaactgccatcccgcccatgaagaactctgcggctctaccggtaattcttcgttgttctgaaggatatgctgagagacactggatgtacagaatggcatttgtatgagtcagttttatttatctccctagaaatatgacataaagaatgaatgcaaactcccaaaaaattcctacataagtaaacagagagagggagcaaaagggcattgccctgactagaacatatataaatacatcataagttatccttctttgaagaatgatcagaagcaggcgaggatgaagagctcatcctggccctatctctagactcacttaacataactacaacattccgcatcggtggtctgtcatatggagacatactagtacatagcaatgcaattttcaagacctcaatcatatgatcgacagacgttttgtcttccaaattcagattcttatcaagaatccctggacccaaagaattgtccctgatgtaattctttacccatgttaccagatcacctcccagttctaatggttgtacaggggcacgtccggttagcagctccagcagtacgacgccgtaactgtatatgtcacttttttcagtaaccttcatggtgtatgcatattctgatcaaaggagaactaggttagtactttgtaggaaacaatcacatgtactttctgctagtataaagcaatcaagtggtatagtagcctaggattttacaagcaatttcaagtaaaagagataagagctataacaggaataagtatgcaaagtaacagtagaagactcaccaggtgctatatatccatatgaaccagcaattgcagacattgattttgagtatggcatgtctatcacctttgccaatccaaagtcaccaacatgagcttcaaagttctcatcaagtaaaatgttatttgattttatatcacggtggatgatgcgaggtttgcaatcgtgatgcaagtaagatagcccttcagctgatcctagggctatcatgaagcgtgtctcccaatcaagtgaagacgaagattgcccatgaagtaactccccaaggcttcctcttggcatgtattcatacaacagaaggttggaaccctggtgatagatgaacccatataacttcacaatattacgatgccttatctttcctagagtaaggatctctgcacgaaaactattgtctgtgttgcttccctctctgttagaagccagcttctttacagcaattgtctgtccagctttcaagatggctctgtacactgttccacatgcacctcttccaataacacaactctcgtcaaaattatttgtggcagaaaccaattcctgaaatgtatatgcatccttggtagaaacctgcatgttagacccagcagaaaatatttgcttgtcttgcaaaggagctactgtttctagtggttttctcatatgatacacaattataacgataagaataagtgaaattcctccaataacagcagcaacaattgctatgaccttgcccaaaggggggctgcctgaattggatgactgggaagaagatattgactcagacccacatttgccaagttgtccgccacatagtcctttgtttccaagaaagctggttgacgccatgttatcaaaaagtggtatagtggggagagcgccggtgagattattgtaggagacattgaactcaagcaaactagacagatttgcaaaggtatctgggatttcacctgtcagcttgttattattgagaaacaaattttccaataatgcaagattaccaagctctgatggtatgttgccagagagattgttataactcaaattcatggcgatctgcaaacttgagagtagtccaagctccttcggtattccaccagagaattgattgccaccaatctgtagagctgtcaaatgtgaaagtttaccaagaataggtggtatctctccagagagcctattgtcagcaaatgatagcagctccagctgaggcaggctgccaacttcatttggcaatgaaccttcgaagctattttggctgagatctaggcgttgcaacatagtgcaattgaaaatttctaatggtatgcttccgcctagtctattggatgatatattgaagacgacgagctttgacagattacctatttcttgaggcaactctgatgtgaaatagttatttgttaggtcaagcctttggagagacttgcaattgcctatctgaggaggaataggaccattgaacttgtttcgacccagctcaattgttgtcaaattcaccagattgcagagatcagttgggaagcttcctgtcagactgttatcagcgagacgaagctgcaccaaggatttacaactggtgattccatgggggatgttcccaatcagcttgttagcccccaaattcaacaaaataaggttcgactgcctgcaaagatctcgaggtatctgcccggttatattattatttgagaaatccaccacccaaagccggctatagataccaaatcttggaggtatgtcacctgacagcatattgttgaatagttgcaattggattagtctgctcatgtactgaaaacaggctggaattgggccactgagtgtattgatcgaaagat

SEQ ID NO: 58424 - DNA, 16909 bp, Oryza sativa
catcatctttcaccgaatcactgatcaagccgccaccaacagcaaaagagaccgcctccgcccccctctacctccgcccaagagccgcacaacacttcgcctcctccaccgccgtcgccatccgcaaaccaggcgaaaccctaacctcaccgcctccgccaattcgcgagaactcgccgcacctgagacccggccttcgtccgaaattgaggtgaccagcatcttctacacgcgatgagtctcctttaccctctcttttcctggcaacatcaccgtagctcgccggagcgactcccgcccacccgttcccccgccgccgggaagggaacggttggaatttcacagttaagatgcataaatgcattgttagatagattaactccaggggcaaagcttaggatagtactctattactttaactggtgatgcatgtactgaaattattctgaagactgtcaatcacaaaagttatatccttcatcaactttgtattcctcgttgctacttgcttctgtccctgtctaatactccctccatctcaaaatgtttgacgctgttaatttttttaaatatttttgaccattcgtcttattcaaaattttttatgaaatatataaaactatatgtataaataaaagtatatttaacaatgaattaaatgataggaaaagaattaaaaaatacttaaattttttaaataagacgaacggtcaaacatgattaaaaaagtcaacggcgtcaaacattttggaacggagggagtattattatttttcccattggctaagcaataaacttgtaaatgcaagacagagaagagaaatgaaaattatgacaatgatatataattctgtcaaggaaaagcaacaggggtatattatttggttgctggtttgcatctgaagagtacttagtgcgtacatcttctgcaatttgcatagcttctttctatgtggtcaacaaaatgaaaaacaaaatctcttaatggcttaagtaaaattagagctccaaaccaaagccaaaatccgaaaacaatgccaacaactaaagagtaaaataagaacttatcaagttctttatgatcttcaattctctgatccaatctagatgcccggcaggctattctcaaagggaagccacaaaggcccaaattgttgctatatattgagggatccacaaatgtctgaagttgtcttccggtgggtatgcttccccataagcggttatttgagagatttaacacactgaggcatggtatatttgcaatggttgtagggataacacctgaaagctcattccatgataagtcaagggattccaagatattcaaattgccaattctttctggaatactgcctgaaagatcattccttgacaagtttagataccggaggccctgaaggtatgttagctcttttgggatttcaccgtaaagtgaattgcttgataaatcaattcctgtcattaacatagctgttccttgaaaagtttcttcatgtcccttccataatatgttaaatctgtctctagactgatcaagagggaacggataatcgtatcctcttgaaggggcacttttccaattaaaagtccctattgtggggaaggtttttgcttgtttcatggatgataagttggcaaaagttgttgggatgaatccagttaacccattgctggccaaatcaagaagttgaagctgagaaagttgggataattctgtgggaatctctccactgaaattatttgatcggaggagaagaattcttaggacaggaagactagttcctatccaagagggaatcttgccaaagaacttgttgctccacatatcaagcgtaacaagtgctctgcagttgcgaatggtggctgggaaaactacagagaaactattgttagcaagatgcagagattggagaggaagttcagggcttcttgatgctggcaattcacccgagaagccgttgccagagacgtccataaacagcaaagcttgcaactcccaccaacaccttgggagctcaccattgaatcggttatttgatagatccaaaaactgaagagatgacaatgtacaaaaggtcgaatcaaggttgccggatatgctgttaccgttgattgacagatatgtgaggttggtgcactgtccccagtcagacgatagccgaccggtgagcttgctcccggatatgtccaagtattccaagctggggtgtatgccgaaggcatctgagatgtcgccggtgaagtggttcccgtccagccgcacccggtataggcttgtgcagttcttcagacatggcggtagcgtgccgctgaagttgttgtggttcgccgtgaagcgctccagcgcgaagccgtcgcagatgtggcgcggcagctcaccggagaagctgttgttggtgaagctcacgtgctgcaaggctatgcccttgccgaggtccggcgggatggtgccactcatgtagttgttgaacacggagaggtactgaaggttcctgagggacgagatggtggcagggagctcgccttgcagacggttggtgttgacgtccaacctttgcaacgctgtcatgttgccaatctcaggtgggattacaccggtgagatcgttgaagaacaacgccaaagccgtaagctgcttgaggttgccgattgatctagggatcggtccggtcagcaagttgtttgacaaatccagctcttccagattctccaaatcgccgagttctgccgggatggatccgcaaaggttgttgctgaacaggtaaaggattttcagtttcctcgccatgccgacctcttttggaatcctgccagtgaagaagttgtactgtacttggaacgatatgagctcgggccagctcgtgaacaacaccgaagggatctcaccggtgagcccgttcatttcaagtccgaactcccgcattgcgcacatcccggcgaatgccgggggcaagccaccggagaggtggttcacggatatctctagaaaagtgagattcttaagatttcccagctccggcggcagagttgaaacaagcccagcgttctttatcttgagccgctgcagcatctggagctggccaagaaccggcgggatcgccccgccgagctggttgtcaccaagttcgagaatcctcaactgtgacatcgacccaaggaactctgggacgccgccggtgagattgttggcggcaatcagcaggtcctggagcttcgttaacctcctgagcgacgccggaatccggccagagaattcattgttggacaagttcaggtacatcagattcgggagcttctccggcagtgtgtccggcatcagcccgaacagagtattctgcgacaagtcgaggtaggtgatgttgccgctcttgaggatgaagtccgggaagctaccattgatggagttgtcgtagagcgacatgaatgtcacggtgggcatcggcgagaacttggcgaagtcctggtcggtcaggtagtttgctcccaggtcgaagtgggcaatcttggggagtcggctgagctggtgcgggatggcgccaacgaggttgttgttgtagaggcagaggtcgacgaggccggagaggtggccgatctgcggcgggatggagccgttgaacccgttgtcgccgaggtcgagcgaggcaagggagcgcagttgcgagatgccggccgggatgtcgccggcgaagctgttcccgttgaggtcgagctcggtgagcgccgggaacgcggcgaagtcgagctcgagcgtgtggaggccgccgccgagtcccagtccccggaggcgcagcttcgtgacgcggccgccgccggcggcgtcgcagcccacgccgcgccaggtgcagaccggcgaagcccgcgtccagccggacagcgcgaccgggtcagcgaggctcgacttccatgccagtagcgcgtcggtctgctgggacgatgctgcggcattgactgatcctgggatggaagcgatcgccacgaggagggggaggaggaagaaagggtggacgacgggggccatgcggagtaaaacaccaacgcagtgatcctgcattgccgtcgtctccggctatgccttttcgggtccctctttcaaatatgaatatatgatggtgccaatagctaactatatataaatataagtgatttatttttttttagataatggaatataacattccggtctctactcagaacgagctacaaccaattattacaaagtagcactcaaagaaagagtgtagtttaaattaaaaagaacagaccaaacaaaagcagaggaaatatagccaaaataaggagaacacgtttattcaattctatttgtaaacatatttattcaagtttataagagtgatttattagttcgtaaatattttttggtgtgattatcctactgatgattacacactagaactagatccagtgatccaccggaatgcgcgcacacataccgcacgtaatgcctatagcataggcgcatatgggaacaaattttaacactaaagatctgagatttgaactgggtgttccaccacaggaaccttaaccaacttaactagcctttatttggtcgttgttggtaacgattctaattaacttccgatgatccaatagaatggtcacgatcaacccatttttgatcgggtgtaccgtgtacctatatcggttcacagggagtaggcttcaacgcggtagacgttttgttccgaatttttctatagcaaacctgatctaacgatacaatgaattttttctattcacgaagaaaaaatatttagaatcgcaatgctactattaggggtgaaaacggtacgaagatttccgagcttttcagctgccgtttccaatttgcactgtctgtttcagtcggtatcggtaaccaacggtgatagaaatggaaacggttatatctttcggaaatggtagcggaaatgggatggatgtttttccgaccgtttcatcggtaaccgtatttgtatggtaatttccgtcaaaattccgacagttcctcaacggctcaaccagcccaatctatctgaagcccataaatgaagaaagtctgataggcttgtcctataaaaatttcctaaatctaaggatagaatctaaagatagggaatagaataaaaaagctgttggtgatgctattagatgaataacttaaaatatataataacctcaagttagttgggtcactcaaccaaacaacccctaacaatatcaccagaatcccctatttgacttctgcttaattcgcagagcgggagtggctaaaacgtagcccgtgcggtggaggccaactattcaggccaccagcgagaaatgcccagaagttttctggctagcttcacaaggtggtgggctagaggatctggatttaaaggctcaccccttctaattatttgatattagattcttctctaatattcgagttttttttattcaggccaccagcggcaccgcacgacgtaacgaccccgcgtcgccgtcgtctccggcagtcgcatactcgcactggcgcactgctagtggactagtgtcgctgccaccagtggtgtgcagtcgttgctttgggtgctcgtcgtcagtgccttactcattacccccactgatccagttttgctatttaaaaaagatagattcttggggtgaatggccgggtgtaattttggtgcatgtatgtattaatttgtacgcttttcggcgtgcacatatattcattaggattcgctaaaattcatgcacttgtaaacggtggctgatgcaggatttctagcatgggtattcaaagttacaaagtagtattgtttaacacaactaaaaaaaatcagaatattgtacactaaactacacaataacataataatatttaagggacctatattggacgttgttctttcaagttctttttttgaataagttcacctgacgtccctcgactttatatcgagtttgtatcaggtcctcaatccccaataccagaaatctttatccttaaactattcaaaaccgtttaaagttaatcccaagactctataggccaaaaattcccctagttttgctgacgtggcatatgtcgggccccacatgtcagtgtgtcgtggcattacatgacgctacacgagtggttgtcaccgccggtcgccgcggcgaagaagcctaatgagatcgccgcaacaccgccacttgcggctgctccggtgacccggagcatgggaagggagcggcgcggaaaagaaggagaaggataagggctcggagaagaaagctacggtgttggagaagcaagccaaggcgccaccggccgcacccgtaccgtcgatgcccgttcggcgccagcgctgtcatcgccggagcaccctcacagggctactcgccgcatatttgagggcctgtcggtgctggtgcgggggcgccgctgtcgaggaacccccgacccggacttcacgctgttgcgggcggatcaagcggcccctcaccggctgtcgaccccgccgcctgatctgaaggatgagcgcgcggctgctggctccatctgtgctgcctggttcattgccaacaccgtcgttcggatcccggcgccgcccaggcttgccggccgcctccccctccccctcgaccatgctcatcgcactgtcctcgatgcccgcctccccacgccatgcctcgacctcgccggtcgtgccaaggttgtcaggtgcgggaagtggctacggtgacggtggtgcgcgtgagcgtcgttaggtgcggtggcagagctcagccggtctcaccggccgcctctaccccatctaccgccactggcctcccgtgaagagaagagaagagaagaaaacagtagagagaaaagaaaaaagacaagagaagaaagaaaagatgtggacctcacattttttcttctcacttatatgtgggccccataattttttaatttttatttgtgctgactaggataccgcgtcagcgaaactctcagagatccatactgttatcgactctagattgcacggttttgtaaagtttaggggtgaagatttctggtattagggattagggatgtcataaactcgatgtaaagttgagggagggatggtgaacttatttcttcttttttctggcccagtctggcccagagccaatccggccgaaattccctgccccctgcaggctgcagcctttgctcttgctttgctgcctactgggctgctggcccgctctgccttgttgatcgatcggctgctctccgtcgcctttgccgagtcacgcgccgcagcgcctgcgcatcgctcctcatcccctacacgcgacgaatctcccttttagcctctatttttcctggctagatcgccgccgtagctcgctcgccggagcgactcccggccaccgcaccccctctttgctcggttttagccgccgcccgcggccacacgccgctggcctccttccagcagtccccgttcaagcctaccttttctgaaccgttcacagctagtgatttgtaagatgcattgtcaagttaattccaagggcaatcttaggatagtataactggtgataataaatatataatgaaattattctgtaaactgaatcacaaaaatctatcgttcatccaacattgtattccttgtcgttactatccctgtggagtatttttatttttttcataggctaaataataaacttgtaaatgtaatcgccatataattccctcgtagaaaagcaatacttcttagggcaatagcagtgcgtctacggaaaatgccgatcctcaatacttcttagggcaatagcagtgcgtctacggaaaatgccgatcctcatgtgccacgtagactaggaaccctattagccacatactccacagtgcaggtcacatatcacagtattgtgggtcccacctttctctcctccccttttcatcttcccgttcgtctctctcctctcttcatccctcatcggcagaagaaacgaaccggcgacggcgacgagctgcgcggcggcggtggtcatggtctcaagcggcggcggcggcggcggcagcagttgtggtcgggagcagcgtcgagcggagcggcggcggtcgtagttgctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgctcgctcgctcgcctcgcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgtgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcagcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgctgcccataatctcaacagttgcgagaggcgccgagcggcggggcggcggcggtcgtggtcgcaagcagcacggccgcggcggtcgtggtcgggagcagcgccgagcgtccggcagcggtcgagcggagcagcggcggcgccctatcctccatccccaacaacggtggcggcggcctggatcgacctcgagcttccgtccccgcttcatcccttccggtcctcgtccgcggtggctagctgcatcgccgtcgccggcaccctctcctccacccccaacgacggtggcggcggcgtggcccaagcggcggcgcggatcaacctcgagctcccctcccccctcccccttcttcatccctccgattctcgtccgcggcgccggcccggtcctcgtccacggtggctgcgtcgccgtcaccggtccggtcctcgcccgcggtggctgcatcgccgtcgccgtcgacggccggtggtgtggatgctctcctccttcggtccttctctcttcccggatgggcacggcatggcacacgaaattgtgtgggcccagaactgtggttttgatgaggaatgagtagcacgttttggctccccgttcttggtgaaccatccaaaagtgctgaggtgaaggggaatatctgagttggctagttgaggctgaatgacaccttattgtattgtaaatggccttagaaataaactgtatatatattccagcagtcctctttcttcttctatgaatgtaactaagcatattctgagaaatcagaacggacgacagataaatgtgtgtgatactgtaaatgaacgggcagtgctcctgcactttgatacaaaaacgaaaagaaaaagttccattttactcccttgaactatttcacgggagtacttaatctcctaaactatttttaactcattttacacccccgaactatttaaaacagtccacttcatcccctaacactatttatcttctttagttctcactatataagtcatattttgcattgaaattttggtagaatatagatgcatccataacttaagtctcaacattcttctttgattttttttctcactgtttacataggttgaaagcacttcaaactgatttaaacatcagaattttaaagttcaagcaaacgtcatgaaaaatttcaaaatatttttgaactttagtaattgtatcatctatggctctaataaatttcagcttaaaatataacgtgtataaagagtaaaaaaaagaaatgttattaaggagtaaaacgacatttctagtagtttaggggataaaacgagaaaaaatagttcaggggttaagatatccattgaattagtttaggagagtaaaatggactttttttttcaaaagaaaataaattatatgatgcatgaaaaaatcccttcaaaatagaaaggttgcggtctgcagacatcagacaaccacaaccagataggcatcaagtacatcatggtagaacgtagctgttctttttttaaaacaacccgctagtgcgacatttctattgataaagaaggaataaaatataagtctatagtcctgagagactatagtaaaaaaaaagaaaatatataaccacaccacgcatctgcgtctgatcctactgctaaatactgaacaaacacacaatacccctaaggaataagtcttctaaacgatggctccaaggaggaaaatgacgccaaaagcaccaccgccgcccatcctagagaaccaggatgtggttttcacttgaagaacctcttgggaaacgatagaaaacgcaacaacgtcccaaggtgaaaacggtgcctgtaggcgtcgccgttgccggcccgaaggctaggccttcgctccttgttctactctcccgcgctaaagagtgcatgccagattcaacagaaccaccagctaatccccttcgacgtgcagccaccgcgccgacgtctcgctgttggctggccatcaaagaagagtctcatccttcatcgcgcttcaatccatccacgtggttgggttggaaagggagagaatgagagagaagaatggatcccctctcccccgtactagcctgtccagcgtgaccatcttacggcggccgccatcctggctagctgctcggttctctagcggcgcgcttcggtggcggtgaggggagggagaggaggagagaggggcggtggcggcggtgctaggttttcccctgagccacccgcgcgtgggcgacgcggtagcacagagttgataaatgtttatgttctccataaagatgatggccctgtttagatccactgacaaattttttcaccctgtcacatcgaacgtttaggcacatgcatgaagtattaaatatagaaaaaaaaactaattacacagtatgcgtgtaaattgcgagacgaatcttttaagcctaattactccatgatttgacaatgtggtgctacattaaatatttgctaatgatggataaattgggcttaataaattcgtttcacagtttataggcttattatgtaattagtttttttattagtctatatttaatattttaaattagtgtccgtatatatgttgtgacccgctaaaactttacaccactggatctaaacaccctgatatttatcttttagtaaagatgcatctaacataccaagtttttatttggatagatagaatcggagttatttgttgcaaaaatgaccaaaacaaacatccctataaactgacagtggtatattacttggttgctgatttgcatctagcatatccactgatgtgatcacttatttatcactaatcacttagaatttattttggggtaaaataaaaaagatgctctaacttcaaaattaaaatatactaactacaccttgatgtgatctcctcctggcctggtcctctcgctctctctctctctctctctctctctctctctctctctctctactgaattctgatccaaattcgctgtctcctctgcagctctgctcggccgctctccatcgccttgccgagccacgcaatagtagctctgcctctgcttcatcccaagctttgccgcgccaacaaaccaagccgacgacaagctcgacctccattccatgcgctcgagctatgccgccaacggcaaaagagaccgcctccgccccgtctacctccgcccgagagccgcccagggcttcgcctcctccatcgccgtcgccggacgcaaacgcggcgaaaaccctagctttcaccggctccaccaaatcccgaaaattctcccgcacccgagttccttcgtccgaaattgaggtgaccatcgtccttctacacgcgatgaatctcctttaccctctcttttactggcaagatcgccatggctcgctggagcgactccaggtcacccgttgcgccgtcgggaacggttggaatttcacagctaagatgcattgttagattaacgccaggggcaagcttaggatagtactctattactggtgatacatgtactgaaattattctgaagactatcaatcacaaaagttctgtccttcatcaactttgtattcctcgttgctacttgcttctatccctgtgtaatattattatttttcccattggctaagcaaacttgtaaatgcaagacagagaagataaatgaaaatcatgacattgacatataattctgtcgaggaaaagcaacaggggcatattatttggttgctgatttgcatctgaagaatacttagtgcatacatcttctgcaatttgcatagcttctttctatgtggtcaacagaatgaaaaacaaaaactcttaatggcttaagtaaaattagaactccaaaccaaagccaaaacccgaaaacaatgccaagaattaaagagtaaaataaacatatatcaagttctttatgatcttcatttttctcatccaatctagatgcctggcaggctattatcaaagggaagccacaaaggcccaaattgttgctataaattgagggatccacaaatgtctgaagttgtcttcctgtgggtatgcttccccataagtggttgtttgagagatttaacacactgaggcatgacagatttgaaatgcttgcggggataacacctgaaagctcattccatgacaagtcaagggactccaagatattcaaattgccaattctttctggaatactgcctgatagatcgttccatgacaagttcaaaaaccggaggccccgaaggtatgttagctcttttgggatttcaccgtaaagtgaattgcctgataaatcaatgcctgtcattaacatagctgttctttgaaaagtttcttcatgtcccttccattgtatgctaactctgtctctagactgatcaagaggggactgatttttgggttctcttctgcggtgaggcttgggaacctggggtacttctggctgaaaaggactgctttccgcgttaaaatattctgtcgctggcaaggtttttgcttgtgtcatggatgataagttgccaaaacttgttgggatgaatccagttaacacgttgctggccaagtcaagaagttgaagctcagaaagttgggataattctgtaggaatctctccactgaaattatttgatcgaaggataagaattcttaggagaggaagactaattccaatccaagagggaatatggccaaagaacttgttgttccccatatctagggtaacaagcgctccacatttgcgaacaatatttgggaaaactccagagaaactattgttagcgagatgcatcgattgtagaggaagttcaaggctttctgttgctggcaattcaccataaaagtcgttgccggagatgtccataaacagtaaagcttgcaactcccaccaacaacttgggagctcaccattgaatcggttattcgatagatccaaaaactgaagagatgacaatttacaaaaggtcgaatcaaggttgccggatatgctgttaccattgatagacagataggtgaggttggtgcactgtccccagtcagaggacagctcaccggtaagcttgttcccggagacgtccaaatattgcaggatgcggtggacgccgaaggcctccgagatgtcgccggtgaagtggttctcttccagccggacccggtatagcgccgtgcaattcttcaggcacaacggcagcgtgccggtgaagttgttgtagttcgccgtgagttggtccagcgcgaagccgtcgcagatgtggcgcggcagctcgccggagaagctgttgttggtgaagctcacgtgctgcaaggctatgcccttgccgaggtccggcggaatggtgccgctcatgtagttgttgaacacggagaggtactgaaggttcctgagggacgagatggtggcagggagctcaccttgcagacggttggtgttcacgtcgaagctttgcaacgctgtcatgttgccaatctcaggtgggatcgtaccggtgaggttgttgaagaacaacgccaacttagtgagttgcttgagcttgccgagcgagctggggatcggtccggtgagcgagttctccgacaaatctagctctaccaggttctccagctcgccgagctctaccgggatggaaccgctaaggttgttgctgaataggtaaaggaattccagtttccttgccttgctgagctccgatggaattttgccggtcaacgagttgttctgcacttggaacactatgagctccggccagctcgtgaacaacgccggcgggatctcaccggtgaggttgttcgtggaaatgccgaagtaccgcattgcccgcatcccggcgaactccggcggcaagccaccggagagccggttcaaggacagctcgaagaaaatgagattcttcagatttcccagctgcgacggcagagttgagacaaggccggagttcttgatgtcgagccgctgcagcatctggagccggccaagaaccggcgggatcgccccgccgagctggttgtcgccgagttcaagaatcctcaattgcggcatcgacccaaggaactccgggatgccgccggtgagattgttgccggccatccgcaggtcctgcagcttcatcaacttcccgagcgacgccggaatcgagccggagaacgcattgatggacaggttgaggtacctcagattcgggagcttctccggcagcgtgtccggtatcttcccgaacagagtattctgcgacaggtcgaggtaggtgatgttgccgctcctgaggacgaactccgggaagctgccattgaaggagttgaggtagagcgacatgaacgtgacggtgggcatcggcgagaacttgccgaagtcctggtcggtcaggtagtttgctcccaggtcaaaatggataatattggggagacggcttagctggtgcgggatggcgccgacgaggttgttgttgtagaggcggaggtcgacgaggccggagaggtcgccgaactgcggcgggatggagtcgctgaagccattattgccgaggtcgagcgaggtcagcgagcgcagccgcgtgatgctcgcggggatggcgccggtgaagttgttcccgttgaggtcgagctcggccagcgccgggagcgccgcgaagtcgagctcgtcgaggccgccgccgagccccagcccctggagccgcagcttcgcgacgcgggcgccggcggcggcggaggcgtcgcaggccacgccgcgccacgcgcacaccggcgcggcgcggctccacccggacagcgcggccgcgtcgtcctgcaggctggccttccacgccagcagcgcctccgcttccgtcggcgtcgccgcattggccagcgcagggatggcagcagccgccgccacgaggatgatcagcagagggaggacgaggcgtgccatgtgggattgtgggcagtcgacgccttcattggcgaactgttgtgatacgacgagtggctaaaacaccagcaaatgggttcgtcgcacctccaaagccacgtgcgcgtgaattcatacgagcgtcgccgtcgcttcccgccatattggactctggctaggtcaatcgttcaaaatgggaggatttcttccacacctgcgtagctatctctcttacagcaatgtgaaaatcgcaagaatcactctgtaaatgtcatttgagtttgagattttttttatataaactaatttattacaaatatccccttctaatttaccttggttattttgagattcttcctcagttgttgtcgctcgcaccttttttttctctctcctcaaactcaaggtaacatttaggatggttttttaataattttccaatatatctttaccaattcataagtaaaactcgatgcaggaaataaaaacaacatgtatttgttgttaaaaattcaaaatgtctctgcagtttttagtgtttaacacctttaaatattagacatatatttgatcatttatcttattaaaaaaaataaaaaataagtcatgctaaaagtatatttaataataaattaaatcacaacaaaaataaataataaatacatatatttttaaataagataaatgattaaacatacgtgacataaacattaaaaactagagggaatatcttttattggcttctatctagttttagagcacattgtggctatgttaggagatttattctaaaaaataaaaaccaaaatatatttaaccggaacttcctttttaaataaaaaataactagcacggtggcccgcgcagattgcgcggctaacatcattatattttctctcatataatagcatatatgttttctcaatgtatcattcaaatatattaaaataacaacataattttaaattttgtactaactttacgaaactactaatgtttaatatccata
